United States Patent 10,407,724 (METHODS AND COMPOSITIONS FOR SCREENING AND TREATING DEVELOPMENTAL DISORDERS) - sequence listing, part 91

SEQ ID NO: 2638 - DNA, 193078 bp, Homo sapiens
tagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaaacaaattagaattgattctttaaaaaattgtcaccagttcaaaggatttgactattttcaagtttcttcctaaatatttacacattgttttgcaggagtgttggaccagttagaattcccaacagccatgcttcaatgcacacagagccagtttcacatggaactcctgggacgtatttctgaacaactgtttataatgcttttcaactctttcaaagtccttgctttacccatccctatgcaggtgcacatggcctgttacaaacctctgcctccagaatatggacagtgagacacagaggggttgcctgctctcactaaatctccagctttgggactcactttcagtgcaagcacacagatgaaggttctcaagagccctcctgattcattccctcccacaggccaggaacctgtggcacaccctaaagagaattacactgttgtgtatcctccaggaactatacgaggtttagtgtggtggttcttagcaacagaacaaatctacagcactttcacttgttttcaagtaaccagattagcaccagtcgctaattttacatcttgccttcatacactcttgactacactttatttcccagtaagctagtagaaatgataggagcacatgacaccaagtgtttccacttccttcgccactcacctcctcctccccaccggctctatgggggaattatggaattgtgctggatagtggccatgcaggagacactgctcacgctttgttgtaaccatagtcttaaggaaaggagactggacaacaccaattaactttttttgggtgctctcctggaccagatgccaacagagcttttgcacatatgatcagctcatcaggcactgttggcttccttttctctttcccgcagaggctgggatggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccatatatcaggcccaagagataactatattccgatgggagaatcagttagtttcactgacatatacaagtgataacaccacaagagtcaaacatgcctacactccattgtccaaaattacccatgggacgcttggggcagagaaaagagaccaactacctagccaagctaagcagagacacattctccaaagtcttttttccctaaggacttggggtggcaggacatgagctatgatgtatggctggggtcacagggaggtagatgtgtctcatctgtttccattttccaatatccaaggctgacaacacactaaataagcctacacagctctgaagtttttctcagtttgatgaacagctggagaacaggagttccagagtcactgttgctctgtgggatcggggtcccgtctgtagctcaagggtagggcagaggctggtaccaggcatctggaaaagatgaaaccttagcagacttagaccatggtgcacaagatatgcccataagcctccttattcccctcctcctttctgtttacagtaaatatgtattacagttctgaaatacagtaaatatgtattacaaaatgtattaagagcctcaatatctatggagcagaactaacaaggccacagttgaagtccaaatcctgggtcaaccaaacaactttacttttgttccctggccacggatgttacacccggccccaggcacctgactcagcaagctgtatgatggcacgtgtcttagacagcaaggggaatgatcaggacaggatgcctcacctatgtccctgaaagaacaacctcaaagccccatcttaccaagtatcactttttatccaaaggtgagcatgcaagtgcatgcgcgcacacacacgcgtgcgcatgcacacatggatgcacacacacacacacattctcagtgacaagtcctcctgtggccaaccttgcccctcactaataatttgcacaaattaaaagataaagcagcttagggtcattcaataaatcataagcacaaatcaaaatctatccactcaattaaatctgaacctagctggaatcacatcgtttttgaacgctgaagtggctaatttccgaaggatgtaagaagatcattcaacacatggttattcaatatcagccccttttctctgtgatttttaaacttaattagcatttagtaaagatggcatgatgttccatagagcagcgatctttgagggattacctccagctcagaaggggggaatataaaaccaatcagtccattgatagaggggccccgtgagctgcccagcattgaaacaagcaccagaggtgggaaatggaagaaaaagaatgagtttgaaaggaatcctgccagccctgtgtccccagagtcatccccaccagtcctggcccacagtggtccaagaacaacaaagacagcctctgcagggagaacaccgggctgtgtttgcatctctgaccactcccccagcagtctggatcctgccaaatgaccgctggtcaaacacgggcgggctccagctggtctcattcctgttatgactgcacttgggttcattaacacccagccctcccctgtgggcatgcaaggcaggaagccttctcactggcttgttttgcagcctagctttttctttctcagaagtggggcaggtggtactacattcgagtaaaatcatgcttagtggggaagggaacaggctgcccaggcttggggtggacacctctggggccacatgctcagaggctctctggctgcctctctcgttagtcagcctttcctggcatacccccggtacgttaaaccgtcgtctgaaatacccagcattctgccgtggaaagaaaacattgagctcggaaaacaggtgggatgaggatattccagggacctggctcgagagcctcagcagggatcatgttccccagggttgtccccaaagacgggacacttttgtgcacaagctgcagagcatcagaaaatcttggggactgcaaagcacatcacatgtcttataggccagagcttctcaaattgttttgaagggccattctgtaaaatttcccatctactgtagatggatacttttgtcaaatactagaagaacaaattactagaagagtgaaacttgaagctgcaaaatacaaatgcattgagtatgtgctgggatgttgcatcaatatcaagttgctgtatacatttctaaatgctcactctcaatgtctgtacctatctcagcacaggccactaacaactcgttcacagagtatatgctgaattgcgctggtctagatccttgccactcaatgtgtggttcaaggaccaagatcatcatcattacctgtgaacttgcaagaaatgcagaatctcaggctccacctcacacctattgaataagaatctgcctttgcataaaattcccaggcaatttgtatgcatgtgaaagtttgagatgtgctagaatagaccaggcttctgagctaatagattataaatgttttctttccactcaaccttcacgatgtctttgagtaaaggagatactcaacgttgaagtgccttaactaagttggagagcagagggggatgtaaaaattggcagggtctgcaggctgaaatgttttatgggagttgagtaactggcaagaatgaagaagaaaagctgagaaaactgaatagcccatctgtcgccaggtaactctatggttcagaagccaccagagaattacggcactcacttgccagatccaaaggaagcccaggagagtgagcacaaagggtgagagacatttatgaatccagtattgggaaatgggcattgcaccaggatgaagcagagagcccaaggtcagggtgctggaggagacaacttgattctgtaatggagattgtgggcggcccacgcagagacagcaggatgtttatttagatcttgtctacttagctggttgactggctgcaagtttgattatcattcaccaggtctctatgccctcagccggaaccatgttcctaatctgcttggccattaagggctctctgaaccctgctctgtctccagcatagagccagagaggctggaagctccccggggtctctttctgcacctccctcccgcggcatgtctctgcttctgtctgggactgcaggccagcttcaatcaattcccaccgaccagcagcccagatcttaattaaaacattcaacctgcacacaagtgaggagagtagtcacagccccctcagtccagctgaaaggaaatcacaaggaatatgtacagattcataagagacttctatctcagggtgcaggtggggtacagccaatccctggttcccttttcggagcactcccatacacctgtcctccctattcctgtctcacctgcactgtgactgtcacttcgatccgacttccataggagttctctccccttctgccccaaatcactaaaacacagagctggggagaccctggaaactgaggacccccaatgttaagtatcttgcccaaagtcacccagccacattgtgtccctgcctgagagtaacaagaaaatgcatgatttgtaagtcaatcattcatattagtcccagtcaccagatattccaccacgatgataattttgtacttattattgtattgtaatagtctaccctaactaacaattttggttcagaaaaaaaaaggtctccttattaatgtcttttctgtgtcctgaccatgtatttttagcaatccaactaaggggttccagctgttaaactctttgaaggataagtacgtatgaagagtttcacccaattacttctcccaggggtcctaagaggctttggggccttaagttgggactacattggcttcaagggtggataagacagaaactgtctcaacctttgggttgtagaattcagggtgggatgagctcaagcctggggctcatgccagccctcccttccaattctacaagattctaggaagcattagccttcattattctattcctcaaagcagggcttctttctggcaagtcccataacatgagaggagcctgaatcccacaagccatgactggcagctcagagcagaggcgtgtccttcacacagctctggctggaagagacaacattctcaaaagaaaagggccccactgatgaccagtgatgatgagctttttttcatatgtttgttggatgcataaatgttttcttttgagaagtatctgttcatatcctttgcccactttttgattgggttgttttttttcttgtaaatctgtgtaagttcttgtagattctggatactagccctttgtcagatggatagattgcaaatattttctcccattctgtaggttcctgttcactctgatgatagtttcctttgctgtgcagaagctctttggtttaatcagatcctatttgttgtctattttggcttttgttgccattgcttttggtgttttagtcatgaagtctttgcccatgccaatgtcctgaatggtattgcctaggttttcttctagggttttcatggttttaggtcttacatttaagtcttgaatccatcttgagttaatttttgtataaggtgtaaggaagggatctagtttcagctttctgcatatggctagccagttttcccaacaccatttattaaatggggaatcctttccctattgcttgtttttgtcaggtttgtcaaagatcagatggttgtagatgtgtggaattgtttctgaggcttctgttctgttccattggtctagatatctgttttggtactggtacgatgctgtttttgttactatagccttgtagtatagtttgaagtcaggtagtgtgatgcctccagctttgttctttctgcttaggattgtcttggctatgtgggctcttttttgattccataagaaatttgaagtagttttttttccaattctgtgaagaaagtcaatggcagcctgatcaggatagcattaaatctataacttactttgggcagtaagataccatctcacaccagttagattggtgataattaaaaagtcaggacacaacagatgccagagaggatgtggagaaataggaatgcttttacactgttggtgggagtgtaaattagttcaaccattgtgaaagacagtgtggagattcctcaaggttctagaactagaaataccatttgacccagcaatcccatcactgggtatatacccaaagtattataaataattctactataaagacacatgcatatgtatgtttactgtggcactgtccacaatagcaaagacttggaactaacccaaatgcccatcaatgatagactggacaaagaaaatgtggcccatacataccatggaatactatgcagccataaaaaaggatgagttcctatccattgcagggacatggatgatgctggaaaccatcattctcagcaaactaacacaggaacagaaaaccaaacactgcacgttctcactcctaagtgggagttgaacaatgagaacacatggacacagggagggtaacatcacacactggggcctgtcggggggtcgggggctagggaagggatagcgttaggggaaaacctaatgtagatgaccggttgatgagtgcagcaaaccaccatggcacatgtatacctatgtaacaaacctgcacgttctgcatatataccccagaacttaaagtataaaaaataaaaaataataacaataaaaaagaaaaggcccccactgaaaacacagccatcattaacttctctgtctggcaaagcaagccccaggatgtgccacatcatggcccccgcttcttctctgccccatgagtcccagcccccttctgcccaccaaccactctccttcttgtttcctgagacacacccagccccaccctgcctttcagcaggcacttgcactccttgaaagtcccaaggagcttgtacttcctcacattggttgggcatgagctgggctaaggcctttctgttctccttttgtgcttctaatgttgaaaaatgatgtctgtaataagacagtaaattctttgctggtgactcaaaagccggtaagcagagaaggcagtggatgggaaggaacgcagagggcaaactctagttacttctccccataccacagcatcacagtcttagggagtttcccttttgccccatccctttcgagtaaagcaaagggatgatggaatctagtttctgcttcccctcaatgccagttagcattagtggaaaggagagtctgtgcccagccaggaggacggaagggtaccagcagctggcaggagcaggtatgtgcacgtgtgtgcatgagtgtgtgtggccatgctgcaaggtggcatcaggtaggtgacatgggaaatgcaatgcccagcatcagtctcagggcaggagaactggggctaggggaatccacttcccttcccttactcgatctcccccatagtgactggcaaagcatgttgaagaagaagtagaaactccttgcatttgtcttctgttactggggacagcttgtgctgatatgttctaattacttctctggttcacccatgtgaactaatgggcaacctcaagggatagtgcaggatcctggggctagccaaagtaaagcacccttacaaccctttagcctgagggagcaaagaatggggatgtttattggaagctgaaaggagaatcgtgtagggcagatgactttgagaagtgatcttaggtaaaggatgcagccaaccccaggctacccagcaggggtggacagtgggttaggggggcagtgctaaaagtggggaaccagtgtgaattaatctccaacctctatcctttccatcccaccagtctcctgccggggtcctcactgtcctgttcatccagtagtcagaggccagggaggccaccgaggcagactccacaatctttggagggcacaaggctctggagcatgaataaaagattcctggaatggctgggcccggtggctcacgcttgtaatcccagcactttgggaggctgaggcaggtggatcacctgaggtcaggagtttaagaccagcctggccaacatggtgaaaccccatctctactaaaaatatgaagcattagccaggcacggtggcaggtacctgtaatgcaagctacttgggaggctgaggcaggagaatcactcgaccctgggaggcagaggttgcagtgagctgagatcacaccattgcactccagcctgggcaacaagagtgaaacttggtctcaaaaaaaaaaaagaaaagattcctggaagaagcacacattggtgtgcatgggaattactcattgatatttctgtcctactagaacataagttcctggagggcagcatctatgtgccaagggcatgatgggccctcgataaatatttattacattaacaagagtatatatgaagaaatgaaggaatggaagggcatcatggagggaacaaagctaactaaccttcttgtagtctgtaaatgtgcacctgctatcaggaggccccagcctgtctttcagactcactctctgaaaagtgcggacactgtttctcccaatctgtcctcacaatctttccagggctgccactccctgagtttcccaggtctcctgggttcacagtcatgatactccaagctggcaggaggctcacccctggcaggtgatgctccaggcaggtagccgagtgccccagaggctctggcagtcactgtctggcctcagtgctcttctacagtgaggtgtggcgcagagctgagcatcgcgcattgctgtatgccctgtttcacagttactgtggcaacagccaggcttcagcctcgcctaggttgtcctggggaggatgggccgctgttggaggctacagcaatcctgtgagccacagccatcctggtcattgtgcaggtccaggcatctcaaaccagggagtagacacagacactggagtcctgctgagccccaggctggccaggagacaaaacaggcgtgatcattcacaaaacccaggagccctaggagatgccgcctccctgtgtccatctgagcacccaggccctgcagcagaggacctcctccggttggcacgaaggcgcttcacagcttcctctgcagccacgccttaccccatcccaccctaccccatgccccagccaaataaaactattacagttttattataccaattgtcagtttcctcctccgaattttctcatgctgttcctcatccttttcgctggaaatgttcacttatcctccaaggcctagctcatgcttaccttctctatcagcaacattgacccccaacacccccccccaccaccaccaccactgaccccagccccacccacccaagaagactctcccactccccattctaggctcctacagagggtgataaatcccactcccctgccagactgtgtctctcatctgattatcagcccagcacctaaggcagtgaatgggtaccttgatcatggtaccctcaagaacccatgatccagagaggctgtattggctttaacctgggtgtcaaactaaggagtcaagagcaaacagccccacatatgaacctggatttgggcatggctgattatcatgggagcacccttcctcccaacaagctcatcactcaagtcctacttttgttagctaaacattcattcattcattcatctgagaaatatttagtaagcatgacactacacaacactgtgctaagcactgagaatgcagagtgcagcaagacatagtcccggctctctagaaactcctaggctaggaggagagacaaaagagtaagtagacatggcaagggaagtggagaggatggtgggaatccacagaagaggcccctgattccatgtaagagagaaactggacatttagaggcttgaagttcagcctggatgaaactagcagagcggggcggcaccaggacactaagccatcttcagaccatggcagcagagcccaggcttgactcagaagcggggctgtgtaacaatccaggcttttctgccaacttacgacaagacttattagagattccaggcacagtggtattgagacacagaccactaatttgcaccccaccctctttttttttttttttttcgtattaactggcatctctgcctgaccttccccaatcctctgacagcctgggagtttgcctggctagcagccatccagatttctttttttctccaagccctggccaagacccaggatacatgggagagggggaagggaacagtttgtgctcatgcaaagcttgctcttgcatacagcccctgggccgggatggagccgagtttcctctgaagcggggcccagccagtagagctgcctctgtcctaccccctcgagacacccaagccgatttggtgcagatggcaccagcagatgccagtccctaggagggtccctcctccctagctaatgaggggagcaggtgaagggaccagagaatgtgatcaggagtgagaagtgaaacaaacactagattaagagttaggaacctgggttctagtcccagctctgccacaaataggctatatgactttgggcaagtcacttcacctctctgaccctaggtgtccctgttgtctgagtctgtgattctagctgtcagaagtgcaaatactgctttaaaagaaaggaaaactgggttttcacttctgctctgttgttaacctactgtgtgatgttgggtaaattccttcacctctctgggctaagattagccatcttttagaagtcacatcgcacgcaacatgcaattaaaactgagttaatgtgaggccagggccatgaatgacccaggaagaaatcatgagaatctatgaagaacctttccccactttttcccactgtccttgccctgggattctagtcatgaggaagctgctggtccacccactgcatgtgcagtcctgctctgagctcctgcccttcctcccgcactaaaaaaatctctctgcttcgccagaattctctgaggccatctgtggctctgatccaccagtcaggtgagccgtgggaccagccctggggattctcagccttcagggatcctgggcctcatcacatgcagatgtagtcctgcctttccggggcaggtgtggctgcacactccagcgaaagtgaagctgcatctctctgcagccttacagcaaatgggtagccaccacagctgctgataaacagctaggggagccattggccaaataacccacttttcacacctggaaataatgggggaaacactcaattaggcattcaggtgtaggtctggactggagtggaagtcacagcctgccctccaggctcctagaaatcactggtttgaggctgttgcaggatgacaggaccatgggttttatgggggctagttggcatggctgaggacaaggggctggctggtgaccattcaggcagaaaggaagatgaggagtggggacaagatgaataagcactttctttagagtctgaggccctgtgagaggaagaaatcaatggaaaccttgggagggaccccagagagagtcctgctgagagagggtgtcggccagataaatttgatgatgcagcactgagtgggggcacaaagtcctatttgaagtattgcaggcaggctggcacgtgcgtcccacctgtgcatctcatgtctggccatgtggcccctgacatgctgctgggcagaaccagggggaagcagcagccagttaaaccctggcacccatgcaggcagcctctgataggcaaacagcctggaagctgggagcctcaattagcctcttggagagaggggagagtattacttgattttctttgccgcccagaaaaagcaagaagtccagatgcaagtgcaatccatgaccacttgctctagaaggaatgaccaggatccccatggccgggaaacaaatgatgaagccagttagcagcctgattccaaattagagtttctcccattatacctatgcctgtacacatgttcaagacacagaaagctttcactgtttgggggtattttgttttctcacaaaatatgggcaactggtatcccaagagctgccatagtttggtgagatataaatttctggtcctttaagcctcactggagatagacagtgatgttgcctggggacttcctgggacacacagctgaacaaaagtaggggtaaggcaaatgtaccctagagatgaggagctgtggtcaaagtgatcacatcaagagaaagccttcagccagccccctgggatatccccacaatggatgggcagaaaggactctggagactcagtacagatactgaagagtatgccatgctttgaaaattggggagttcataaagggaatggggagagctgcaggttccctaggtatctatggaagtttcggaaagagatgaagaatagccaacacatatgtagcactcatataaattaactctaattttcacaacagcactgtaagataagcactatttttatccacacttgatagataaggaagctaagccacagagaggttaagtagcatgtccaaggtcgaacaactgattagtggcagggctggacttgggttttgggttttttattttttttgtttgtttttgagacagtcaacccctatcaccaagtatggagtgcagtggcacaatctcagtttgctacaacctccgcctcccaggttcaagcaattctcatgcctcagcctcctgagtagctgggattacaggtgtgtgcaaccatggccgactaattttttgtatttttggtagaggacggggcttcaccatgagatgaggctggtttcaaactcttggcctcaagtgatccacctgcctcagtctcccagtgtgctgggattacaggtgtgagccaccgcgcctggccagcagggccagactttgaacctcaggaggcttctcccaaagcctgtgcactcttaaccacggtgcagtgcaccctctccagagtgaagcaggatgctcgtttctttagggaaagaccctgccttggtgtgggaaatagagcctccaggggcggccctgccccacacctgcctggggcctagggaaatcctgccccaagatccagacccagacacctgccactctgacagctggcacagggatgggggctggggacatcacaccacccgcattctctgcagggatacccagccatccattttaggctaaaagccttctccgcatctcagccttccccaaaattttacaaatactagaagataaaagcgcaggaaccagcatgaatgaagttggtttttaagagacagtgtttaacatcaagatccttctgatgtgagtaatttggattctgatgcaattctggattgtttgttgaattatgcatcagcagcttctgttgctgtaaaaagcaccaccgtcactcgagctaatctgaaacctgcagcaatgaagacagttgggttcacagtttggatactgagatgcgtctttgatgatagtgaaccagcagaaggagagaaacagacacaagggcaagtggagagcaggtagtaggaagaattgggggaatgaggtaggattaggtgctttatttaccacacactcatgagagccccatgctgggagaaagaaaagacccaaagaggtgagcagatatcagcttcccccaaatccaggaaattccacaggatacagaaagacaagaacagagagaaccagggattcattctggcaaaggatgaagcagctcctagactgtcaaatgcccactgtctctaccacctgaaatatgatgctctccttcaagctcttgacctatgctgggggccttcctactgggccaaaggccatcatggtcatcattattaattattttctcagtgttttaatatgtatttcaggttgatatccttatttaaaagcaatagctaaggacagtatgcctatttgacgaagggcacaggggagaaaggtgatatacctaaagtcacacagctgcttagcaaccggaaggaaattggaattccagtctcctgactgccagtcaccttctcttccatcaccccaggctttgccatctcactatggaggctcccaggatctctgacaacccatcagacccactgcttaggctgggaatgccaagtcccatgcctggagcagtagaaagcaaaggcaccaaagccccaagctaagccacctagtccaaagccacgctgtgcctctagcatggtgtgtccctgagcaagttatggaacccttggtgtctcagtttccttatctgccatagacgcctgataatagttcttgcttcatggaatgagatgatccatttgaaacctttggatcaatgctaagcagaaaataaatataacctgccattttcattattgatattctcctgtgaaactgttgtgacttcagaggactgatcccaaagcctgccaggaagaccctgctgagtgtcccgctctcctgaatagcccatgtcctcactatcacaggttctattcgtgtcgcaacaaggaaccacacatccaaggcagccaagccaggagggccctgggtgtgcgggagtcagctctgtggagatgccgtccatgcccggtctgacgggaaccccagctctgcgtttctccttttcatgaagccagtgagccaaaaccaccctcctgggctggcccagtttaagagcctgggctccagggacgcagggaggcccctcagcccaattataaatcaatctagcagcactcactgaggccattgccataaatggctctaaaagctcagcctctttcggcccaataggctcagggctccaggattaatgagcatcagctgccggcaggctggtggggacagatgccgacctaatgagcacagtggcccagccctcgccagctcgaggtggacagggctgatgagcaggtgtcattgtcatgatgcccctttgccaagtgtcactttgaaagggagggctgttgtcatcaagtggcatcttattaccccacctcaggacacccacaggagattctaaaggctgtccacaaagatggcctttgtggctgccacctccactcctcagctggccctggcaccaggtttttctcaaggcctctcaaccacagggctggataagggttttagaatcctgggcatcccctcccatcccatgccatctgattggtgctgcattaaagtacagaggtccctgctagaatttccctcagtcacgtctctattacacccacgggcttcaagtttgcctggagtatttacacacagttctgcagattcaaatggattcaaatgggcgcaagggctcagcatcacactggtcaccaaagggacacaacccagtccctgcaagacatatcagcttgtatgtcagtcaaagacacaggccttagagggactgatcataagcataaaacatagcaacaacaaaaatagtcatgatcacttcttcagcatttattttgtgccaagcactgttccacgctctttatatgtgctggcttatttagtaaatgtgaatgaaagactctgaataataagagtcacgttatattaaggcagtcaatgcaggtgaaacaaaaaaaggaaagatcacttcggctgactggagaaatcaagagaggcttcatgggggaggcgggaccacactggtcctagtgcagtctgggaagagtgttccagaagcagaagcaggcacacctgggcagggctacagtgagtttgctgaaggtcacacatctgtgctttggagggcagagctgcagggccacaggtatattcaatgtagtgggttctggcatctgaaaatgttgttaggatgaaatttcaaaatcaggttttattcctgatgaaagtagactgctcttaactggggcttcactgcttcttttccatttctgtttggagtgtgatttttttaaggtaagatgtacacgcaatgaaatgtgcagatcttcagtgcacactttgatgagtttttgacaaatgccttcacctgtgtaactaacaatccaatcgagatctagaatactttcatgggcatgaaaggggaggaatgtgacctttgtgatcagatggtcccatacctacatcttctgggcatttgtaagttggaataaatcaaaataatcaacttcctcccttaccccacgccagtccacctcctacccccggagaaaaaataaaataaaattcatccacatctaaacagacaaatgcctacctagtctgtctgtgtatttgttacctttgtgccccagaaccaagcttcataccaggcacagagtgaatgatccatacgtgtttcttaaaaaaaggaattaacatcctcagattaaggtctcccaggaagtaaaggactccactttctctaagttcccatgtgacactgacaattatattttcctgtcctctctgttgagattaggaaggagtccctaggaggatgcagaagagtatccttttgtcctgtctcctacctgtcacccagactcttgtgttctctacagccagtccatcttaggcctcaaattccatatgtttgacaaaatcaagcaggtagttcaaggtgctcgtctctcctcccagctattcagcagacaaaatctgtgacataatgtaccccagcctcagacacgctcacccttctttcccaggccctgtgtgaatgggccaggccactccttgatagttttcaggcaaaacacatgagaacactcccaggaaagagaagcctccaggggtaccatccgtatgcataccacgcatttacttcctagcctcaccagcgttttgggtgtggccacagctactccccaaacctttcatcttgcaagtccctagatgtcctcctcgggaaagctccctgcgcacagcttgtgggagactgcaggctcataaacagcataagccagcattccaatcagattatttctcacttgcaatattgcacaaagagaaaaaaataatgctgaacattctgttcgtggaagaaaaaatagcaggagaaaactgtcacattgtttggtctattttcaatttcattcccgagccctgcaaatagctatctgtgcaagcaggccagaagaggactccagcgacctgacatgcacgatctcagatcaggtctctagggcctgtgaaaaagggagagacctttggctggcacatatctacacatgtgataaaattgcacaagactaaatacacactcgccaatgcaaaaaactggtgaaatctgaatggataagcttggtgggttgtaccagtcaattttccatttgtgatattgtactatagttatgcaaaatgatgccacgtggaggggagaactgagtgaagggtacaggaacccctctgtacaatttattgcaattgcatgcaaattcacgattatctcaaaaggcaaagttaaaaaaatgcgcttccagtgtctgatttaatgggactaggttgcagcctgagcatcagagttttaaaagctccctaggtggttctaatgtgaagcccaggctgagaacctttgctcatgaaggttgggaaggtgagacacacacatgaaatccagaaacaatcagcatgtgatacagtaccaaaagcttcatgaatacttgtggagcaaatcagtgaactgctgaacagacgcataaggttagaggaagtccggtaggatgagggaagacttcatggtgaagtggaacttaatcaggacggggcataagtggagaattcagaggacgggaaagggccctctaagccaataaagaagggctcagagattgtgtggccatactggggaggaggggaagaactgaacttggggacagctgaggagtgaagatggataaaacttttcataataaactggctctatccctgtgcttagacgagtggatctttcaaacacctgaaccagctctaagtccctgcaaattgccaagagcaattttcagcaaaaagccaattccccagaaggcacttggcatctctcagataagcaaaagagggggaggctggagaggcttcagaatatagtatcgatgggtataaaagtaagcagtccttgtcatggttcatgtcactttgcctgactgcacttcagctggccttagattccccagtcgagagcccagccaggtgctagaaaataccagaaatgacccgggaaagggtaaaatggaaatctcaagcctacataccaaagcgaatgcacttgactcagcaggtccctagagtaatcatgcaacacctctttattcttattttatacacaagtctaataagcttgagtatctgtttccaagcccgtagcaaattaaaaagaacaaattaagtggcagcaggagagctgcatcagacaggatcagtgacaacagtgagaagtgacaggtgccagacaccctgacggtaggcggggagacagaaagctataaaaagtaacttggggcactcacctaacatgaggaagccaccctagcgaggcacaggggctccattgtaaaggtggagaaagagctttaagatactcaagtccaagttctaaatgccttggagaacatctctttgccttttcctgttattaattagtccaacatacacacaggggagaggggcagtgtgctgctgcaggctgccactatgggaggggcagctggctaatcatcttattgcaggaaataccccctgccaaaaacacagctcccctctcaaagcctgctttctcaccttgtagcactggccactgccatcacagggtatgcagagcaaaggacaggctgctcccgagccgctcagtccatcggatcaatcaggtttaacaaggaggcatccgaggatcaggagaaacacctcctacattattaccacagcaccatcactttgcatgagacaggtctggctgggaacgccacctccagcatggacagaaactgcgtgtccttgacccagttgtttcatttcttgtgctgagcacgcccacccattgacccccaatccagagagctagtgttgaagagctcattaacaaaacacaaaacactcagctgacgcaccgccaccatgcaaatgcgtaataactggatctctcttcccccacagctaacctcaagcatctcttcttggccagctgcattgccttggctctctgtgtggttcagagccagagagggcaggctgggcagccacttccatgccaacatcccaggaggcagtgcttggagcaggaagatgagagaagatgatctctcccactacacagagcccaggtcccggccccagactcagaggccctgacgcctgctatgcctggtccacaaaagcagcagggaagggcatggatgctggcaatgcactgccccctcaggagccagcactcaatcatgttctctctaaagaatgccagtgtcccattttcatccaaatgtgaaagttgaaaaagagaagtcaggcaagggagagaggcttttaagatttcccctactcaggggaggagctggcagcgtgagcctaaaaccaggcaggcaggtaacgggagggggccctaattgctgctaaagatcacggggtaaccctgatgacacctgaaagtcttccgtggatcctcaggcacaaaacataaatcatctccctctcacttcttactgatcgcgtttgcttgctgtgtcagctgaattcccaaattggcctgggtttaaattgggacttttttttcccttcctggcctggcttttcctccactctctctctccaacctcctcccaccccatgggaagtgatgacagaggaatctgcctgcggactccaaaatgcaggtttgtggcttcactttgtggggtgggagggaagaggcagagagcagggaagagggcatttgggggcttacttcggggacaggacctgagggatcaggagggagaaagtggccatctggacccacttgccgacttttggtgtcctgtcctccttccaagtaaaccccttctcagtccccagggcagccaggagagtctgcaacagacatgctccattcagtaggggcgggactcaggaagtgcaacagggaaggtcagagccggataacgggtctgtagttggccctgctgttctggggagcagatattcacctgggctctgtggtgggccaggagacaaggctttctttctttcacttcttttgtttccacgggtccccaagcacctccataacacaggatgggtcagagcccattgaggaattaacccagaggccttgaccctaaatagctccatgagaaggctgaaccttactaaccctccaggaggctgatgtgaggctacacacaatgccaccagctctgatgggcccgcccaacacaactccaggaaatgtcccaagaaagctttccaaagaccccttttcctagactatgggggactccccccagtgacttcatcactcaaaccacaaccaaaacgatatgcagcccccttagcctttgtgaggcagaggagaaggctggtgcgcagcctccaccactgtcaccaaccagccctcacaggcccagagccagggggcagtgggcaggtggcctcccactgggtggcagaacaggatggccacacaaccaacacggcttgctggtgtcacagtgtccctgttacatggacctggcagtgcaccaggtgacatggaggccacacactacagggtagtgattaagaatggactcccaagtaagactgcttgattggcatcctaatgagcaatatgatcatgttatttaactttcccatgttttgtcccctgttaaagggggtgatagtaacagcgccacctcataggggtatagagattgagataattcatgtaaagttcttagaacagtgccaagctggtgtaggttgtgattattattctgatgcctactactactattattatccctgtggcccaggagaccagaaggtatagagggtggaaagacgaagcttcagggggagtactgcacagggtggggtactactgccttcctgtcaccccagtgttcccactggcttccccagggctggtcctccttgttgtgaaggatctgagtctgacgttctactttaaaataacatcaaggggatccattgtttcagcaaaataataagagagggcagctgagggtatgtgtgtgtgtgtatgtgtgtgtgtgtgtgtgtgcatgtatgcatgtgtgtgtgtgttggacacattctcttctgagggatgtatgttttctactccatagctctcagaagcagtttgctgaaacatggtactcccagcttggctgaaatcgggaggcagggcagtggagcctgggccttggtgattaaaagtctgggtttgaaatgggctaccgcaatgccgagttttgggttccttgtacactgatgaggcaggactaggctgtgcctacagctgctcttacttaggaaatcctaggaactgtgattccatacctgctacattggactcaccacgagatgctgagccagccatccccttttctctctgatctcactcttccttggttcaacttccctggtcttcaagaaaaacagtcagaggagcaggggccacaggaaatggagagtcctggttactgccagccttggaaagatgggtgacagctctcggtcctcccaggggaggaggtgtcggcttagcaggcctcctcaatctggagcccaggctgcaaagccagggacgctgggctgagtggatgccccacaggtcccacagcccatcacttgcagagccaggtggtatttctggttttcactacacatacccatgtggcacaaaacatacattgtgaggatgtgcagagagcatctggattccttagacttcaggttccccatcctttagggcagttttaaaaattgtttcgctggaggcctacccaggaaatcttactcacattgaaaaccaggatgaaacccaggaaaacaagtcttccccttgctacctgtaatgcactcagatatttttctttcttactctattccatttaaaagaaggttggccacagcccactacattgacttaaagccatacgatgagtttgtggccccctggcttggaaagcaccatttgagcagcagggcagtgacaatgactcaatgtggcctcagtgcaggcagaaatcccattttgcaaagggacagactgcctgacaaagtcagagtccaagtgtctccaggcttacactgcagggttaaaagaacttttcagatccatgaacctcttcacagagaaggatttctgcatccttccaatgactaattctcagcccagacagaagttggctcatttgaaagggatagcatgccctcctgccacacaatggtctgagtattttttccgtggcccataaatgaagctgacattagataagtcactcacgcacttcaagaacttcttcaaaattggagtcagttactcagctactccaattgtggcttatttcctcacttctgagatttttaggaattgagtaaactagagcgcgttctaactcacctgttgttcacctttaactctcccatctttggatgctatgggaaacccaggagcctcctgaccacatgaatgaaaagaatagggcttctcctttggcctcctagcttcagagcatctgctccctcctagccaagtatcacttacttaggcatatctgatttttatcatgtctcaaatttataaaaccaaaaaaaaagaaaagaaaaggtccagggtttacctcatccagccttctgtttcacaggttaaaagagcatgacccaggggcatttacgactcacctggaaccacacaggttgttaagagtgagggctagaatttgggtgacctgtctcccaggagccacgcaacctctctgtgaatgaaggtaagaagggccaagttcaaatctcgaatgtccttgtgcttccccaactctgcatttgcagagaaggttgagtgggcaccgagagaatcaaaatagagtaggtgttcattttgaggggaaaactcaactttctaggcctcatttaccccttttctaatgataaggaaaacaagcccaaacgggatttccactttcataagaacccttcatctcccaagtcctcatctgccttatggagtctgggatagaagggcattctagtaatagctacactgatggccctgactgatgcacctgcaaagacagatattgacgctctcatttattctggtagtcctgcctgacagactgccctaaaatgagcaggagctcattatctcagctggccttctccttaagcaaggcggaaatggcccaaccctttctgggacaccccacccctgggactcggaggccctctgaacagcagggatgagatggactgatgtggatcatcatagtagccaaatgaggccctctggtgattttcacagagaggtgtgtggcacccattttctagtgtgagaagtttctagtgtgagaagtgtgtttttgagtccattgatccggcactctggatttcctccagggatgtagatgcatcctacatgcatgcacacatgcacatgcacacaaacatgcacatacaccaacacacaaatacacacatgcacacacacttgcacacacacatgtgcacacaaattggctgctcaggtcctgcatcccagcatgccccctggaaaccaacctactttgttttatttttattcctgggactacgtcaatacatctctcctggtgtggagggtgggcatcagtttgaggggcttgtcctagtcagttgggctaaatggggccaattcttttgctttccagggtggatgcagggctttgttgaattgtgaagaatgttaaatgaaactgtttattcatatcacaatctctgctatgccacagaacatgaacttagaacacacagattttatacatcggaaacaagaaatgtctaccacattagcaaagacttaataaaatttcatagctttctagtgggaacataaattggaacaatacttttggaaaacaatttagtaacagatagccaatctttaatgtgttcataccctctggcctagaaataccgcttctgggactctagccaaaggaaatagtctgaaatacagggatttaaaaaaaaaaagacctttatgcacaataattttcatatcagcattatttataatttaaaaatgagaactaacttaaatataaaacagtaggagagtgggtaagtaaactacaatgtatttgcataatagaatattaagcagatgtttaaaattatatttatgaagagtttacaaaaagtggggaagttagttgagttacaaggttcactgaataggcaggaaaaaatgagacatagagtataatcttatctatggaaaatgattaacataaaacatcgaaaggaaatattaatgatagctgcaggcggtggcattctgggggtgcagtttttacatttcttatagatttctaaatgttttaaataaacaagtatttttcaattcttttttagctttgaacacaaaaacactttatttatttatttatttatttatttatttttgagagagagtctcactctgtcacccaggctggagtgcagtggtgcaatcttggctcactgcaaactctaccacccgggttcaagtgattcttctgcctcagcctcatgagtagctgggactacaggcacgtgccaccacatctggctaatttttttctatttttagtagagatggggtttcgccatgctggccaggctggtctcgaactcctgacctcaagtgatccaccagcctcaaactcccaaagtgctgggattacaagcatgagccactgcacctggctaaaaacacattatttataaaaggaggtccagtcacatctctcccattacctctgcagatgactgcagagaagtgccctctctgcctgcctccctcccgccccccaccccatgtcatcttctctaagaggaatgcgttggatcacatgatctctaaaacccactctgctctcacattctgtgtcttgaaatatcatccccctgtgtttgagactgagaatgggatctcaaaaaggggtccaagcagcgaaactatgctacaagtaaaacactgtaatcatcctaacaagacatggacttggatggtcttctagaagatgcagctgttcttttacagtcttcagagaaaaatgctgacttgatgtccttgggattgaacatctggagccaaacatccaaattaatggggtcgcgggcagctgccctgtgaagccagaaatccaggttagggaggtgggggctcagctctgtgcctccatccaggccctagctggagctgaccttccagggtactgcagtagatggcttggtggcccacacaggcacagcaggacagatcccatgtcctataaccccctatggcagctccagccccgagacgtcttcccttgaccaaactccatgggattctttttgtccgttatgagcatggggcaccttcttacaaatcatctgatggtctcatggtttccagttccatttcctcaaggacattgtctgtcaccccttgaaagtctgtccctccttcgatcatcccagagtggttgagtggttcacaggggaggggaaatgagaatccacacattgaaccagctccccaccctggatgagggggttaattggatttttcactctttcaaggtggaattccatgatttgataattacatgggactgtatctctcccctggactttggccatctttcccaccgttcagagaaaatacgacttgtttctagacctgatattcatccagcatgcaccaggatggatggaagataaaatactgaaatgtttccacactggttggtaaattaccgtcacctgcggatacctcccctgtagtcccaacaggctggctcgtcctccgggagatcccccagtgacctccctaagatgtgtcacctaaagggttaatgcctggcccggcagggggcccccagactcttcacccagcattaagtctttgtgcccttgaagtttaaatattttgaatctcacctctccctgctccctctttggaattgagtcccttgggttgagagaagctgactgtagttgcctgggataaccacgatggctgaaatgtaataaggaggaatttaggcttggatcctcacactctccctcctgcttctaggggtgaaagttgggggatggcaacagttttgggcaaacaggtaggaaagggaaactgtgcccacctccccgtgcccccctcccccagcccatgctattctcagcattcacagttcctctttacagacaggactgagaccctctgagccagcactgtagaatcccagaagcagcacagtgccttccatctgagcttctgaagtacatttcacacatagcaccttcagaaggaacaggaaggagagacacttttcctgacttcgcccatgaggagaaggaagcacagagatgtgaagctgccttgtcactcgcacagctgagacagacccaagcctagccttcccccctccacagggataaccgttagaactgccaactctgtcccaacgggcagtgaggagatctgacaggattacgtcatgtgctctgtaactgggagacacatttatgagctgacaaccagagaggctggtgtcatagaggaaggagggttaccaagtgctgccttttgataataaaggtttcgtctgtctaggctgcctgtctccaagcactctggccaaaaacagacatgcaatcactcccctccccaaggcgctggtggggaagactgctatcgtttatgcttttactcatctccatcaggaggtgtggaaggtgccacaaacctgcctcgactccagctagttccccttctgacggtgcacccacccatctgtccattccccacagcaggctagcatccattctaggtggaaactccactggaagcccaaacctcagacgtgagccccaggagataccagcctgtacagcaagccccagtcctcagtagcatcttttagaaaaagttctggtgctttggccatcatcccgattacgtttgcccatgacatgatccggctgtcatggaataaagaaacatgagggtttcaatgcaaggaatgtttagaaatagagaacgaaaagaatgtgcttgatctcatgttttcactttaatgtattcagagctggcagagaaagggggacatttaacttctaattaatgagttgctccatgtgtccaaacaactctcccatctcttccctcactgcagatgaaagcccaagttctcttggagctgggtgattctctgtgcaggttacatttccccagactctgaacgggtatcttccaccaatcagattgggctctggcacctcgccacctgttcgggcttcaccctggaatccctcatcagcagccacttctgatgcgtaattgacaagaccatagctgatgaagggtatgttacgggcttggctctcaccatcaaatctattttcagttgaaactgctttgaatttactgacaccaaagagcccagaaggtaagaatgggctgtcattgccattgttacgattgtggctgtttttggaaacctgggtcttttcaacttatcacaaggcttcagctaggccctgatttcaacttctgccaccatctgagcacgagccttctgagtccaaattccctgtatatgttgatatcatctcagtaaacattgaggaacaaaggacatgaagaaatgagtgtcagtccgtgtgagggagaagaaaaggcccagaaattctggcatccccagttcaaattccactcttcaccaacttcaccttgcatttccacaccacagacttcccaggagcttggtctctcattcacatcgatatttatgcttggaatgtgaaggatcccaaattctacgtccaatcacatgttcacatccctgaatgctctgaccaccccagacatttctgaaatggcttagctcctgcctgcccctccaaacttgaccaatgccctctgcctcccttcatgaaggtctgtccacagggagcctttctcaggccctcaaaggtgccgagtttgttctccacttcacaacccccaggtaggactgtgtcctcgacttagaacactcttcccctcacctcagctcctcacattctttaggtctcagagcaaacattccagccttccattctgagtagacccccaaaacttgattatcctctatttcaaaaccctacttatttatttcaaagccctgataactgtttattattttatttatttgtttggtttttggcatatctccccctccagacctcagctccatctgttgaatgaatgaatgaagttgctagatgaaatggtatgcctactatgctccaagcatgcttcccatgctgacgatacaacagtcaagaagtcaggtgcattgccctcatggagccgatcaccttgcagacagcgacctgcaggaaactgaaatcataggagacttgggcaaagacgaagggagcaggaaagaggcagaaggaagggaacagcatctcgtgagctgacaacgaaatcctgtataaatatcacacaaaaatctattagtgttaccagcatagagggcaattgctttttaatataataagatcttccttggaggcgattatgaggcagtgataaggatcaggtgacatgttgaggtttggcacagatggattaatttctgtttacatctagttgttggcagcatgggggagttcttcgttttcagggaggaggtgggaaagaggacctctggggaaagcagccaagacacaattcttgtaggtgttattccagagagctcactgcttgctgtggatcccagagtgaactggagagaaaaccagggcctggagcaccggggagggacctccatgcaggacacgctggccaagctttggagggacgacccctctcctttcctcctaaaccttggggtgccatgacagaggtaaactattgctgatgtggagggattagtgactaggaaacaaagatctgaggtctttagaaacaaagtcacttgatagatggggggtggagagagaaggaaggaggaaaatggaaaagaaggcatgctgttcttatacagttcattcccgacactgtctcaagcattaacactctcattactagatactattcttccctgagtgttacacagaggtaaactgaggcctgggcaagtccaggacagacccaatcgtactggaacagagtctgcctccggactcgctgcacaggcacacagcaaagcctggaagcaactctgaagatttcctcgatggggtctttccttccttccctggagcagcccaggggtttgcttcactggctgggcctcctgtctccagtaactcctggagtgaacaccaaagtcccccagcatcaagacaggggcacacaaccaggacaactctgaccctggagccagggggctgtttattccaccatgtggctgctttttccaacatgtgacagatgtcacgattattctgccaccaaagaggcaccctctgccactcccctaaagcaccaaccccaacagacatggcctcaacctaaacccaactcagagcaaaacacaatggaaaacacacctaagcaattcaatggtgccttacaaatggagttactccacggttctggttgcctgaaactgctggtttatgtgtgtggcccaggcaaaatattagcaatgccctcttttactttttaaaactcttccagtttggaaaataaattccagggtcttcctacttgtgatgtacctggaaacccatatattatggaatctacatagagatgatgctattttagagtatatacacccatgaccactatacactcctcactcccaaccccatatcaaccatccagtaaacaaaactctcaacaccccattcacaacatgtagccatcaagctgtgctcacaaaaaaaggtatgcactccgccaccagtcatactcttacactgctagtcactacacaagtctcccaatcatggcagatagagctatctctcttccactattcgggcctagacacgactacacatatctcataatttgggggagcactgggacatatgcacccacttggacatccatccaaatcagccttcagggattttaaatggaaaagccccggttgctgtaatggctacaaccttgtaaggacatgagtccaagttcattaagaagctgggtacagatgaaccctgttgctgttgtgattaataatcataatagacagtcagctggagggcttgccagctgtgccttccaggtcctggttctgggatcccctctcatccaccagtgagtaatggtttggtttattggaaactctcttttcattttttatggcttcaattaagcgatggggagaatccatcatgtaacctttttgctgcactgctaaagacttccggaggggaaaatatttatcaaaccccaaaccatcagaggagagactgcggtaaacctaacaggagactggggtggcagagaggtgaccgagatggtagggaggggagaaaaaaatatccacacagaggtttgatgcttggacaagagccatactctctgtaaaatatctgcttatttcacaaatatcaggctactcctcacctcacatcccataaccacagaaagtactccactgattatgagggtggctaattaatcagcccccagtccccagtcatgtggattcctatagcccaacaggttcaaggtggcaagaagaacagagacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaaatcctctcccaaatcaatccattggaatccacaacctcctatccttggccctacacaggcccctaccctttccccgacctctaccaggcagccctgctggtaagcagagccgtctcttattctgcccttcaaagtattcacaccctaatcttggccactggcattaatctttcatttgctatttagacatctgattcctggggcaggattgagagatgtcccttgggagatcaagttggccagaggggaggtccgaagggagttggcggcctgcagagcaacaagggcctgcctggaattaatggggtcatcgccctgctccccatcgcccaaaggaggaggagccacagccagaagacacagatgtctgaagaaatgagattgcaggtctgtctgctttataagacgtgtgtgtgtgcacgggtatgttcacatgtatgtgtgtgcgagaccagggatatggcctctcagcttgtgtcagtgtagctgctgttaggagatttgtatctgctctggtgcagggaacagaggtatcaggagagctgggcaaacagataagactcaaataaaaatgatacacatgtgggccctgggagacggtattgtctccatatgctaactagtaatactacaggttagatagtcagcctgcaaaacataactctaataggagatagatggtggaaatacacttccctttctccctctttctcctcctcactctcagctaacctttatcaacacaaagttccagggactgtgccaagtgttctttattaattattttcatcaatacagcaaacccacaaggtaggactatcagtacctgtattttacaggtgaggaaactgaggtctggataggttaagtaaactgcccaaggttctgcagctagtaagtggtcaaggagaattccagccaaagaagtttcactacagataccaaatttaaccaatgatttaggaagaaatgaacagataagtttgatatagactagagagcactggggaaagaatagattatagctatgctgtctgataaccagctactcgtggttctttaaaattaaattaaatttaagttaggtaaaatttaaaatctagttccttagtcatactagccacatttcaagtgctcagtagtcccatgtggctggtggccaccagaatgactagtgcagatatgaatattgccatttttactgaaaattcactaggtaacactggttagaggataaggctagatgatggcaaatagaaacacttttcaggataaccagctggaggaaggatggcattaacatgtgagttcttcccatctagaaaggacaagaaaagggtgaagagcaaagaggagaacctagggcagcatgacatggatcaattggttgctgttattaacaagtgagacttcaagaaatgccacagaaggaaggggccttggagattagcatattcaacctcttttcatacattacaataaggccagtgacaactggggaggccaatggcccaggtcacatagccagttatgtcgaaggctcttcccatcccacccagcctgtcattctgggtttttcccatcatcctcatccttgatcccttctgagatgtgcacagaaaatatcagagtactcagaggtgatttccaacacgtcttcacactattatgactcctgacaggtaaatcactagctgtattgctgcatcttcctttcttataatggcacagggctgtccaagaatgagacattgaacatttgtaaaatagcagcaattgaaaagataaatggcaaacctggagtttgggaagcagcccagtaggactgtcttcctattcagtctcagtaaatacttcttgaataaaccaatggatgtttggctggatggaagagtggatggatgacacctaacagttcttcaaccactttatggactagtgccccattctcccacccccatactgttcatcacaaactcacagttgcttctctacaagctactaaaatggaaaacatctcagcatgtggaaaaattcaactgcatttcagattctagttaaaaaaaaaaagtgactatatcctgccatgcctatataagtcctgcaacggaatgttgctgaatgccttcttgtctgcactagaaattcacactctcttaagctaagtgtatgcccactctacagggactcccgcttccccctggcctcaaagatcattacctacctctttgcgtgaggccaatccatcctcttgacagctcacttaccacggaccagggctgtgggggagcctctgacagccagagatgaaatggcagaaagggctccttgtctggacattcttgggcatctcctacccgccacattattgtcaccatggccaagtgtgatccctgtgtcatgaggcctgcgcttaggattggggctgcctcctctgcttcttcctagacccttgcttcgtggttgttccctcaaactacatattcagtcacttaaatgacgcaattgttttgagactcagtgaaaaatctcaggatatagactttgtccagtagataaggaatgaggtaatgctttagttcacaaattccttgagggcagagattttatttctgtatcttttaaatctgaattcccagtgtacagaaaaatgccttgcacaaaataaataagcaatacaatagattaatgaatgaatgtatatatgtgtgtgagggagagagagaaggagagagagaaaaagactgaaaaggagagagagagagaaagggggagaggtgggggaggaggggagagggagagacggagggagagagaaggagcaggagatcaacaaatgcccaatctgttactctggtttctgcctgggctgctgttatttcatcccaggaaagctggtttactctttggtccgtgggtctctgttctctttctctctgggccccctatctacctccttagttttgtggggaaattgctttctctgcaaccacctggtcctctaaagactctcttcttaggtcactttggtttatttggacaaaacgcttctaattcattattcctcctgtggaagactttttgagtttatttagaactagcattctgggcactgagtcttaatgaccatccacagacaagcacctagccaaccaaccccagctctttgctgagtccttctagactcttctgcagctctggcacaagcactgcccttcttgttgctgctgtatgttttatcttattttttaaaagaatgattacaccccttttccaggctctaaagtgacctgaactcaggaaaggttctcctctccatccatcaaagttcattcatccctcccccaagtttctccatgatttctactccagtccctcagactccagtggcaaattcacctcaaatttttggagttgtgattgctcctgttttccaccataatatcaggattgaaactttctgctgaacatagttccttggcctcccaaaactttccagatcaagatggatccagcccagcttagctctcaagtcctagaatcccctgctcagacaaagcatatcacatcctaatgctctgtgtggagggatgcctattgttaatgtctttgagaacatgaagcttggctaagaactggttcacaaactcactgcttgaaattcaacaggcatcctgggcaccgcctggagaaaggaagaggaaagcagggagctctgctcagattccatctctaagaccaaggcagaggctttgtagaaatcaatggttttccttccattgcaaagggggcaactggcagtgacgagcagaagggtggagcagggggtgtgggaagaagaacaaagagtaagcaggaggggaagaagtgagaggcagagggtgtaaccatgctcccatcctctacagattcttccccttcacttcctccaggcctggattcactttcttttttaatggctggggccagtgatttgttcccatcgatcactattgatgtttttcaattgtatccgtgacacttttggcaatatgtttgtaaacacagagccttctgggatctcacttcttgtcaccacgtacaggcaccgtctccttgtcactgagtattagctgtcaatcaaagggttgggaagggagctctgtgtccttggtcctgggacttgcttctttttgtctttctgcctggaagtgaacattcctcattcattcccagagggaaaatggaaaccttcctctttaagtgggagaaaattgggcgagaacaaggaaaggtttctacctggggccaggcatcgtgtcctgggcagaggaaaccacagttcttctggggagaaaaatgcagcagagaatcttgtacccaccagtttagcttggatctgggctgcaggagcagagaactgctcccttgaccacaggtagctgagcagcctgcatccaaatttcatcccagataactgggtgaacaactagaaatttcctgggttcacctagacaaggagctttccaacttttttgatcaagacccataagtaagataaataattcagctcatgactgagaatacacatacatgcttaattgaaataaaagttaaaggaaataagaaaatatttaaggagaaacacagccttacaacaagtgatacactctgatagtttctgtccattcttctgtttttcttttttgaattctggtcatgttccattaagttgattcatgactgcctgctgtgacccacagtttgaaaaaatactggactagaccaagggtcagcaaacttttctgtaaaggccagataagaaatattctcagctttgcaggccatatggtctctgtcacaaccactcaacatttccgttgcagcatgacagctgccacagacaatacataaacaaatgaatgtggctgtgttccaacacaactttacttatgtacagtaaaattcaaacttcatgtcactttcatgggctatgacatagccttcttttttttttaaatcattaaatacggaaaaaaaatccttagcttatgggctgtacaaaatcagaggtgatctggatttggcctgggagccagagtttgtcaccctctagaccacaccacatcaaccaacgcttgcagcatgttgccagtccttctcttcaaggcttctggcatctacaaataggtgggagtgaggggatccccaccaacctcttccacacctgcccacgagtcaaggtcaagtccacattgctcctgtgcctctgtattagagcatgaattctaatgtatttaattgatggtctctgttcccctgaactgtgtcctccaagaggatgcacttcttgtatcacacgtttctcactctgccttgaaatgtctctttgcttgtctacccatgggactgtgatccagtagattcctgagctgctggtccaggggacagcaagagagcctctgccctttctaatacttttcttggctcatgcatagaatctatggctgggctcatcctctggtgctccttggtacctagcctcaggctccagcctccacagcctcctcagctaactaaagccacagggctcccacctgccccacaggtgcctctgcacaacaaaaagttctttgcctttaagcacctgaataggaagaagaacactcagttcttttcaaatttacattttaacaatttttttaagtgtagagttaagtggtgttaagaacattcccattgttgtgcaaccatcaccactgatatggtttggctgtgtccccactcaaatctcatcttgaattcccatgttttgtgggagggacccagtgtgaggtaattgcatcatgggggcaagtctttcctctgctgttctcgtgacagtgaatgagtctcacgagatctgatggttttaaaaacaggagtttccctgcatgcactctcttctcttctcttgtctgccaccatgtgagatgtgcctttcaccttccttccaccatgattttgaggtctccccagccatgtggaactgtaagtccaataaacctctttcttttgtaaattgcccagtctcaggtatgtctttatcagcagtgtgaaaatggactaacacaactgccatccatcttcagaactttttcatcttcccaaactaaaactctgtccctgctaaactctatgatcctattcccctgtcccccagctcttggcaactaccattttactttctgtctttatgaatttgactactccaggtactttatgtaggtggaatcatacagcatttgtccttttgtgtctggcttatttcacttaaacctcatgttttcgaggttcatctacattgtagcatgtgtcagaatgtccttctttttaaaggctaaataagagaacactcacttttaaaaggtggttcccaaattgccctagaatgtaagaggagttttaacatatgacattgacaacaaactctcttcatctcttccccaacaataccaaggatggatctcactccatcttcttatcatcactctgcccctagaaaattcccccgttctgctcaccctctctgtcttctctactatggtgtcagggcaaccgagtgggctttatttatggctgacatccctgaatttaaatcttagctgcttctttactttattgctaaagttttttttttttaccacagcttcagttacaaaacaaaaataactaccttctatataatgactgttgtgaagaagaaataagatgaaagatacaaaatatcaaacacaaaacttacaacttagtgctcaaaatggtaattattattattatcccaattaataatgttttccagggtcacagtctggtcctagtatcccaaataaaccctagagatccccaagagcatcccagaacctcttttttgagacaccaatttagttaccaagagtatcgcagtgggaaccccagcttagaactgagatgtcaaatacatcactgcttcgctgcaaccctgggcaagccaatgtctttctgtattcttcaccctccttggctgtgaaatagatcaaatgatgcttctaaaattctcccaacaatgaggtaatgtcttcaaagtgccctgagcctttcacagggaagtcgttgtcaaatagacacctgtagtcacagaaaaacggttatactctgggaatgatttgctcagttggttaccgaatggtctgagtctatgccttatgcaagccccaccctaggagctggaaaacaagggtgaacatgtgagcccagcaccctccttcaccctgtatggctctgcatggatgggatgcaaagaatctgacttcctgcagaacaatgggtgccttacccagacagaactgatctctcacctcagagagcaagaggggagaagatgaacatctatttgggatctactgggtccctccagattttctacagccacaacggcatttaattcttcccatgtatgtgcacacacagagaagcacggaaggatatgcaacttacccaaagtcacacagctggtgcatcattaaagctgagatcaaaagtacggctgccgacttccaaaatccatgaatgtgccacccttccaagcagccatgctaataggggccatcgtaattgtccagcagtaattcatccagagacagattcgtgttggccatatctaatggcctggctctcggtccccttctgtctcctttatgactcaagctaattcacgatgtgcttagtcagatgtccagttgccagtttattgtctattaggtttgcagagggaagggaagtaacatttgctgagcactttccaaggcccaggccctgttccaggagctcctggccatacataatctctcttaatcctcataatatccctataaagggggtattattaccccactgggcagaggatcataaagattaagtaactctggataaccccagaagatggacaaacgtgctggcctagcacctcgggaaacctctgaaagcgagatctgccaagcaaagcctcccacagccgagggagccaggcttctccacctcatcagaggcagagagtcaagggagagcagaatggatggtgtggcaggttctgattaagaacattcatcatccctgccccgctagccccttggggtggcatggaattcgttacacgactcctgaaccgtgttcatcctctccagcctcctcctgtgcgaacaccgtggaattagccaggaggggtagcaaagaaatcagatctgccctgcggaggctctgcattcccagcactgtgctgggtactttgcattgctcatctttcacttttacatcaatcagatttagtccatatttctattttgcacaattcatgttattatttcatttaacttttcccaacctgccaaagcttacgtagtgaagggacgctcccaagtccactcagctgggaagtggaaagctaggatctaggccctgttctgtcctccctcagggctccaaacaatctgtcacactgcagcagagagaatgaaggggtttccctcttcccattttgctgatggataaactgagtctgagagcaggaagttgcagagagctgcagagatttggggccagaatatcagtcacatgtatgcccatccagcttttctagagatggtcatgaagccaaagaggggaagtgacatccttaataaaagctcatttcagcaaaaaagctgaggaatctgtttaattgatcatcactcctcccttccacaacagcacagggttttaaatgggactgggctccctgtctggaattctactcctccctgaaatgatccgataacaacagagctgattgtgactggtcctccctccccttctctctcctgcagaatgtttttcttcatccctgttttgtgtcttcgtaattgcgttactcacatagcaacacatggggatggccacactacagccaccaccatcggggccacaaggagaaagcaacagcattctaggagaacgcaccactccccatcaggcccccttgaaccaggcggggctgcatggaggtcaatgcctctcagggctgccctcccctctggatcagctcccagaacatgccctttgcctctaaccacgagcaggggtcacctgaggcccttgattctagccccactttagctttcccacagagaaggctgagacgttgaaaggcatgagcccacgcctcctcctcgccagggtctcagtgactccccagccccaggaagaggagcagggagcccctcacccaacatcaggcccatgtcttggaaacgcaggggttgtggattcacatgctggtgctgctggtctgccccccgctccctggcctgggttttgctccatctctgagcaacttttggaaaagaggcagatctaggaaatccataccaagtcccaatatactctatggctgaaggggctgaggagggagctcagctggagagccctggcccaggcccacaagacagtagagggggcactgctccttgtggacgtccaaccaggctgatgtcgtcttcatccttctgtagggaccaaaatcttggtggaacccccacccttcctggcaagtcaggaggtcagtagaaccccccaggccagcattcctttcccagcctcattcctgcccagggctccctgtgacctgcccctcccccatgtgaggacactatacaccctggatactgtcccctttccattccatttgtaattgtccctggcagaaacagcctccctcaaatggtgaattctcacataaatgtttggggtgatgcatatcccagttacccagatctgatggttacacattacatacatgtaccaaaacatcacattatataatcaataacaattttatacataaataaataggaaaaaaacgaggttctgctagcgtgtggtttggcagctgtcaaatcttgtgctagagccgagtcctgaccatggtgtgccctccacgcatcgtccagctcacccatcctcccaggaaggccacccctctgctgggtgtcagcatcacggcacctgggtgggtgagccgctcactgccccgccctaccccagctgccctctctagccccactgtgccacgtccccttggcaaggccactgtctggagtctggaacacagaaaaccattcctggaccctccgcactgccaagtctgtaaaagagcaggcgcctagcctctctccttggaggctcaggccatgtcaatctcttctacgtctccctagtgccaagataataagggggaaagtttttttctcctccttccagagtgcagaccaattagcattttttaaattaccattggagaaatacacctaattagccactttaaaggaaagctttaaaaaaaaaagtcataaatttctaactggccacagcttggagacacttttaaagctaattgtgtgtttctggcactgacaggggaattggtgaaagtaagagaccgattttatgaccttggtgggaaaggggaggggaaggctgaatgacgtccttaggccaagaaagggttaatgtctgtctcccggaaccccaggcccctcctggctcctcctccccttcctcaccctccctcatcagatccccacctctccccaccttgagccctgccttaccccagtcaggggtacctgccttagaagaggcagacaggaaggcagacaggcaggcaggcagacagggccacacactcagccagaaaatcatacaaggaggaagaaaagggcagaggacaaagagagaggagaaggacaggggaaacagagaagaaagaaacatttgaggaaactgagagaaaggaaccaaagccaaattccagaaggctgtttctcatttgtgcttcctattaaactctccatcgaggtgggggcgggagctgggggctctggcctgctcttgaacatggtgcctccctcagacagttccagtggaggcagacaggggcttctgcagccctcgggcctcctgcccaggctccctgaccctgctcagtggccccaactccctgtccctgaaactgagaaaactcttcataaagtgcaggcacaggactctggggtgcctcatttaggaggaaggtggcacagggcagtttctggttgctcccagcctctgccactgctgtggattcattcctgcctcagaaaaggggaaagagggcctctcccagggggagatcagtgtacaactggaggagtgtcaagaagtgcggccaagcaagagaagatgcccagagcaactgcacagggcctccatcatcctgcagagcccaccgccatggctcatcagcccttcaatggcccccggtgatgacccagtagagcggctaaggtgatgggggtgggggtcctctccctcaggaacacccctccactggctgggttgccgggcaggagttagggtaggaacaggacagtatagatgtattgtctccacctctgtctgaggcacacagtgtgaccagcgctgtcatgtctgcccaaccctagctcagtgtcatgcccacctgacactaggtgtggcctccctgttggttgaaggggcagcagcaggtgtttgcattctatacatggaaacttagaggcccagaaacactgaggcaaatttgctctagtagcagatttagtaccatctaaagtcctgggaggcacattcttcattcactgagaccctcctttctatagcttaagtgagagtctggagaaattacagacagtttcaaaacatatagtcttctggaaagcccagaacatgcattctcaatgggtacaagagtgctccccagagggtgaaaattagagggcaaaagaaaaaaaaatcttagatataatgatttgtggccctccaaaggtcaacattactcaataaattcacatgtcgtctcattaaagagaatttaaattaaatttaacttgtctctaagggggaaaaggtgatttttaaaaagctgagaaatgctgacctagggcagtagcccctagagtcctagagtcccacaggccagagctggatccactcacctgtacccccttgggaccaagctcagcatatgaaacaagaaatggggcccaggaggggattcttccccagaactagtcagtgactcctactgaagacactcacaaactttaaaagtggtgggagacttgagcaacctagcagggcaactgggtaagacactgcaatgctgtctcttctgccagggcagagggaagagcttctgggagacaaaagaccttggggcctcttcctgctcctcaccccagaccttaaagccttcagagaaatggcgcactggacgtctgagctccaggaggttgactgagggcaggattggagtgcagggctggaaggattcatgaccttaaaaacagccaggggagctggggtgccccaagtagaagactagggtctacagcgccccatcagagcccctcacactcttccttttttcctcccctctctggttccagaggctgggaaagagggaagagaaataactacacagcagaatggacaggcccccacccacccagtcataaactcatgggtgacaattgtgggggccctcacctccacccctaaaagaattgaacctgggctagctcctctaagcgagtagtacagctttcagcctaacaagtatccatctttactggcagcttcaggggctggtggaaagagctctggggtcagacctgctgggctttgcacaccagcaagtcatggtctgactgtccctgtgatcttggagagtctggttcttgggaaggggctctgacttaccctattctcctgcccgatgccttctctagaacccatcatgcactacgtgcttcatacatgcttgcagaatccaatgtgatccttcctttgcaaatgtttttgcaaaaggaaaatggaagtgaccatctccccgcctcagggggttgttgggaatgttaaagagatggtgcggacatgcagggagaacgtgtgcataacaggcaaggtgggcatcccctccacatcccctctcctctccccttgctagaaaacccatatgcttctgcaaagcaggtgagacgaggcatgggggaggggaggacatcggcacagacagggaaaccaagggacactgcaggaaagcctccaggtgacatgggaggccccatgtaccccaagtgccctgcatgagctgccttctgcctgcccccaccagagaaccctgcagtgaagggacaaattcctaatagcggggacgtcccaggagggtccctttcctggggctctggcccaaagagccagcacctttgatgctttcccaaagatctcatagcagggaccccattctacccactcaggctgaaatcagtgggaagtccctatgctctccccatctggctctccctagctttctgggggtgatggatggctcaagagttgcaatttttgttctgttaagaaagcacaaacaatccgatgccaggaggcgaggaccttgctccctgttggcgcctggtgcaatccccagggagctctaccagtgtcagcagagaaagggaaaacagctgggtctctagggcccgagagcaggcgggagatttattattttggggtgattaaaccgaagcttccaacacctcagtgagtgtttccttcttgctacccctgctactcagacacaggaaccgtatggggcagcctggctcccggtggtcccctctgtcccggtccttgagaccactgccaagacactgcctccatcagacggccaagctctggccagcctccaggtcctcgcctacctcccactccattccctgtctgcaattgtttccaatcagtttaggaaacagctctgagaacaattagaaaagataacgaggaagaattacataattacagttctcctagatctcaggcacttcaggggaaaagaaaaaggctgaactgagtccaaacagggaccaatgtgaggaaaagatggtacttctggaaagctttcggggtgcaagggcttagaccctgaaggagagtgggaaggacaaaggcactcctatgtctgcctgctggtcagctgggggctgcctccagctcagggcctcaaaggacggctcagaaagtcctcatgcaatgcagacctctctgtggaatagccatgtagactacagaaccacgtcccccttcaagatcatgcagcccaaacttctcattgtcaagatgagaaagaccaagagagaaaaggtcttgccccaagccaacagaactcaggactccaagccccaggccaacactttgtccatgtgcaggctccttaacttctgtctttggtccctgggttacaattcactggtcccacccactggacagctgggaaattctaccttcttgaccaaaatggatgggtataggaagaactttgccctctagagtaaagatgggcaaacttttcccaggaagggtcagataaatagtttaagttttatgggccatgcaatctctgtagcaacaactcaactttgccatcacaccacgaaagcaggcacagacaatatataaacaggtaagcatggctgtgttctagcaaaactgtatttgcagacactgtaacttgaatttcatattattttcacatgccatgatatattgttcttttgatttttttcaaccatttcaaaacataaaaatcattcttcacttgtgagctataaaaacaagtggcaaacaagatccagtccatgggttggagtttgccgactgttgctctaggatgttgctagaagactttgtgcttctctgattattccacacccagagtttaaccattccttgactccataaacccagcatggtatttagaacaaggcttgatggtcagtcttttctaggtcacattgccgtggtaggccaggctattaccaactatgcaagccctcaggaaatcatcctacgaggtttactcaagacacctctgacgtctgtgagaacccagtccccaggagcagagtgggcagctggatgacagctttccctagatgggcaaacaatccctccccagaagaatatggaagaggaattgcgtctcaatctgcccctctctatgcagagggtatttgtggcatatgaggtaataagagaccaacatcctgagtttctatgcagcacaacctaacttaccactgtcttctcctactgcctctccgtttagcaacagggagtaccaagtatcttcattcattcaaaaccagcatattgagtgaatgcctattctggcatcatgccagaggaaaatcaggcacaggatatcagacacatacagacatcaagtctctatgcggttagtaccctgacagcagggacattactcctcttctgcacccagcacccagcaccgcatgaggcacacaggagaagctcaggaaatgctgagtgaattagtaaatcaatgtgcaagatggaaatggttaagtagcacaaggcagatcaaatcctatgcaagcagagaggagggagaattaggtccagctgaggaagccaagaaagggccaatgacagagggggcagttgagctaagcctgacaagatgagtcggattagggtatgcacagttggggcacagagaaagaggagagaaaaattccagccagaaagaacaactagcaaggcatgatggtgtctataagaacatgcatagctgaggttgcagtcttcatgcctcttgaggagtaatagcttgagtgctaacaacccagagttaagctgtttctagattgttgagggccaagaaagtcaggcaaaagagtttaaacatctgtaggtggtaggaggcattgaatcttctgagcaaagatggttgggtggcaatgagattaggaaagtgaacatggtggcagagtacataaggactggataagcaaggagtctctttaaagaaaccctaaactaggacaggagcagcagcctcggccacaccgctgggtgaagcggaagagtggctgtgggccagcgggaggaggtgggacttgtaaagtgattcatggttatgagtgtagacccgggaatcagataaactgggctcaagtccaactccagcacttactccctgtaaatgatcagtcctttctagaacccagtttccctatctgtaaaaccgaggcaataaaatggagtcatcatctcacagggtccatgtgaagctgagatgtggttaaacatgtgaagtgcttaccctcgtgccctgcatggagcagattctcaatagaaatttgctaatcttggtcaaattctgtccattggccaggagtcccagtcaggccagagaagcttgtttttgccagagaggtggaagggtagttgaccacagtccacaatcactccccacctcccctctccccctcccaatcctgggtggtaaggcacacaccacatcctcaggaagctgacatacaccctcctcgtcactcctcagccagctagtgaaaaccaacaaccagaaatgtgcagtcccatgtggggacctttgtcaggcaagtcaatgtgctcaacagaaaactcatagccccaacactgtgagagggaaggaggaagggagggggaagacgtgactcagaagttaaatgccttctttcttagaacacaggagtgtcacagcattcaagccaagacctctgacctgcaagacatctgacctgcaagagggctcacttttgggaaccctcatgctcacgatttaggcctctgacctgctaggaacatgatcagcatcttggcagagagagcacaggccctgcatccaggcagccatgagctctggtcttggcctcagcgctccctggccatgtgactacgtaaataaggacatcagttaaataagggtacgtgagataatgtgtgttcagcacagaccgtagcccagtgctacagaggaatctggaatttggagacacggttgctcacacctgagacgaggataggacctcgcctctcataatcaatgcctgcctgagaccttggtttctgcttaggtggaagtggttttaaccaggctcagaccctcctcatactgcctactggtggcctctgtcatgagctctcccccacacctttttagatggctcctctgtcttcctttgcgtggaggttctgtgtttctccacaatagtagtctcttctcttccctggtccaattacagcccaccctcctcactccaagaagctgggtatcccatccctgcatctaacggggtaccagaactggtgacggacgactcaccagtcactcgtggcattctctaagaagcctttagttagtcctctctgcaactcccttcgaatcccgtttatgagtgaccagtctcccaaaagcaagaatgccagtccaagaaagcaggaatggggatttgagaaaaagaagaaaataaatgtgtttctgtgctcagggaagctctccacacaacacagctcaacttcctactcctgcattgccatctggttgctactggcaaccaggcaatcatatttttctagtcccagatataatcatcataatcaatatagggtatttatcccactccttggttccaaggaactcaaagattttcacatctattattcttccttcactaacgtgagggagagaaggggaggaggtctgcttgttgatggggtgtggggaaggactatttcacagatggaaaaactgagggaatgggtaagaaggaggctgtgggaacatctcttaagaaaacagtattgctaaaagcagtttgcatttggatagtgcgttcacttttgaataaaagtgaaaaaaatctcatctaatttttacaacatccctctaaagtaggttcatttatcgtatagacaaagcccccaaaagtaaaggatctttccagaaacacaccactagaaatgacattgcctaaactcctaggcctttcgagtcccttttagcatttttttcccgcagcatctctgcaaacaagtacagtacattgttggagctatcatgtctcttgtatgcattaccaccccaccattgtaagtgtttctcattatacttacattgtgcattacagtggctcttacacataggaggtttctgtctagttccggttgatacacacaccaaatgggcaacagggccaacaaaaatgactagactaaagcacttgactgcgttggaaaacttaggagccatatttaatttcctaaattctataaatgttcctttactagagtaaaacttggggggaaaaatcaatagttttgactctgagatcactcaccgcttttgacaactctgtgatgttaccttttcctacagccactggtttgatgtcaccttttgtcacagtaacaaagcaataccaaaaacatgctttgggggtccctgaagtggacaggaagccttctaccctacatacccagcaaaggcttcagtgccacccttgctcattagtgccaaacacaggtggctggaggtaaaaagacactcaatgaaacacaactgcaagagaaaacatgtggccacggccacagcagaactgttctaagatagggcgtctttctgaggtttgtgctcagcattcatttccctttggagacagtagaaacaccactgaaaggaagagagtagctggcttgtgcatgaagcttcctctctgttctcagaaaagagaaccagctggacaccatcttatcttttatcatttcctacttagagagctgcacaatttaccccttagaaggagaggccccaaacagaagacctgacctgtgatacctgtgatatccgcgacctcctgagcaaggagataaaaggactcaggtcagccctgacttcctaacctcatctggcacctcttcggattctagaaagaatcaccatattggaaaattccctccataccctcattccattcagttgagtaggcagaggggggaaattagaaacaaaagtgcctgacatgctaacaccaggctaaggattcacagaaggaaaagttgatgatcccagtccctagagatggatgaaccagtgtcagcccatcaatgaaagcatgttcagcacctactaggtgccattactatgcaactattccaagctgggtcttgaaaccaggctggtctgcccaccactgcgcagccttgcctgactccaaggacgcttcccgcctttggttgcccttcctttccgttcctatttcctcagtttctgacactttgcttttgtctctccttctctctccccagtgccctcactggcatcagatttggcactccggtgctggctttccaagctctcttttggccacagtgtgcacccagctcccggttccatggttttctggccaccgtagtgtacccacattgctgtccctggggcccagctcaccttatccatcttggttggcatctctgccatgcctgtcccagctgcccagggtgggaggcaaggagggcagagaggtaggtgaacactctgtgcatgctatcctgtctctccctgatgtttagcaaaattcagacttagaagttcagattccctcaagacacaaaccagtttgtggcttttcttaagtcatgctgtttcaagtctatcttaaagtagattcctgactacaactattgctttctttgtataatacttgcttctttccaaggagcttgccatctgctatctctttttagccacataacatctttgggatgaaacgtagtcagatgaaagaacatgaaccccatcttgcctcatttggggacaccaaggcacacagaccatgaatgatgttatcctaagtgtggaacggtgagctccactttgctctgaccaccttcagctgcataagctggcacagccttgacgggtacagatgtagagagttagaggattagtctcttgtgtggatgaaacactagccttgccagggatttaccaaagtccccactctaatttttcacccaggatgaggaacccaagtccagaggctcaacacctctttccaggtctctgctctggggccaccctgggaagagacacagggctgagatccaagttcccagtctgttccatctctccccagcccttctttatgcataaaggacacttgttggggagtcagtctgcgcttctggcatctggacacatcagcctatatctctaggactcgagcaggaagtatgtttgcctcgcctcgggcttcctggccacacagacccacgtcctcatttagaatggtggcatcatggagccggctgagatctgcagtcttcagtgtcagctgcgggtccacaaactcctactgaacacgtacccatagccccaggggaaaaaacaagggaggaaagaaaataaccaaggtggggaggggggagagattctggaatctagacaacatcaagagccctgtttccatgacaaccactacttaatacagttgctcagactgcagcctgttctaatcggccccgtggatggagcctgcagacccagaaatggcctccagccacggggctcccaagcagcctggaggaccaccaccatcctccaaccaccccaatctcctacaaagagaacagagggcaaaggaggggtgaggctcacaggggaggtgagaaagaacaatgaggagtgttgaagaaagtggaaagtgaaaggaaggagtcagagatacagccggacatccggggggttgtctgtggatgtttgctggggccacctgtgttcggcaacacttgtctttgtgttggtgagcctgtgagcacccatgagacgcatgacaggctgtagccagcgtgagtgtgaccatccacagcacgtccactgagcccatctcccttccccttcctacacattggagtacccgcttcctctcttctctcttcccctacaaagctctaagctttgtagtccaaggataacccctgtgaggcaaaggccagggtcagcagccagccagtaggtaccagcagcttccaacaatttctcagcaaattgttgggatagaaagaacaatagtactaatattctctaaattagaggtttctggcttaggggcacccccgaaccctgctcctcacagacttctccagttcccagaaaatgatgggtgacttctaggttttcttccaatccacatatgagacctcagaggctggcaacttgtcaaagtcacctgctgggtcaggtgtcagcctggagactctgtccctggaaagccacacatctccctgcatactccaggctgcactctccttcttcctgtattcatctggcaatcacccaaacacgctgcaaatcagatgacatatgacatgctgcacactccgtccaactctgaagggagtccgtctatggggacaatgggtctggtttatattttaagcagctagagtgaaaaacggggagtgatgaggtaaggccatggcaacgaacaccatgccactatccaggataattacttcgcccagccatcctggagccaggcggcggaagccttgccccatagattatgagcaatgagacagggccagccagcttaggaattcccttcctccacctgcaccttcactgcaaatggaaacacagcagaaggaaccaatgcagtgggagatcccaatcaaagcaagatgacctgtccctcaatttccaatcgttggagaaatgcaaagaaaagtccctatgcatacccctcctccaagttgctacatggaaaatcagagctctgaatttcggtgatggctgctgagccaagagacaaggaagacccaaaatcagcataggacagagatagtgaaaaggtcagtgagcgagagagaggaaaggagaagctgaaagatgtttgccgcaagctaggaatgacctattaaaatccccagccactccctcaagctgggatgcggtccctgttggtggcttcacagctgctataccccactcaatgcaggctgcttcagggctccaggacacttgtactattggccagctcagatgccacccctgcaggagcatgtggaaccatctgacttggatatgactgggctttcctgctgcaatgccctacagatgctccatcgccatatacacatgccttgctcagggatcatgcccatgttgaccttggccccaaaacacggatgggaaggagcatgcccagggagcagccttatattttcttttcctttgttccctgagtcctcagatgaaaatggctacaagctgatgctctggagaagagaatccaattcagtggccacaccaactaatacagggcatccactttgctcttcaaagacaatcagaagtgcaatagtcagaacatggcgcataggaagatcctgaaaagtccaggcctgtgccagctgcctcccttcgtggtcctaagtgcaaccccttaaagtatccgaagaaattgactcctgaggggcagaaatctagcaaggagggatgtgaccacacgtgtgtgtgcatgtttgcatgcaagcacgtgcacagacacacacattcttacaaatgaaactgcaatcactggtgatgtgtgggtgtatgtgtgagagttagggggttgtgcatgtgactatgtgaagctcgggatcacaaatggaaggagagctgcatctgaggaaaaaaaagaaaaaaaaaaaaaaaacagaaaaagccaccagccctgtaccctccgcaccaagagatccttagcttgttgcactctcattggcctcttcagcctctcctattttcagtgaaactctcctttgtttctcccaccccaggttggccccagaccactaaatacacaccacctgaagatacagcaaaacccagaagtggtgaccacagcaacatgagtacacacactgcagactgtcagcagcaggagggtcatgtgattgcagagggcagcctgacaagcccatgtgattccctccacattaagtggaaaacactgtctccactgagaaagagaggtgaagaggtgggaggagtgaaaagtgaaattaacttgagccaagattacgcccatgggttctgtggaggccaggccggaaggaaagtcaagaggaggggcaggaactgcatccagcgtgtggttgtgtacggttgtggttctgggaggatggagcttttgagaagtgtgtctctggtacaccctatgcaggaaaacctcagcacgacttacaggtgtataagcatgtgtgtgggtttgcacgcagcatgccaaaagcatatttataaattgggttaaaggttggttaggaccacagattctggttaaaataccagctttagagtatatgaccacttagagcttcagtgtcctcatctatgaggtgtagataacagtaagtaactatcatagggttgctttgatgacataatccatgataaagcacgggacatagggcctggcatgtagtaagtgctcaataaatactaatttggtttattattatttgatgttccccatgatctcaggtctaaaatgacatagcaaaaatagggtaggtagatacataacattattatttgcaagaaagccacagttcatattacccagttaaacagggaatggctaacttctcaaccacacactgaatatcaagataggatgataattctaactggataatctcagtattagtctaacatatatttaaaagtatcccatagtgtcattgtaaagcaaggactttgatattagactatgggagtattctatttttgccacttgctggtaattaggctggcttagcctaatgccctgcacatattaacacctcaatagctgtttttaaaaattacagctctgtggagttttagatgtgcttaatattgacaattctgttcttggtctaatagctttttttttcaatcatccttatagctgattgtcaacatatcaaaacaaaaagatttattccatatcaactgcccactgctagacagtaagtcatcgatggactttcacaggtttatatgaaacatatggatgtattaattcttcaacccacattgagatgaactgtcacgtcccttttaaactccatcacaggcagcaagtattaacctgcaattattaccgtgtataacgtgctttacaattggcaagaacgtcaacagtccctggttcattcagcagccctggtatcattcacaaactgcagttctcttttttttcctcaggcctggagggaattgagaagcagaaaataatctcaggcagatccagctgccctgacacttgcagtgcagctggcaggtgccggagcttcagacacgtggcccacaggtgcaacaaacccaccttgcttgggctctgcaaccatagagtcccgccccggccaatgaagccatccctgggggtctctgaaaattctccaggctatctgcaaactggtctctcagaatgtgtggccagctacactttagaatacatgaacaagcaatttacttggtgattcacattgtacatacatgtatacacacaggtacacatggatatacaaatacacaatatatccatacatacatgtgcatgcatatacacacatatgcatatatatacatacgcatacacacatacacatacaatgtgtatatccatgcatagctacccttcccagtcaccttgggtgacacattttgctggggatctttgtgggagaaggaggggcattttctgctgctcaaatagcttttggaaccaaaacatttgcaaaccacttgtttagggggcaagacctgaactcaaggagcaagacctgaactcagaggttcgcacaacaggtgaccaaccaaagtttgcggtcctaattatttctactctcttttccctttccctaaaggccctaggacagtttcctctgcacccatggtcctctaggccctgctgagtagggcactactagagagagaagcacctggttcctgacctcaaaaattcccagtggtgaatgagcagtgtggcactttgtaaagctttatggaattaggataaatgcttctggctattggaaaaccttatttcacatgtgcacacatgtgtgcatgtgcatgtgtgagtgtgtgtgtgtgtgtatgtgtgtgtgtgtgatctgtgtgggcttgtgccatgctgccataaaacacaaatttatcttcataatagggtcaattacattctccgatttccccacaagtgaggcaacaaaaacaaattttgagcttcaacctgcaggagaatgccaggatctctgtgttgaaaaagggagccttggtttaccctccccctgccttgcacagacatatgttgcacagacaaacacctggaaggtgcttctcaattctttgaggttgctgcctctcacatgcagctgtcaaatcacaccccatcaacatgacacagcaaataacactacgacacgcaaccagcaacttttgaaagtatactctccccacacccagccccgtctgccttctccagcgtgggctgctgtcttcaaactaaccatcctgaaactgctttaaagagcctgacaggtaatttattctgtggcagaggatagcaatttcattgtccagaggcaagagatccaactatatcagaaaatccgtactctcaaggaacacaggtttaatatgataacgattctaagggtgtgtgttcataattcttcctgttctttcctccccttccctaaagctgctagtgaatgcttttgcagttttttttaagggccctccaaagaactgacataaaataaatcaaatattttaccacgaaaggtgattatcaaacacttatttgtgaaaagagtcaaccagaaggggtcaaggcctagctgctgttatgggatttttgcccacaagtaaaatgtttttaaaaattgcatctgactctcttggcagaaaacctgctgggatctataaggtttcacttgggcacctggtagagaaggggatgaagagcaaaaaaggttggtgaacaggacaacatccgcttctagaagcaaagtcaaggccgctatgcacttatttttccaaaataatatgatagttattttcacattttatttgctaaaatccatgcaaagtaagtattattatttccattttacatatgaaaaaaccaaggcttaggatattgaagactcagcttcctcaaatataatataggaacagtagaccctgggtccctcccaatggtaaatcacaactttgcatggtgagctcccatcagaaatagaactagaactgaagtctcctaactcttagtctctgcctgctagctcccaccccatgtgactgcatcagatctgcattgcaacaaaaggtaaattcgatgggtaggtgatttttaaactcgcctttgtcaacgaacttgtcataagatcttggacaagatgcttccctttttagtattttggaagattgaccagtaaggggaggctgatagctcctcagatcatcgtgagttctttctgggtggcagtgtccagcacagtgcctggagtacaatatatcctccataaatgctcactgcattgaattgagaataacaacaaaattctcttaacccccactgatgttccctagctaggagcacgttgcgctccgaagcacaggacattgcccacagatcccaaggctataggacttagcatttccatgggctcattgcactaagctcagtgtttttaggtagtaatgaatggaattcttttttaaaccctgcattcggagtctatttcatgcctttttacatttcacattatatttatatttttaaaaatcattacctattttacattacacattttaaaaacctattcagtcaaataataatcctattccttggctgccagtcagggaaatgaaggtctcacaaacagtgatttgcccaaggccagcaaagactgaatatcagagaaggatgatcccaaaggtagactcagcttaatgaggccagaggtctgttggggcttcactttggagaagtccttcagggtaaggagtgccaactgctttgtgaagtggcatgccaccaatgctcggtcaaaatcacatgcaagagtgacactcctgacctcaaatcaccagttgatcagagtcaggggcaagacaagggcacagatcttctgaggctggagaaccacgtgctcaccctatctgggaggagccccaagcccttaatgatctcacgtggccttcagggacacccaggcactccagagacaaaaagagaagacagatccagatctgaaagagcagagaatgagttgtcagtcagggacaaagagtgggagattaagggaacatgctaagtgtcactagcctggattcttgtgtcagggccacagaggtccctgatgccaaaagctgggataagcctgtgggttgcatataagttgcgtatgaagttactgcttgatgccagcaagcactgaaacaagaaagagaagcctgtaaagatggaaatgaggcaactcccaacccccatcccactttcagaagttttaacagatgtcctttccactcccttttttcttgggaatgcctcaagattcttacttttctcgaacgggcaactttccccaccacctacgtgttctttctagattccaatctgctgcttctccatggggttctttctgttctttttcttttttcttttgctgacctttgtcctcccaaatgttatcactcagagaagtccccctccgcaaacttccccacttaagtgtgctctgtgcccaggccctgggctaagcacgagatgtggaaaactgaccaagacaaaaaacagtcccaggccaacctgacctcacagtgtcaggcattaagcaagtaaccaagctgcccgcatcagcaataccttctggcccctgatttttctgtctctgcgatttaccttgccctgatctagcagacttaaagggatcagtttttggggctggcacggcctgagaggtcaaaccccgggacacagtgcccaaggctggctggcgtttgatgggatggcaccagtagggtcctattggttgctgacaaatagagtcggctctgcttacccagcccgtgctgcaccagcttccatctgaacacccctcctgctggttttatcacgaaggagaccaaccaaccgaagcctgagatcatggtacagccatgcagatagtcagacctctccatgcttttcccactcctgtgtcttcaggggcctagctccctcagattctcttggggaacaagaagctttgcccaactgagggatgttcctttgctgatgtttggaggttttccttcctttttgtggccatgttcctacagccaaggcaaatccaatcagcagtaccatccttgttgcaccccgtcctctgtgggggaactttcccggcttctgggctgttctccatctggttccaaaatcccaagccttcagagagagcagtcgcactgcctgaagtttaaatcaactaggcaatttgctttctagaactcaagtctgccgatactctgtacagtttttctttcctcagtgcaaacgagaaactgatggtttcatgactgtgatctctctgccctctcctcccagatgtttctagagtcaattccagctgccaccgggcctgttgtccatttcctggcacgtgctcagtcaatacaaataaagacgatgagccgacactgcgcgtggtcgtgaccatgttcccctggattgccctggacttggtcttcctttagacacttccctcttcattaacctcacgtctgcatcctttctttattacacataagtgaaaatattgctattgaaggattcagcagagaaaatttccaaagaccaacatgtggcatctccagggttccccttcattttctaaattggtacttcactcaaaacatttctggcataacttcttttcaaaaaatgtgtgcttccattccaagcaacataataatagaccaatcccatcagtgagcagaggagggccatggattcctttggctcccctgctgccattcagtgctaaaacactgtccaacaaagccacatccacctcagtgaactgggtgggatccccctgcctttgttctttctctgcaaatgcctggcttagaaactaagcctgattgaaaacctgcagaccaacttaagaacattgtcttgctgaatttcagccttgattaatacccttttctagaatctgaaagtcctttgtcttgaaactctagtccacacttactcctgtccttcaaatttggaaattaaaccagatactcaccttctcatcattttaatgatgccctttggctcaggtgttgttgtcagaaagtaactcttctctttctttttttgagaagaagtctctctcttgtctcccaggctggagcgcaatggcgccctcttggctcactgcaaccacctcctcctgggttcaagcgattctcctccctcagcctcccgagtagctgggatgacaggcatgtgccaccatgcccagctaatttttttactcttagtagagatggggtttcaccacaatggccaggctgatctcgaactcttgacctcccaaagtgctgggattacagatgtgagtcactgtgcctggctgaatgtaactactttattgacaaagaggacccagttctgtcctttgagtatcttgaatggcaggtgtcatctaatgaacatgtaaagggacctaagttccagtaaccccaggcagcctggtgcacatctgtgttaaggtgtgtgtgttggtgtgggagggtgtgtggggtttgtgtgaagctgtgccaacctgtgggtgtgcaaccatgcaccctctccactttccccacacctgagtggtctgctggtcaccgtcagtagaccatgcatgcaaaatcattcttctggacgtgcaggagaaactgaaaaccagcactgtcaggtgtgttaaaacccttaagattggttctcggctgggcgcggtggctcactcctgtaatcccaacactttgggaggccgaggcgggcggatcatgaggtcaggagatccagaccatggtgaaaccctgtctctacttaaaaaatacaaaaaaattagccgggcacagtggcaggcaccctgtagtcccagctactcgggaggctgaggcaggagaatggtgtgaacccaggaggcggagcttgcagtgagccgagattgcaccactgcactccagcctgggtgacagagcaagactccatctcaggaaaaaaaaaaaaaaaaaaaaaaaaaaaatttgttctcatgaacttcctggcttagccaaccacatccacccttccatgtgtaggttaatattcccaatctgccacctgctcctccttctatgtgatttctcgagcagatgcaaagagacttgtctggggcaactcacaccccacaccatcttgatttttgtctctggggtcttcaaagccctctccttgccacagccgagtgagcgcccctgccttggcatccactcatctgaccatcatcagtgcccctgtgggtcttccccctgaaagcatctcacacaacacatctagttgcctactgccatggggtacagtagataagagacttgtctccatagtgtgaaccagaatttattgcatctgagcaaatcatggtcacagctatgtagctttgacattcacttctagatagataatggcatttttcacgccaaaattctttgaaagcaaatatatgatctggcttcattccacaaccagaccagttgaaacacctcacttccctgtacagaaaaataaaagtgagaaatacaaaaaagcagtcctagaaatgccactgaccccaccctgtggatggaaggcagggtgggatgggaccgaagggtgccaggaagctcttctctctgggggctctgctcagccctcactgtgtcccccctcagggattccagctcctcacacagcctctcaggctcacgtgataaggtgggaaaatgaaggtcaaagttaaagagcaaaaactcccgagaccttgatgaaggaggttgtttgctgtgccctgaaagttgagctgatgtctccctggtaggcttaggtcagctctgctccaagttaacacaagcccaggagccccgatggaggaagggaaggcccaaggcggggcaagactaagacagccaggtgtggtcttgagcacaagaggtagactgacccccaacctccctgagctacacgtggataacagtgcaaaccctttaccgttgttgatggttaaacaagaaattgcatgtagcgtgcttagaccagaggctgcacttcatccccactagtaaaggttaggtaatattaataacaacatacgaacaacaacaaataccccattatacttctttttgtcacctcacagcccaacaaactaggcacaggcactgtcaccatcccattatgcaagaggaagtccagcccgtgtgccattaactatctgccccaagtctcactgctaaaagaggaattgaaaggggaatttgaaaagggtggaactcatggattccactggaggagcccagagaagaaacctggtaaaggttttcaaatggcccagctgcccagacaatgcatgaaatctgaactctgactctatctctcttagcctttgaactgcctcctcgaagagaagtgaaacttaactttataaaccagacactaagatgcatcttttaaacaagaacatagagtagctcttcccctatatcaagcatcaactatccaggtaactatgttacctcattgtatcctcacaaaaaccccaccctatccgaattcccaagggttccattttacagaggaggaaatagagagtcaacaagctaaggtaatgagtctgaggccatataactagtaagcggtagatctgggattccagcctagagctagctggtctttggcaccattcccctttgcagcaggcctgcagcagacacacacacctttgaattcctcgacaggcctgtgcctggaccttccatcctcccttcctctccccacccgcccacatccataatgcgcattttcattaggcatctttgcccagtgatctgctgatttgttatattagaattgcaaacaaatgctctcatttcatcctcctatcccctctcttgccctcctgacatctgaaattcagcattgatttttctggccccgctccactgcctaactgacatttccggttgatttcaccttagaggcttgcagttggctcaccaggctcccactagagcccagaatggaatagcgcatcacctggataagcagaattggacctcatcccctacttcctgctctcagtgctctcactgtgtcagaactcagtgccctctagactctgtccccattaaccgattgatggatatgcatacctcagtccttcaagattctcaatgggaagggaaggaggggaaaactgtggaaaatgtcctgggaggtgggaccaggtgaattttgatctcctaagtactgatgttttcagccatagctggggtaattggacctcttgtggaggagaaaggggattatgaggaagaccaaatggactgagagatagaggtgggaaggggactgggataccatgttacaaacagaggatctctcatatcttaatccatcagaagactcatagaatgatcacttatctaaaatgggacttaataatccccagaggtcatctaagtcagtcttctgtccacaccacacagcacatcttaggaaggtgagcatctctcctaagtttaagaactcaagctgggtgcagtggctcatgcttgtaatgccaacactttgggaggccgagttgggcagatcacttgagtacagaagtttaagaccagcctggacaacatggtgaagcccacctgtacttaaaaaaaaaaaaagattaaaacactttttaaaaaaattagccaggtgtggtggtgtgtgcctctggtcccagctacttaggaggctgaggtaggaggattgcttaaacccaggagacagaggttgcagtgagccaagatgatggcgctgcactccagcctggacaacagatggagatcttgtcttaaaaaacaacaacaacagaaaacacctcaaacaaaaaaaacgtatagcatctctcacaccttctagcttctgtctctgataagtacattggactactaggttccaaacagagctacgttttcctcccaggacttcccattcccagtgggtactgaccagtgggtatccaagttggttttttatggaagcttccattttgtcaataaggaataggcccagtgtcctgtgaagtggtcagtggtgaccagctccacaaggagaagacaactcacagaggtacactagagtggccattgccagctcacaatagctggttgttacatttttaggaagtttgtgatccagttgttaaactattggtagtttgcgaacaccagggtagaagtatttacaccatagaaattggcatctgctataaattagggcttcttttttctgcagagccaagagtttcatgaagagggtgcccagtcatgtggtcaacatagaaagagggagaggcatagaaagggtggggtgaggaggacgaggtggaggcaagtcagggaaaccacattctttagtatcctcggaaaagcaaactctaaacaatcacctttccttccttcctaactaggaaacatcttattccctctgcagctatatgttatttcttctctaaggaaagcagttattgtttcttgttctcagacctaaagtggagaaaactagagacagaactttggatcctatcatttctcagaagccatgagtcagagaaggaagaaccaacaaagggctctgaactatagactgaattctatatgcacatttatacatagcccagttctagttgtctctagagatttcttatgtagaaatatctatacaagacaacagctaactgtagagctcatcaaaatcagggattgtacctttcatttcttatataaccatggttgtacctggtaagatattaatgttacaacaggtaatgaataaaattttggtttattaattgaatcactttgaattgaattggattggtggcaaaccactggtttatgatcagatgtcaagacttttcaaatcccttttctaagaggtaaaaattagctggttggctggctggctagaccaatagacactgattaggcatacacatgaccttataagttatcttgagctcacacccctggctctactcattcctgtattgtccagttggatggctttgcttctttctccacagttctcctggcctcttactcagatccatgtgctttgggcttttggttcttagtaagctggtaacttggcccctgactacattcaactgtgcaccttgaacaacccaaattaaaacaatccaaagcctagtcaggtcaagacaatgaagctggtgccaccatgtccacattcagaagtggactcagaaggcaggaggaaccatgttctccaaacccccaactcaatcagtgtttcccactgcagatgatccatttcagggaaaccatgcccaaagagatgaacggacagatcctggtcacatggcaccagctctactcccataaaggggtgaggaggcagaggtaccttatttagaaacctgtccttttctggatcctctgtcacacatgactgccactgtcacacatgactgccaccattggtcatgcttctctctttcctgacagcttcctccagaaccagaggcaaagcaccttcagtgccctgtacaaaagcccaggtttgctgggctggggcactgcctcaacagagaggcccatcctccccaacctagtggcagaagtccagactacttccaccctaatctggcaatgggtgttcgccttgggggaaccaagacctctctgagaatcttctcaaatattttggaaaatgctcatgcatccattgttttacagacaaacttacagagctcagcggctgtgacagtccccctgggggccctgggctaatggcctctgatgaaatgcctctcccagtcacactgtccatttccttcctggacaccagctcctgtttttcatttctcgagtcccctctgtcctccaggaaggaagatgactgctctatggtacacctccacatacaggtgagcacactgatatccacagaggccatgcaacttgctcaggctcgcacagaagttactaggagagatgggatcgggatgtaggtccaggaggctgtggctctttctagaatttaatgcagccacacagtgctgtgtttgtggatctcagaagcaaccacatcaaaaccctggcctctactcttcctcagctatgaaggaggtatgaaacctcatacatgaagtttcaaaatgggagggagtgctcctccaaggaagcaggtaggtctttgctcagaggtaggcgggacacgtgattagctctgtgtgtactggggtgatgtcttcagaaccaataccgtaaatgcctctgacacaccgtttccactgttaatgagaaagctctaagagccattaatctcattactgttctatcagcagccagtgatcatgttcatttcactcctcctctccaactccttggtcactcagctactgagaagggtggactgggaaggctggaaaggccaggaccctgccctcaactgaagtcaacggtggcatcactccagaattcttggagcagaggaacctgctcagcctgctataggaacaatggccaaggaggcagctgtgtccccaggactcctagcccccttagtgggcctcttcagccctctttctctctgagattctggagtatttctgtatgtccatgagggagcactctgtcccactatggcctggagctccctgagcaagtcggaggcccaggaggcccacatggatgagtcagtccctagtcctcttgttttatggctcaaggtcctctgcaggggtggaatctttgacccaaggctaaggagcccagaaagatgattcaagtcagagaataattccaggtcaccctctcttctgtagccacaccttcaaggtgtagattatacaaacccagaagtcctagttactcactaacccccagccacttttgtgaaaatggcacttgactgctatgccttatggaagaccgtgtctaaggaaggagcgtgaggccaggtgtggtaagtctagaccacgagggactcagggcccacccttcacagctgaggcctcatccacgctggtccagaagtcttcccatcataagcatctcatcttaaggagcggctgggttatattccagtccttctggctgatgtctgcaccctgggcctcctctttgctgcatccttgccctgaggcttcttgaggttatcacaggaaaagggttagaggcagcagcggctgctgacgtcacatcagtatccccttcaccaccaagagccaatgtgctgagcagcttagagggtatttgaggaagcatgtccacaagggcagatgggcctggtactcgggaagttgggaaaatacaattagacagaagcctggtcccaaatcaaaatttcagtaagggcttgcctgcactgatgtccagcaaggaaaggctatttcctttgtggggtctcctgtactctgttgtcagccctgcctgatgggcccagtgggtaaagggcagtgagctgagctgtcattgaaatatccctgcatgtagagagtctttctagaaggaagcaagagcttggtccacggactcccatgagactccaaaaagagaaggcagtgccggcccctggaagagaccaagctcacactcctaagctaccccagtggcccaggagtgattggcacagggatgggatggggctgtgtgggaagggcaagttcattggtaggcagggccctcctggccctgacagccaacgattcccatctttcttcaatcaataaaacttctgctcccttcagtctgtctggaagctcttcccaaaaggaggctcaaagtatcagacaccaaaatattacatcacactccctgcccacttccttccccaagagtcctctcttattccaaaaagggatgctggaaggacacacaagagtttcttgcccttttcttttggttttatttttgtctcaagtctggcttagccatgggagtcagagtagagaaagaagatgttttcctcccctgctttggccaggaggataattccaaaggaaatcaaaaacctttatctgtcatcatctcccccagcaaggcatcccagcaccatgcatttaatagaaagagaaatcgttccagcatggagagatggaagagacagcaataaaaggccaggcttctgcctcccacattagcgtcccacccatcaggaagcatgccaagtcacttcagacccagggagcctgtggcatgcccatctctaccaagtacatgttagcagagctcagaaggccaggaaaagaagaagtaatgtgtccaacacaaggaaagcgatggtggccatgacgtcttgggaaatccaaaaaaacatggcacacagtgtttctagtctcgcatctctccctgcaaggctcattagtgagccctcacacactgcaagatatggtctgaaaggtgtaagggtccagctcccagctccctgggggcctgatactctaccctctcgcttctgtggggagagatgcaaagaaaggcaatatggccatctcttcatgggcaactctcttccaacccaagctctctgatcttcaaaggggagagatggggttggacatgagcatcagtgcaagggctcagagaaatgtatcagctgcaagacagctcccaagatggtcagaaatgcaggtcctaattacatccctccattggctatgaccttgggtcaccacacaccaattatttactctggcaaagtgattagggaattggaaccagggaatggatatgtgttggggtagaggcgggaacctgggggttcagaagatgaggatggcagtggcaaagatgctccttctgcatctgcctcctcctaattggggtcactgcaggcaacagttagggagccacgcaccacgttctagtttttggtcatggggaattatgtagaggccccaaaatgacaagagaagtggaggaaaaggaggagagaaggataagggccaaaaaaacagttgcccatgaacaaatgcaaatcctatgtcaattagggagaggatggaagcaggtcaacaaacctgcccttctcccaagaagagagagaagtcagatcaggcaggtgggagagcagcaaagatgggcaaggctggagagaaaggtgacacagaccccacacagggactcagactgcagggccatggttctccaattatgaccctaggactagctacagctgcatcactcagcccttgtgagaaatacccctttttggatcccaccctagctctattgactcagaaactatagaggtgtgttttaacaagctccccaggtgatcccgattaaccttcaggtctgagaacagtccccagaaggaaaaggaattccagtttcccattgcatcctttgcccacagtgagggttttttttttttcttccagacagtctcagtgtcaccaggctggagagcagtggcgcaatctcggctcactgcaacctccaactccctggttcaagcaattatcctgcctcagcctcccgagtagctgggattacaggcacgtgccaccatgcccagctaatttttgtatttttagtagagatggggtttcaccatgttggccaggaaggtctctatctcctgactttgtgacctgctcaccttggcctcccaaagtgctgggattataggcgtgagccaccgcgcccagccaatgagtgcttttaaactccaaattccccttcaagacctcatatcactttcagtgactataataatcatttctctccagagatgtagtctttgacccaccgtcagcagaaaggacatcagagtgtggtctattttgaaagagcagaatgaggtttgcaccacatgctgagcacacccttgtccctgctctctggtgtgggcaacagcctagcagcccactgggtttagtgtgtctgtcatcaccacactttcctgtgcaggaatggcagcagcaacaatgctgtcaatgaaagtaaaggaagcaagtaagctttgagcacccatgttgggcactgtcctgagcatttgatatgccttctttcatccaatcttcacaacagccccatcgtatagacaaaacatgttcagaggggtgaagccatttcatcaaggccacgtgactcttaagcctcatctcaaagttcttgttcctgcttctgcattgccttcttaagaacaacaacaagaagcctctccattttctttgcagttaatttgcaaaccacaaagccaaaagctgacttatcacccttgcaagaaaaggggcttgggttctgtgaggggcatttcttggctttaacaagaagctgcctgggaaatggccctacaaaaggaggccaagtagagtagggcatagaaaggacgttgttctgagctgaagtgcgcccccccaaccatgtcactgcctttccacaaattcatatgttgaagtcccaacccccagtacctctgaatgtgactgtatttggagatagggtctttaaagaggtcattcagttaaaatgagatcactagggtggaccttaatgcaaactgactggtgtccttataagaagaggaaatttggacaccagtaggtacagaggaaaggccatgtgaagacacaaggagaagacagccaaagagagaagcctgaggagaagccagccctgcctataccttgatcttgggcatccagccaccaggagagcgaaggaataaatgtgggagccacccagtctgtggtactgtgctatggcagccttagcaaactcatccagatctcttcctgtcctacggtgggctgtccaccttcccacagctccttcagcatcctcgatggggccaatgctggccaagagaagcaggttctgtgtatccctgcactgggtggcagcctgaggctgtagaagtaccaccctgactgaggaggttgggagacgtctgggaaacaggcagccccggctgtcagcctgcagcctcgcctggacgctgtttgcactcacacacactggcaggtatctgtggtcatcacggtggctgttccgctgtttgcctccctcctggcaggtgcctgaaaataaagcatgaagcccagacagcccaaggatggaaaatcatggagctgagacaaaacacgtatttgcagagaacaggttcaacttcaggggtggggaggggcgcctggctctcaggatggtgcagagggaatgacagagaggaaggtatcaggtgtgcagcaaagcagaacatgagaaggaggagagggccaggccacattcaagtgtgcccaagtatatgacacacacacacacacgcagagtgagggccgctcgaattgacacttggagacatgccaaaccccaatgcactcactcacacatatgcctgcatgcagaccctgggtgacacacacaagcacagtcttcctgtctgttgggagcccgcgcagtatgtttgctgagtgaaaatgctccttggagaatcctccgtttgcattctccacacacaccctttctttctgggcttcgaaattgtgcatcaagcgtgcagctgtgaaaagaatgatacaagcagagaagcctgccaggatgctccatgtggcctagcggaggggtgggggagtggggcccagatggtcctcagccagtctgagggtgtgggtgcctggctcccagtgacctgacttacagtctcagtccctctcctcccctgcccagacctgaccatcaacccctctgcccacctctggaggcctgggaggaagatgtggggcatgcaaagttgtcaggagaatgcaggtgaggccagccttctgcagctcacaggatggacgagagaaggtgcccctcccttgtctctggccctgatgggcctgacagggcgccggtgggagggcaggagggagacaaaaccatttatatgtatttctggtggacatgtttgggggtccctcttcgcatctcctctgttcttttttttttttttttttggagatggagtctcactctgtcacccaggttggagtgcagtggcacaatctcagctcactgcaatttccatctcccaggtcaagcgattctcctgcctcagcctcccgagtagctgggactacaggtgcccaccaccatgcctggctaattttttatattttagtagagacaggggtttcactgtgttgcccaggctggtctcgaacttctgagctcaggcaatccacctgcctcggcctcccaaagtgctaggattacaggtgtgagccactgcacccagcctctgttctctttttataaggccaagagcgtgctctgaacttccatctcaaccaatttcctagaagaggctggaggtacagaactaagccaaaacaaccagagggactaatcaaccgggtctggacagtgataggattaaagtcagtgacaaattttattatggagctctaaccatgcccagataagtgtgtgacgagaagataacgactcagctgcgaaccggcagccactggggagcccttaacagactgagcccaggatgggccaggaagagaagagggcagtggaggggaggggaggggaggagggctggggaggagttgacgaatcaatcagaaaggctgagggcagggctccctctccattcatgcccaaagaccaccctcagcccagcccacctgggagaccttggatggaactggttcctacatccccatagagataaccgacaccatctgatttgtctcacattccccagtttccatttacactttaatggttctgtattttttttaacctcatcattacctttcagatctaaactcattctgccaacactgaaccctgtctcccatgtcacacagacataaggtatttggagctttttctctggtacctaagtgagtacctgtattctttttaactttctattttaaaacaattttagatttatagcacaattgcaaagttaacccaaagattcctgtttatcccacacccagcttccccttgtgttaacatgttacgtgtaaccatggtacaattattgaaacaaaattaacattgtactgttaaccaaactgtagccttatatttggaattcatcagtttttccactaatgtccttttgctgttccaggatccaatccaagatcccacactgcactgatatttttcttcctatccatttcagattattcattactgctgaaagtaaacaacaatttgatgaaacacatcttaagtcatctctcctttaagcacatgtcccccattgcatccatcaaccttccctcacaatgtaataagaatcacagagaggagctaaacaactgggcagcttgtggtgccatttatgatgtttcatgaaggtaggttctgaggatgacatggtgaaagtggagagaaaatacctccctgtgtggttggccagataatagtcctcaaagacacccatgtcctaatcccttatacattaccttctagagcaagagactttgcatatgtgattgagttgaggaccttgagatggaggagattaccctaaattatctggtaggtcctaaatgcaattgcaagtattcttttaagagagacacttacagaggatagagggagactttactacactgagagggaggcagtgtgaagacagaggaaagagatttaaagatgctatgccgttggctttgaagatgcaaaaggagccatgagccaaggaatgcagccccagaggctggaaaaggcaaggcaatgaattctcctctggaggctccagcaggaatgtggccttgtgcgcaccttggtttcaggccagtgaatcctattttggacttctgatccccagagctgtaagagaatacatttgtgtcgtttgaagccaccaaatttggggtaatttgttacagcagccataggaaaccaacacatcgtgtcatttagaatagtgggcactcgagacatactcattgggcgaatatacccaggtgtatctccttccagaacccactacaccatgcagtctgaaaacgacaatgtaccccattcctgctattttctggtgaggatattaaccagcctactagaaccaaaaagttctttagaattatctagtatatgcttggcagggtctaccaaagcggtacacatgccatgacctagcaatttcactcctaggtatatttccaacagaaatgtgaatatatatggtcaccagaagacctgcatgagagtatcaagggcagcactgttcatagaaggcaaaaactgaaagttattcaaatgttcatcaacaataacatggaaaagtcaatgttggtgtacccacacaacggaatgctacacagcaataagaatgaacaaactacagctgcatagagtgagctgggtatctctctcacaaacttaagtagagcaaaagaaaggagacacaagagagtatggactgcaggattccaggcacatcaagcagaaagcaggcaaagcacatctgtgccatgagaggtcaggatggtggctgtccctggtgggagggaacagaaggggacttctggggcatgggaatgttctatttattggtttcagtacaggcaacatggaggagtttagcacgtgaaaactcaccaagatgtacacttaggacatacgcacattcctgcctgaatatgacagtgcaataaaaagttacccaagaaaccccagtttggaaacagtccctctgccaagcccatccactcccaagctgtgtgcagtggagagctgggcgaaatgcctaacgggacaagcactgcaaatgaggtttgcctattaccataattacatctctgggaatgtgcaaagccctcattttcccttcatgtctataatattgtggggacacaggatgcaattacagcctgaaatatgcagcttaggaagtataaatacacacatctacgtagacctaggtaaaccgtgtgcctttacagagcacgaccgaaccagagcccgcgctcttcctcctgccacccagccgtggagcatttggaccctttgggctgctgtctgatctaagacggcagctctgaggatcaattcccctgagcagacagttttctgaaccagaacccctaatttaaaaattgcctgaagaagcagaaagtaagaactggaggaacagtaatagttatcactgctaattttaacaccaacaagatcttacattcggggaaacgatctcccaccccttttcttatttgaaatatagccttcttgatcataatctgtcattcaagaggagctggatgcaagtggattggcagtaggagaggaaccccagggaaagaccaaagagcaatgagcaggctacagtcaatttgattttgtggattcttccagggccagcacttgcggaggttagagatgccggaaggggtccaggtcttgggtttgtgtgtggtttatttccctcgggcattttcaattcatattcctgctcccctagatattcaggcccatgggcagcattttagcaaatctgggcttgtttcaacaccagcccaagcaggcacagaccagaagagaaatctgttggtggtggggatgctgggggcagcgagcctgatctgaagtggggaggctccctcgatcctaatatacaatatcccaaaacaaagtgaaaataaagtttaaattaccttccggtttcgatgatctaaatcacacctcccttccagaagtgtagataattggagttgactaaattgtgaaaatatctgattttttaaattcattgtgtacaagagtgcccccaccccgccccttctcttccccatgcccctcctataattaacctacacatcagcatataataccagtacccaatgcagtcacgatggcaaccgatagcaagaatacttatggctgtgtacaattcagatacaactgtttaaattccatttggctgagtactgtggctcactccggtaatcccagcactttgggaggccgagttgaggggatcgcttgagcccaggagtttgagaccagcctaggcaatataatgagaccctgcctctgccaaaagttttttaaaaacttaggcaggcacagtggtacacacctggagtcccagctactttgggaggctgaggtgggaggatcccttgagcccgggaagtcgaggctgcagtgagccatgatgatgccactgccactgcactccagcctgggtgacagactgagacactgtctcaaaaaaagaaaaaaaaaaaaacctcaaattgtaatttctctaaatattttcaaaaatagctgcatggaaaaaattagctctgtgcccacccttctctcctgtggctctgtggggtccacttctcaagtgacagcttcataggcttcccagaggttcaggtggcaaagaaccttgggtgatgttttgccagctggaaaccaaatcaagtcaggacaactggagatcaggccaccagctgagaagtgtgggactggaaaagtcaaacctagcaggcaatatttaaattcaaaattgagtatatgtggtcacagcctctctaagcctcagtttctccctgtctttcctttactaagaatgaatcctaccctctgctaatcccacacatcacccaccacaaggatgattttggtttttcagtaaaacaaaagcagaggggggatgggagcagatcctaaacgtttcagaatggtgttcacactattctctcttagactcatggtacctctgcacacagcctctctttgtaaggctgaacaaacagaagcaagcaaccaagcaagcagaaagatattgcagccccaaaaagtaaaaaataaaaaagatgaggataatcacaagaaatattttcctatgagatagatttaccaaaaggaaaaaagaaagaaaatgtctgggaaatgtcgtttttcagtaagattcaagaggacttttttctgaaaaaaatcaaagtaaacagcatctcaaaagcaggggtcagcaaacttttccattaaaaggctagggaagaaatatgcttggctttgaggccacatggtctctgtacaacaaggcttccctaaatagaaacaatatgtaaatgagggagtgggactgaatctggcctcttcctctgatccagagggaaggagctgccctcaggtaaggttgcatgaatggctgaagttaaaacctcactataagaagcaggaagtataatgcaaaaaagaaagtgacagacgcacttgaaaagctttctcagaaataagatgacagtgaggaaaacaaaataagatctggaccacaaaaccagacaccccagtatgtacatacaaggagccctccaaagagaaaacatcacagagcagacatcttgatgagaatgataataataatagtgataataaaagcctttcctgcattgaaaactggaggctatagattaaaagaacatatttaaatccaagggaaaagaaatcaagtcaacacacatccatatcctaataaatgtttctgatgtgtggagaaaattctataaaccttcagacaaagtaaatgaagagattacctacaaaggaatcaaaatccaacgggcctcaggctcccctcctgtattcattgctctaagacagcggagtcatttcaacaactttgagggaaagaaaaatactcagtcaagtctccatttacatttaaggttgacataataacagtctcaggtatccaagggcttaaatattattcccttcatgggggaaaaacaaagtcttaatggcaaatgccgatctactaggggacaaatcaaaattaagaaaccacaggtggaaaatttacaatgttgcagatctatgagcaatgaaaagctattaaagttgtccaaatacttagtataatttcaattataacatagtagaaacgtcaaaaacagtgtttgaaagggatgaatccatgttgaaattatcataatgtaaaaataatacaggtcttaaaacctagatcatattaataaaaattggaagtagggggaggagaaggactaaaatcatactgtttaattcttaacttcgatgctttagggaatgtgggtttaaatgtgctttcaaaaacttaagggtaaccactattaggttaaaataggatgaatactttccaaatcaccaaaagggaggaaagcagagaaagtccaacccacatagcataattaacaagtgataaaaaggaaataggaagtaaatgcatcaaaaagaaaaccaggaagcttaaagacaaaaaacagaaaaacaaggattgtgctatgaaatattaggctgccactaaaaaccatgtttgaagggtacttaatcacacaggggaatgttcacaataaaaagtagagatgaaaacataatatgtacatatatatactctcaactttgtctgtatttaaggttcatagagaaaaaggcatagggatatactcaagtatcttcttttatttaaaaaaaaataattattattattttgtacagacagggtctcactatgttgcccaggctggcctctaattcctggcctcaggtgatcctcccacctcaacctcccaagtctttggtattcacaggcatgagccaccacgcccagcattaataattttttgaagatgatagaatttcaggttattttttttcttgtttattcttgttttatattttccacaaataacacacatttctataattttttttttttttttttttttttgtgagggggaccgagttttgctctttccacccaggctggagtacaatggtgcaatcttggctcactgcaacctctgcctgtcaggttcaagtgattctcctgcctcagcctcccgagtagctgagattacaggcacacaacaccgtgcccagctaacttctatatttttagtagaaacggggtttcaccatgttggccaggttggtctctaacttctgacctcaagtgatccaccccccttcagcctctcaaagtgctaggattacaggcgtgagccatcgcgcccagcctgtaataattcttaaaaacaatcaacattataaaaaataaaaattgtagggtaccatgaaaccaagctgattgttcttcccaggggaggaggaagggccagagaggatttggaaggtattatccagcacaggttaggtttgatcagtcagtggatgctgctgggttggaaactggattttccatctaccagtgcacactcagccctcagtattcttagagcacatgaggaaaaaaaatcactattaagctttaatttccagagcccttactgtgtgctttgtgcaatgtactttattctcacaacaacccagagatgtaagtatttttagcccatttgacagatgaggaaattgatgccagagaggataagagacttgcttaaggttacatagatgggaaggcaagctgccagggttagaaaccagcccgtttgttgaatccctaataataatgtgtccccttccttctggaagttaggcagaacttgtgtggacttcactgctattattttttaatctgctcattcttccctctggcttacggggacacaccatgagggccactgtctcttactttcagctggactatgaatccacatgcccctgattctttcacaaagatgctgcaagccacccctcacaagggcttcctgagcagacatcttattccttccagtccagcatcagtggataaaacagaactaaattcatcgctattccacccaccccaacttccttccttcataaactagccacagagcagaggcccaggagcctgtccaatacatctcagggtcccaagtacttctccccacaccagcctaggaaaccagggctggctgtcagcaaaatgaataaaattcctatgtttgcctaaaaggcaggggaggggagtggagagcttacctctgaattgcaatgttactaggacacagtttgctgtaataataccaattaacatttctccccacttaatagtttctagtacaggataaaaatagcaatacacgtggtgctgagatgcgaaaaataacaatggaaatctgctctggaagagtcctgctctgtctcaccagggaagggtgaggaggtaagtgggaatattaggggagattcaggagggagctgcagagaacctgctagaaattaagagtctgccattgtcttacttctcttctgtcctcagtcaccagctataccaccagaaggcccctgtggcatggcgagatgccgtccggcttggaatgagaagagttgattgctgggtctccactctggcactaaccagttttgtgaccttgcctgagtcagggaacctctttaacctgattccttatctgtaaagtaagactctcagcacctgcatctcaggtgggtgtgcatcgaaatacagtgaaagggctttgcaaaatatgtggaatatgtgaaaaatgtgtcaaaatgctttgcaaaatatgtgaaagggctttgcaaaatgtaacccgagattcacatgtgagggtaggtccctaagaatctgtagtagtgatgcaggtggcacttgccaatacaacaacctttattgatcaacaaaacgaaaattaccaggagttagtccctcccctcagcaggactaaaggatgccagtggtgtaggcattctatggcgcaagctcagcggacctacccttcaaggaccagcacctgtctacaaaaagattcctcagatggaaacagctcttcctaaggacgagtgtggcctggccagaagcccattttcctcaaagctctgatatatttggctaggagagaggatgcccagtcatgctggagaaatttcctggaggctggcttctcttcaatggctgtcactcagagcctgacccagccccggggagcccaggtgccatctatggggagggtgaatgatgaggcactggaagtttccctccctcctttcattccctccaccacttgcatcccccactccccagacctcaccccaacaactggacacacagcccatagatagggtgatttcacgattcagtctagacccccccaccaggcagtgtggaggctggggcctctagttgtgctgcattgggtcccctgagctcccccgaggtgtcctaggagtctttggggaacactgggaaaactgagagggaagctctgaaaccacttcgtacccaccaacatacaccctcaacctgaaatgatttttaccagtttaatgtttggcttccacataagattttatacaaagaaaaggttctgtctctaaactctaaaaagttttacaatctttgttcctggggcttataagaatccagggaaaggggaccttaccttggtccttggattggagtgaagtcacctaaggacccatccaaataacgaccatgttttattcctagtgggaaaatgtagtccaacagtaacaccatccaaaatctctctgggcatgtggctaccacacctaagtacaaggaattttctgtttcttggaaaaagcccttcgtcctctcccatgtgctgtcatcccaggatcatggggcctgggaatgtcagttcgggccagatgagttcaagtgagcaatgtgttatcacaaacttggaaggggagacaggaagcaggtttggtgggaaggaaagaaagcagaaagacccagaggagaccacttttcctgcagagctggaggagagagggactggaagagcccacagagacccatctgtgtttttcaaaacgcatttttagaaaaagaggaggctagggaaacagagacacctgcttagagccagagaacattcccttcgaagggattcaaaagcacatgggcaacacaagccactgtgccaggtacccacgcaggtcaggggcctggtctcaacttgggaaacatcaagaggccagcaagctgaagcccctcagctcagcttctcccctcagagacgaagaagctggaagccatcagccagctaggcagaaaggggtcatctatcattgcttggctctgaaagatcttagagcaagaaggatccaagagagagggccagtgtgaaagggggaaatatgcaggagggacaatgtctgacattttttggaggctgtaggtctcgggcaggagttgtggctgaccacactcagctcagcctgagcccaacagggcatgatgaggacccgtatgggctctggagccaggagtcaggccctgcattcaaatcctgcctccagagcctgagacatgtggccttgggttagctctttatcctgtccggacctcagtttccttgagcgtccttagcaacgataagcatatctactttgtagggctgttctgagggttgaaagagttagcagatgtaaatcacgcagagcagcatccacacttggtaagcctgcagtcagtgttggctggagctgctgtggggaaacccccttcacgctgagccccattgggtccagccctcccaagatgcaaggatggaggtgggtggatgaagttcccctggtggcagtgggatgtgaacagcacccccacagcaattctctttatgtgtaaccccctccctcgggggcagtctctccacttccatcttttctttttctcttctctctccattttcctccttttttaactttttaatcactttctaagttctccccctgtgttcttttagcagatttgcagagccatctatcaagaagcttaaataatgaaggaccatagttgcaattgcctgttcacaggctcttgggctttctgggtgattagaggagactcctgctgggggaagctgcctgactagaatgttttctaacctcttagagaagctcccatggctgctatgccttagctgccctccatgatcattagcgactccctaagcagcccggtcaggtaaactgcacactacttgctccacacatggaaaagcctcagagggactgagaagtcactggtgggatggggactgagagtccacagcccctgaggctgcctgtctcccaattcatcaagtcacaaaataagatgaggagctcctagcccacctctctggggtcatctccacagctctgcagagtggctggtcttggggccaaaagaggtgcgagggtaattgacctatattggggggtgagtttgcattatttttccagagctgagtccgtcacagtccctcacagccaaggtgacccattaggcaagagctcagggttccgcctgagaccgtgggccagaggtatttgctgtccccctgcaggggacccgtgaaagaccttggccttgttactatactgcttcatacaacttgatcgtcccatcctaggctctgaaaactggtctgctcaccaatggtactcaccaaaaacttctttgaagatcccacctctcagctgggcatcatgtcccagtgcatgtcctaagcacatcctgtgccaagcacattttctggtcttcagttcaaaggtgggaaattaacacacagagagagggcaaagtaactgccaaagatcacaaaattaaaagacgttgaacctagggacccagactcccagcctattcccatgatggcccaagagaatattcccataggtggtatgggagtaagttgtttcggtctttctaatacttcaaataacctcattattcaggatggtggtgtccaagtggtgaaacagaccatccctggatggcagcactaccgaggaacacacttcttggctgtgggatccttttgctggctcactttggaatgccaacatgttccaaatctctccaacttaatgaaacacctgtcccctctaatgccatcagcagtaactgcacatggctctcacacttgcacacacatgcacacagctccagctggctcactgggtggttccttgggtacatctggctgcactcctcaatccatcctggtgtgaccgagttggaataaaccccccagtccttagctctctggaataagagaaagttttacaaaaaaaccctgtaatctggtatcaactgggcctaagataagcctcaagtaattacaacagagatagacaaatcgtacattcaaactgccaaggctttaaatgacacacacacacatacacacaaacacacatacacacacagacagatggtattgttgaaaacttaaaatataattcatatttacaggacatgatttagaaattgtccccagttactattttgtaaattggtgcttatacatatgccgtatgtattctatatcaataatttttcctaataatgttattaccttgcacactcaatcccagtgaaccctgaaggaaaaaattctcatctcaagaatccaaagagctgaggtcaggtggggaagtcttagccttatggtgaaaaactagaacaggcagtcgaaggggcaggcaatgcttctatcgtccctttttagaacactgctctgtggccctctcactcttcctgcagatgtaggagtagaatgagatgaggagaaagagagaagaatgctttgaaataagttatccaaaatggcagacaggtcctcctccacttttccaggaacacctccctcccttcaacacacacaatatgcacacgcacacacacacacacacacacaatacacacacacaatatttatgcacgactgttacatacacacatttgaggagagaaggaattatgtaacacatcagctgttcattttcacaggcccacttgaaatggagctcaatcttataagtatagaagtctggggtgagcgtctaggaatttcaacaggcactgagaaaatgcccactctgaagcacagaacatggcctgtggaatgctcgaaagcttccagcctggagggcgacctgagatgttagtaccaagggcttcctctccagagcctcagtctccacatatccctcagactaacccctacagagctgggtatctcgtagggaaactaaattgagctcggaaatgcacaccaaccaaaaaaaaaaaaaaaaaaaagaaagaaagaaagaaaaaaaaaagaaaaaagtattttagatccaaaagggagcagtggcacaatgtcacgatgtaatacaagggcatgggttttggagtctgtggatgaagaaatgccttacctccctaagtttctttagggtaaattggagcaaaaatcctcaccttgcagggttgctgtgagggccttagaccatacatgtgtaaagcattgatagcacaaagttcaccatggagtagttgctcactgttttctcattttccattccctctcttcctctccccagccctgactgattggaagtcatttccgctttttcagcagacccagcctcagctgatgattcacctggttgctggaagtgagttctgtttctcaaccctgggattgaagactgactttcaataatttgattgtggagttcttagccttcctgaaacagggctccatttggatgctttgcaaagccaagcagagaacatgtccttccagtgagaaagtagcccatgggtcttcattccaatatacctctgtggtttctcaatgcattcgtccattctaatttttctgtctacctaaaatctccaagaatagaaagaccactttttccttatttgatcatcacatactgcctaaaatcacatcttgctcaacagtaactgttaagcggaagatggcagtagtgccaggaaattatcagaggaaaacagaaacaaaacacaacataagcctggtcagtcacagtttcccttgatcagtaaacaaccaaggtcggtggtgactcccctttgggagagaggacaccatttgccactgtcacaactggccctgtatactgtcgggttcagtggcagatcttctcattgggttctaatagctgctccacatgccagagccaccaaaagcctctctgccttgtccagttaagacaaagatgaacttctcaaaagttttttatgcccaaagctcttccaaaaccaaggggaagaaactctgtatataatgaaacctcaaataaagtcaatgacactgagaagtttacagagggctcctctcaataaatatccaagagggagagctgacagttgtcttgaccagtagagttcactgggctcagaaacaagggggggcctgtcctcaccccatctggcttggatcagaggacctgaagtgctctagttgggaatgatggcaaagtttggtgggattgtcagtctttgtaaaaactttctcaccttctctttggatgtgggcctctcagtagacctatctggtcccaaaatgccatcccccaaacttcacacctatccccaatcagttttgcagatgttttagaggaatctccacttgtataggtagaatcatgccccctccccaaagatgtccacatcctaatcctcagaacttgcgaataggttacctaacatggcaaaagggacttggaagatatcatgaagttaagaaccttgaaaaagagagatgagcctggactatccaggtaggcacactcatatcacatgagtccttaaaagcagagaacttttcccagccttggtcagagggagggagacttgactatgaaagaaaggccaaaaacatgtatcactgctggctttgaagacggaggaagagaactgtagctgaggaatgtgggtggcctttagaagctgaaaaagacaggaaatagattatctcctagaacctccaaaaagggatgagctcctggaaaggcatgaagacctgccagtgcctggattagcccagtgagacccatgtcagatttttgacctatagaactgtgacatagcttggatatgagtccccgcccaaatctcaagttgaattgtaatcctcagtattggaggtggggccttggggggtgtgattaaatcatggggtggatttctcattaatggtttagtaccatccgcttggtgcggtttttgtgatagtgagagagttctctcgagattttgttgtttaaaggtgtgtggcacctcccccatctcttgctgctgccttatctatgtgacgtgcctgctctcgattcgccttctgccatgactgtaagcttcctgaggcgtgcccagagccaagcagatatacaccctgtaggaccatgagccaattacacctcttttctttataaagtatccagcctcaggtatttctttatagcaatgcaagaacggtgtaatacaaatagaccgttgtgtgtgttgtgtgaagttggtaaatttgtggtcatttgtgacaacagcattaggaatggaatacactgcccgttcctggtgaggtgcccctcttccttcatcccttcatggcccaacttctctgaaagtgctgctggctgagtcctcccatgggggcacctcacctgttactcccagcgatcaccttggccctgctcctcatcagtctccttgccaggacagcagcagcagcctgttctctcctctctccagtttcaaatggccctggttccttaaagggccttctagatcttgtttctaatccctgggaccgtttgagttccaaacatcacttgtcagaaggatagaccacagatgccttggagtgggaggaggaggaggggcgctctttcaaactctggttcccccttcacccacttccccacatatggacttgtaaaacaccagccacctcgctttccataccaaacaacagtacacgcaagaacaaacaagcagggccacggcctttcttactggaaccaggtatgctttctggcttgtttgttttctcagaatttaaaaatacatcgagtgtgctttattgaactgcccaaaaagggacacacctgcagcacctcataaacttgtttgatcaaacaaacaaaagccaaaacacttttctgatggagtatttctcggaacttgtactctgcagaaaacactctgtaaagtttgcttgtaaccacgctccattatcgtctacaagcctcagaagtctgaggaatctgagcccaccctgacctttctttccgattcaatctgcatacttgctttttgatcatgaaaataaaaaaattttgccctgatacttttttccccatatcttcatttatttttcttggggcctagcaaggtcttttggcaagaaaatccagatcttttctcgctcagaaatattttccttattggatttggcttgtttcttaacttgctctggtcagttgcacaagagcatcaattatctatattttgctggattcttcatatctaccatggcttcccttatgattatcatatttttaattccctccttgggcacaaatgcaaatctttagaacaaggaaactgggagctgaaaagagagaggtaagaatttcagaggaagaaggaagcctctctcaacagacagcagcaggggcaatggcaggagccagggcagtgcacgggacacacccccagccgaccgcctcccaagcctgctggggctatggaacccaattccaggctgtcagcagagacaaatttagcaccgatgatctcatcttgcagaacagccccagggctcagggaaacatcactggaaaagctgggaagtggacgtcactgctagtcccataatgtaggtgaaaggcacagggcccctctctcagctcactaaaagggagcaccaagaccacaaggagcaggtacaggtgatggtgagggcgtggccagcggggaacaggctggggggtctggggcattactagcctgctctcctcagagtccccacaaccccaagcacagtgagctgaagttccaggacaggtccacagatacggacacacttcgtttgagatgagtgacaaacagtactaaacattatcattgtggagttacagcttctcctgtcaggcccacatcaggatgttacgtggcagagtatttacaaatgcagcagcaggcagaaggtagagagagtgggggcacattccctcttatttactgaaaataagaccaaatccctgcaaaggggggcaaggatcccttgtctcttgcagtgagtcagtggcagaaaaagatgagaacttgtcaccaggtgcaaaccccaaatcttgccactggctcaagctacctctgcatggctctgaagttggtttttctggcttccttagccggacacttttgctggtcagtttccctgcagtttcttagtgtgtctggtggtcagattctccctcctgttcctggagcaaagaggcctcagcggctcccccagtgtttcccaaaagcagtcccaggagggcagtggcggcaggtcctttgctgggatggggacccctgtctcctgcttctgtagctaatggacagcatcccatgaacctttgtgaagaaggaaggtatgaaaataactaagaaaagcagacttgacacctctcacaaagaaataaatacatttctaaatgtcaaataaacataggtacttacagaaggcaagaccctccaaaaagagtggttcgtatcacactgctaatggggatggatagtgatggcaaataaatattgtcacgttaaaaaggccaggtttatattcaagcacaccagggccactcctgtgtcagtttcagtcatattagagaagatcagctccctgagaacaagggctaggaagctaataaattccatactgggaagtgccatgggaacgtaatgaggggttatcagagaaattagaatgtgcaagactccgtctcaaacaagaaaaaaaaaaagaaattaaaatgtactgagaatttggggtggccaccaaaataaaacctctcccacccaagacagcatgaacattattgtggttaaaggaaagaaagttcaacaagcaacttagaacagaactgacagcatctcttcaagtgaagacttcagagaaagctgcaaacagaaatgacaaaaaacaaaacaaaacaaaacaaaacaaaaaaaaacagggcaataaacacctagaaggcggcattagggctgtgcagcagagcccaaatgcaaaggcagcattagcagtggaagcaaagaatccttacggggtcagacccacagggctgagccaagatcagatctctctgtctcacacacacacacacacacacacacacacacacacacacacacatgcacacaccagctgcagcactagggcgtttgggaaagacacaaaattagtttagattgtaaaacatttatcctgtagaggcaacgtgagatttttttctgtagttcttttaattaaaagtgagctcataaatcaaagcccctgtttccagcctgcaggaggtagtaggagtgaacctaagccttgcagagctgagcctgccccgcccatcctgctttccatcacccaggttattcaccccaattacaacaccgcacatgttacagggactcagtgagtagccaagggtggctctgatgaattacatctcactttcttcactggggtctccgaagttctcccaaagagatattgagcacatgtacacacacacacacacgcgcgcgcacgcacacacacacaattaaatcctatcagaactggttagtgcatctatttggagcatctgctgtttcccctgcagagccccacctctggagaccttcccctcctctgcatttctaccttgcctgggctcacatggctgtttgcatttgtgagtctgaagactcttcttagaagttttttaaacacagaaagtcttatggatccttgccatcttcttaatttgttttaattttttcctcctgggtgaattaaagaatgttctacagacatgaagtctcactaccctcagctcattcataagagagatggagggagggtgcatacattaatatgctcattactccaaaggtgacatacgtgtggataaagaatttgtcccaaaccagaagtgcagccagaaacaaagttaagatttcctggatgtcggttccaagattttaagccacacccaggcctggctcttaacaatttagagggatggctggccccagacacagaccagggcagacacctgggcatgaagattgcaggagtcctaggagcagtagtgggaggcagcagggtggcccacagtagctcccgttgcccctcccagccctccttgggattgacagaatggttgccgtgaccagcggaggaagcacattgatttcccattttcaagctgccccccagctccaagcatcttagagctctttatgtgcccatactcacatgtgttcacagttttagtgggaaatgaggacaaagaaacggaaccccctctaagagagaaaatgttagagatagagatgaacttcatttcagcttcctgcccggtatctacccttgatgccaggaaccgctctgtcactgcatcccccaatcccactgcttccttctgcccctgcccccgcacagaacaagaatccagacaaaagcacaggtcaagggagaaataaaggtcccccttcccctgacccaactccctcagaaacaatcagattcaaggcagagagattaaattatcactaagctaattatgggactcacacttaggctggctgccgggaagcgaggtcagcaagcaagagacattaacatgcaaattgaaggcagatgcaaggagcacttaaaaaaaagcaaccgggagactgattccccccacacccagaggagaaagaagccactctggtggttgaggcactgtccatctgggcaatggtcagggcatttgacagctaaatagctctactctgtcatcatcctgaagccaaagtgggcgagtcagaggtaaactgattaggtggtgtgccgctaatctcccagagagaacatgagggaggtggatgcaaggcagagcccagcgggagcagccccaggcttgagtgcagagaaggctctgccggttcctatgcttgcatgtgtgggtgcctccctgtgcgtgggtgaacacaggtgtgtgtgtcagctgggtgtttgtgcatgtttatgactatggatgtgtgtatggagaggggatacagaatcaggcatgtgtgagtatatcttatccacctgaaaatagaaggtgaagagcttagacagaatcaaagtgcccctcctagcataatagccaccgggcaactccttaagagctttctgagattgttaaggcccctgcaattgctgtcaccagctcagccatgaaaatacatattatggtacccagttatggatgactgatgcttccccaggcatcatcaatatgatgcgagtttaagacatgttggccaaaaacttggcagtctacaaaatgactttgagagataaaaatcaatgtttttcaatgcaatctgcaggatagcttcctccactcaggattctgactctgcaagtctcttgccttttccagagaggagcaggttggcagggaaccctgatacggaggcatgtgagcttgttttaagtcagtagacagctttgggttccttgtcctgagaaatggaatttaatgggcaatatcctgcctgtgtccagagtgaatttttggaacccatggttggcaaggggggttcagaggggaagtgggggaatctctggagcttaaattacttagggaaaattaatttggaaactttatttaattataggtaaaagaaatgcttccataaatttgggtaatttaattatccaagagacatctgctgaacacaatctaatcattgtatttaagtagaaaagtgccctcactcttaacaaaactaattttggggagatacaaacattcagagcctgactaatgaaagaaaaggaataatttcagtttcagttttaggaggaaaaaagtaaatcacaggaaaatcatctgagagaggatttagttttttaaaaatcttcaacattatatctggggttgatgatataaaatcagccatatcctatattttttgcacatcttctccaatactaagcaaagaagagatcacaagctctttaagtcaagaagtgcctagcgcattttagatgaccaagaagatagttcttgactgaatgttgatgttcacaaaaataaaccttatgataaactgtatggacagaattatccacaaaatattcattgcccttctctcccacctccctgcatacatacacaccagccccctccccaggctccaggcagggttatattttccacaccattcactttggctgggccaaaaaaatgggagtgggccaccaccaagcagtagctttaacaaccacggcacggttctgccatctctcttttcctttggccatgagatcaacatgtcccagacaggggctgcccttccaagtctcccagataaataacatggagcagggctgcagccagcccagggtgcacatgaacgtgagttgaaaatagccttcgttattgttgttgtaagccacctaaacttgggggtcatttgttactgcaacataatgtagtctaagctagctgatacacacacacatgcacacaggcactagaagaccctaagccccagtggtccatcttcaaatacatttttttattcagcatttgttaccttcgggcagtactgtgggggcaccttcagtttaattggaagaaggtataaacacactggggaaatagatccagctatattaatgaactgtattttctatgtgaagaaaatgaacaaattcctttcagaaaaacatctcagctacaatgttgaaagcttctattgcctataattttggggtaatcaaaatgtggctaaataaaaaccaaatttataaaatggatacattatgaggctattaattttagaaaataattctccattttagaaagagattcattagtttcctacaatgaatccacatttcctacccaaaaagagataaagaagcccacagcctggttgaggcagggaagccatcagtactatcagcatccctccagccatggcccttcctaggtcacagagcctctagggtccccagctgccacactagctctacttaaggtcaacattgtacaagttcaggcccacctagggcataagccaacactgcctaactaaacctccctggatctaagaaagactcattctctaagtgaggtttaagatgtatctttctctcccaagtctggtgtgtctgggaaaagacccagaacaactttgatcataaagatgaaataaaataaaatattccaggtatgctaacctgatgcattgaaaatatggttataattacatgcaacatttaaaaaaatatgtttactcatcacaagtgatacttgtagtagaggaatcctgtctgagacagaaaatcatggataagttttatgctctgtgggggaaggaagaacaaaagggacagagctgaattatcactggaggaaatgttggtctgttgcagaaagaccaatgtaaagaatgtattgacttatagatttttaaaggtagactgaagatatctaatcattttcattattataaaaaaccacgatgtatataaggcacccatatatgatcttaggtagaatcctgcctagaggccaaaatggcaatttgtatctgagactcccatgggaatacctggaacacagtaggattttgtttaagttttggatgcaatgatgagggcaggtcgtcaggtggcttcaacatcattctggcctctcaggtccaacaatacctgggaacactcagatttagccacctccagccccagaatactcatatcttggtggggaggtaaaagtggttaagcagaaagacaacccatctctttccttccaacctccttgccaccaaagcctcagaagccttctccagcaggggagaaactttttggaaggcagctcaaaaaagtctcatggccagacatggtagctcatacctgtaatctcagaattttgggaggccgaggtgggaggattgcttgaggtcaggagtttaagaccagcctggacaacgtagcaagaccccatctctataaaaaatgttaaaaattagtggagcatggtgacacatacctgtagtcccaggtacttcggcgactgagacaggtggatcgctagaacccagaagtttgaggctgtcatgagttaggatagcaccacttcactttggcctgggtgacagagcaagaccctatctctttgggaaaaaaaaaaaaaaattcccaaaaggaaaactgggactaggtgaggcactgggagtgtcagagggcagccccaaggaagggagagcctgtgaggtggggtaaaaccccaaaccaacacccatttctcacagatgcaacccttggagagcctttcctaaaaggactcaaaagggaaacccaggaagccaacaaaatagagctgggtccccatgcagctgtgccataacacagggcaaggggaatacggccttccacccgcaccttagtgagcccgggaccccacaatgagcaagggagagaatgccgcccggcagtgggtgtccaggagtggttttggggggaagaggattgctctttgtagattctttgcattcttttattaaccatttttttgggatagggtctcactctgttgcccaggctggggtgcaatggcacgatctcggctcactgcaacctctgcctcctgggttcaagcgattctcctgcctcagcctctggagtagctgggactacaggcatgtaccatcattcccagctaattttgtttatttttatattttagtagagacagggttttgccatgttgcccaggctggtctgaaatccctggcctcaagtgatccaccctcctcggcctcccaaagtactgagattacaggcatgagccactgcgcctggcctctttgcatttttttaaaaagaggtttgactatataaagaactatgtacacttctgaagtagtctccctaacctcccattcaatcatactattaccccaagtccccatatctataaagaaatagcaaagccaacacggcctcaggccttcctaactccacatcatcctgagcaaattaattggtcaagataacatttgtgagcacaccttcactaagttaaaagtacaatactacagagcgacaggaaggaaaaggtaagaatggagggggtgaaagtgaggaaagtaggcaaaggattgtgagaagagccgagaagctcaggtttgggggatagacactcagaaggaaaaagaaggttggatgtgctggtggtgacaagtgctccaggtgactgggagtcacaaggagactggctaattaggccctccattccagagcacttgcaaagcaataatgacccgtgattaggaagaagctgtcatcctccaaatgggtcaagacagggaccgtggataacccgtcacaggaaaaatcacccagaaccacagcacacagtcccacaggctctaggagggacaattccggtgagaaaccaagacaaagatgggcccagtctgtcacaggaaaaatcacccagaaccacagcacacagtcccacaggctctaggagggacaattccggtgagaaaccaagacaaagatgggcccagtctgtcccaggcagcaggccaggggtaagtggaaaagcacagctcggctgcctcctggaaaacctcctcccctccctgtggccacctcccactcggccacgggatccaagctccagcataattgctctcagaaggaaattgcccgtggaggcaggttggtgatgtgagagcagccatggaggcaggagtcccgtcgtttctaaggtgggagcctcttccttggtatttaaatttagccagggcccttgaggactcgaaatgtgaaggccgaggcagccagctgaggctgaatggctgagccagggacctgagtcctcagcatgtcaggtccacttccatgcaagcaaagctacaggcaaggggctgcagaagggtggatgagacaagtccagttttgtttttcttggtgacaagggtgagaggattagaactgctttaggaagctgaatctgccatctaggatccatccaaactgattttcctgtccctaaagtgctcccctctttaatccatcccaggaagatggattaaagaggggaaaatcagtttcaaccgccctagcatggacatcagggcctgagacagggcagagacagaacagagggaatgaaaggagggttctgagcaacaggctccagggtaggtaccagaggtccagccaccacctcctccctccatcagggaggtgacctaccctacagcccaggagccaggccttaggtagagtctgtgatattactcgatacgggtcccaggacaacctcggattagaccgtgtgacctctggggagttacccaaccccttttctcctgggtaaaatggaaggtgtaacatttaccccacccccaaaaaaaaacattgaggattacatgtgacaatcaatgtaagtaacatgtgaaaacatctagaacaatcctggtgcctacacggtgttcaaagctcagtagttccctctgcaccacctcttttctgccagccccaaacactaaggaaacgaccccttcctaagatgctgggtgcctccccacagaggccaaaggcagaagatatggattctccatggccacacagagttctcggcagctactgattcaaaatctaagcatctcttgtccatcatcgagcactgccctctctccagatgaacggagcacctgggactgcctgctgagcccccaggcctccttgttgaggaagtttcctcacccctggtcctgtgggtgtggcgactgcttcacagcctcctgtttatcctctggattctctactgtgtttgcacaatcaaagccacaagccaaaagacaggattcagtgcctgggccactggtgttcctgaggaaggccgtgtccttttccacactactaaaaatgaacttgaagtttgaaagtatgggttcaagtcccctcaatggctgagaaacaaagccctcatgtagaaggcagcctccaacatagcccccagtgatccccacctctgggtattcatgacctacagagtcccttcctggagtgtgagctggacccactagctggcttctaagacataatacagcaaaggggatggggtgtcacttctgaaaccaggtttcaaaaagacaatggcttgcaccttgctcagcctctttctcgcccccatctctcagacatcgttctagagaagcctgctgctgcactccttgttgtgcacgtggcctcatggaggggcccacatggcaatgtagggatctctcaagtgaggacctgaggcttgccaacaaacccgggagtgacattggaggtagactcttccccattctggtctttagcagtgggatgactgcagccccagccaataccatgaccctaagccggaggacccagctgagccatgcccagattccagaaccacagaaactgtatgtatgataataagtgttgttcaaagcctctaagttctggagtagttcacggcaatcgataactaatacacctgtgtctcctgggccaggagagaaggtatggagtgagtgtgggagcttcgagaaactttttttttttttttgagatggagtctcactctattgcccaggctggagtgcaatggtgcgatctcagctcactgcaacctccgcctcctgggttcaagagattctcctgcctcagcgtcctgagtagctgggattacaggtgtgcaccatcatgcccggctaatttttgtatttttagtaaaggcagggttttaccacgttggtcatgctggtcttgaactcctgacctcatgatctgtgtgcctcagcctcccaaagtgctgggattacaggggtgagccaccgcgcccggccgagagacctcttttaaaaagtcaccatggatgcttctatgagaagccagaactgctgcgaaaagcagcaccatgacatcatcaataagcaagcccagtggacacattcccaggaagttccctaagaacaagtatggactttcagcagaccccaaatcagaacatcaactcatgggctgtgaattggtccaactgccactgccttccccatcagagtggctgaggaaatcatagcaattgccggtaacaaagacctcccctggctctaccctcgctaggagtcttcactggtattgacatcaagattctattctcctatccagagtctagcaggtgtgagcccagcagtaaaaggaccacttatggttgggggctcattccctcttcttgcctctgcctcctccctcttcctctgtacatcatgtctttcatcctttcccatctttgttgtcttggttacatggccagactcctaatatgctgctagttttcattttaatgatatgtttttgtaaagcacaatattttacttcaattgcatgtgtcactggataaattcctctagtgcgtctgacatttgtgtatcagctgactgaatgcgctctatgatttggggtgtttgtgcagcactttcttcaattttaatgtgtttgcattttaatttatgatcaggatctttctataccaatgtgtgtatatatacacacatatgattcaaaaaagtggcacacgtatcaataaatcttgaattggcaaagctcatttaagactatctctttaaatcatgtgcactagcaatgatcacttggaaaacagaatgacaagtgttcctgagaaactctttgctgggatttcaatgtgtgtttcaggaggaagtcaggaggagaatgcaacaatgcctagctattggctgcagtagaaatttcacgatgagaacacctccccgggtttattcaggtcagcaaggagggaccacttgagatcccccagggatgtgcagggaaggtgggtgggcccaagggcagaatagtgagaaatggaaaaagataagaaaagagggccagtgtggccacacttacatcaaaagggtgattgagtgagggcttaatagtgttcaagaatataaaatatgtccaagaggatatcaaccagcttagttgctcttttagtcaactgagtaaaacttgggaagaaagcttaaaacatagcagaagagattgaaacaaggtgggaggaaggcccatgagaagtggatacattggtctgaggcaagatcagtctgaagggccagtcttagaattcccaggctggaaagactaacgacagaatgccgtctgtctgtggttgaacgtgaaatcagaggagggagggtggcacgctggcacacctgtgggatcttctgcctggagcccttcaacctcagcctccccttcacacaacccacagggtaaggtctatgcaggtttaatatttgcaaaaccagggatggaaaatgcagacacaatatagcaaatagagggtcttttcctgtcatggaaatcggtcagccctgatgcttctgcatttctttccctttgtgcttgtgatcaatcacacatgaacccatggcagcttgggctggagaaacatatagcacaacagaactacctgaccgaaccctgtatcaaatacatatgccctctgccctaaccacatgttcctagtctatttggtgttccaacattgtatctccatttgatttcctgacacttccatccatctgcagggctttctgtgctatgaatatttatttttagttaaagtggattcaaatttccagagtaattttaggaagaattcccaggtacatttaggaagcaacaaagcagaggctggactctctgatctgatattgctttgtgacttgagcactgaagatacacacacagcatctgttcctgagaagcaatgttcgccccaggtgggtctccctccactccaatccactcctgggtgattcccccttgtggacctgtgccgaaggactagggaacaaaagcaaattaattttaaaacaggcttgagaaaaaaaaattaggaagattaaattaatctacatgacaattcccaataagaatggtttttgtactatatactcctattgcctcttcatgggaatgtgcacccagtacctattcagagaggctggtatggattagtctgtgcacagacacatggatgcatgtcccgcaacaggctaatagcagggccagccagagttccgcttaaccaacatccatacagcgctccacccccttaggtgtgaacagtttaacctagcaaaaacatccagggaagacgcaatcaccagcgagaggagcaatcacacctcaagtggaagtttatgatgttttggttcacaatgaacattagtctctcccactaatgtcaggcagtaattcaccactgaacagcagccataaaaatgatcgcttagtgaaaggaaagcaagaggcagagaaagcaagagagggaaaagattccagcagaaatattcaagcaaagaaatctcgtgcttctgagacaacactgagctgattgtcccaactcaagccaaagatttaggtttgcttggccctaaagccagtcaagatggcatttgccttatgatttttacctatagtggaaatgttaacagtctgtaggttattgctaagttcctagacacctgcttatgactgtagtatttataggtcatatttcttaacacacatacccttaaagctcaccacaggaagaggctgccaataccatctgcaacacacacacatcagaaaacatcaaagacatctaaattggcactttcctcacctcctttccccccgcttcatgtgacgtgtgcactaaaggagtgaaattacggtcgtcaaagacaaggttgcaaatgattgggactcatgcctttcaagcaaaataaaaagtaattttgagagcagcccacggatagctcggtctagctcctggacccctgaaacccacagcaaacacccttactcttagcatccccccaagctctctcctgcccacctacccccatttccagtctcttgtcataccgtaaagaactctgaaaggtccttgatacacacaggagattattacagggctcagagaaaccaactctgtaattatggctacagtatgatttccattattctcacgccctggcctcagtcacttgcaaaacttccagcaaaatcctcctgcagctccacaacttgtcacggctgggcctctgcccaaaaggtgactgtggtcctgataacctctgggaaaagcaagtcagaattattacaaggaaaggggagtggtgcttagtgagtgagtgggggtggggaattctattgttcaagaaaaaataaataaatgggccacttttgctttttattatttcaaacaacagactcggcagcccagccttcctttcccaactcagactgttcccctgggccagctgtgctgagtctgcaggcacgggagccgggcttgagcaaaaccattaaaaggctgccactccaagcctgcagagcagaaagtttggccgccccagtggcctggctttccccgggaggaccgaaggctcattccccccaactgacccttgcgctcttacctttcaaatgtttatgcctcaccagccccaccactgctctggaaattagatagaatatcccaggtggctgaaacagaactgttcttatatcaacctaccaaagtaaaagatgggaatgccggccgcggtttatgaagccccagcctcttggtggggtattgcctgtgtcacctgtcactgcctgcctgaccgactgctggactctgtccttacctgcctcaggagggttgtctctgagcgccttgctggcccaggctcctgggggtgtcctgatcccaaactcatggtgctgcacttgacctccctgtcggggaacagatttggacaggcttccacaggcaagagagtaccagtcaccaaatgcctcaacccacccttggacaaacagcacaaaaatgcaagttgactatcttgggtttacaatgcagccatggtcaggaaacaccttcctttttccaagagaaaataactgttttgttatgtgcactgaactctcaatgttcatttcattgataacattcactgcccaaccagctcagacaatcacacacacacacaaatcctcatccagggtctactccatcctgccagctagtaaatggtcctctggcagctggtaggaaattcagcgggtaagactcttttagggcaaggcaggaagttacttctacattgcactgagattgagctcaccggagaaaagagttaaagcatcccccatactgcttgctgacttatttactcttaatggtgctcattcacccattgcagcaggtgaagcaggtctcagtgcatgaattgtacacagtaatgcccccggtatttagaattcacttttccagcagaccaaatttgccaaatcctactgaagaatcgagccatctgattcacctgcccaaaagctcatgtacttctctcctcagtgtggactgacgcgtgtcagacacaatttcagagtttggctatctggtttcctagcccaccaaagctggaagctgcagaatgagggaggaggaaaggtgctgaagtcaaccaggattcctggcagcaactggaagtgatgagtggccaagtgcatgagaggaagacccgggaaggcagcaaaaatcagacacaggagctgtgtggggataacatgcccatgtctcacagcgtcttccctgggcatccacaaaactcagttcaatatgtgaacaaaaatcacgaggagtctgaggcagcaaggaaagattccattgcgcttaccattttcttcacagaacggaggtatgaaatacaattctttgcagggaattatgaaatacaattcttaaaaatgtgtacacaatgattttgctgttttttagttgtgacactgaaggcggtccactcaaattaggcagttacttcctcctgggcagcacctgctgtgtggtacatcatggacaccattcttgcagagtaccatggtgtttccccagtgctcattgttttctttcccagtcattacccatagaattactccacacacaagttcccaagtcacaaacacactctggggtgcccgcctcttgtcctccacatgctcccattccagacacaccacctgtccgcagagatgccaacagaaatgattgctgggctgttacattgttggatggtaaaataggcatagtcctctaaatatgcccagaacatttcctcttgaccatccagagctagcagccagaaatacagcaaagggaaatggagggattaaggcttagtctcaatctttactcaatctgaatcacacaatgtccagagaaccccaaaagaagccaaaataaagcaagcaagagctccacatggaatcatcaatatttcctgggaaaggactaaaatgcaattattggccaacaggaaacaggacctcctgcctaccaccttagaaggacttttaacccaatcaagaagggcatgcactatagggccagttccaactcatgagatgagaagcctgaacacaaaacatccctgggcggatgactgctcccaacacagctgatgagccaagatcgcccaggactccagaacctgccagcttccggaagatgcaggggaaaggtcaggtccccagatcataccatctgacctcaccagagcaattttcatgttcccattgcacccgtggttttctcagcccacaacttggctctgggccccatttgcaactttaataggtctgcactttcctccatctgttccctgaatgcattccagatgatgcagcagccagaagggctggagcaaggggaacaggcatgtcccttccccctgcccaccttccccaattgctcagacctaataaagcctttgccttaagggcacaagcccaaattgaacacagcatacaccatttagaacaacactgcaaggctggtctgacacctctcatgtgcacaccagctctagggaggaggtgaatccacacactcaccccacaacctcagcacagaggcagagaaaggacaagatgatcatcatgacctcaacagcagcgtatctccttagctcaaatctgtatcacctgcccacacgcccaagttagcaaaaagatgtaagataacatccagcccaggagggacagactgtcttcacagtaaccaaaagtactgcacctcattcctaccttcttcagcttgccacttttggtgcccacaaaggccagagagtggttcttgtagacatatgcgatgacagacgtcatgcggtccctgtcctccgtgaagacgggaattccacgcaccatgtcggacactcccaggggagcattcatgtccaggccacagaagttatcgtcaatggttaagagctgcaaattttaaaaagagaaaaattagaagggagcgtcaaggaaattggcagagatattaagtcaggaaactatggaggtagaagaatccttagagatgaaacatctggtaacaatccctcttttttacatgaaaaacgtcactccagagaaactaggtgacctgtgaagagtcacctgagtgggcaggtgcagggacatggcagaaaacacaggtccgcaggtctcctttctccataatctgtgtgtctctgcccctcatccaacccctcccagcgccatcttgggagctttgtccatcattattatcatcatcatcctcacgtggaaaagcctcacgtggaaaagccctgggtcagcccagatgagcaggggctccaggccgctctgctcaggcacaagagggatgtggtctccgtatctatacacaaagaggaatgtggtcttcgtatctatacagaagagggatgtggtctccatatctggagcagacacacacatgaggactcaaaagtgtagactagggaactgaaaacattagcatgtaagtagcactatcacaacagaggcatgtgcaggcaatcagctggggaaaggagcaatgggggaaggaatgtgctgattcaactcaatgtgccacagctggtgctttatgagctccgacctcaggctccctgtgtcttttagagcattgtgaagaagggcagccctggccctgccatgcctacaccagcacttcccaaagtgccatccatggaaacccaggtccccgatatgctctacagataaaagggctctgcaggcaaatttctaggaagccttttaacaccatctaagagattcataacgattagttacatgaaaggtctgaaaagtatttttaagaaaaagtatgtttaaccttatctcagcctctcctaaacattttattcactgaaccttttcttccttttttttttttttttttttgagacagggtctcactctgtcacccaggctggagtgcagtgacatgataatggctcactgcagccttgacttaccaggctcaagcgatcctccaacctcagcctcccaagtagctgggaccacaagcatgtgccaccatgcctggctaaatttttgtattttttgtagagacagtatttcatcatgttacccaggctggtgtcaaacccctgagctcaagcaaccaccaccctcagcctcccgaagtgctagcattacgggtgtgagcccttgcacccagctgctaaaccattttgactgcaacacctactagtgttccttaaagagaatattctccagatatcctgtgagatactgaccctgactcgcttgctcctgactccaggaagtataatttcagaagtcaggaagctttggggccagttcccccactgtatttccagtggaatctctcttttttataccaggccatcaggtcccccttgaaacagagggtctcagctgggctctggggtgctggggagtggtgaagaccctggtagtagctggtgaaaagccctcggcactccccacaagcagcttgggtctcacacacacacccctctggggtgaattttccaccgtgtcttggaagggctatgtggtctcagaagagttactccgttttcctgtgcttttattttctgctctataaagatgacggaaacaatccccgctctttgatgggctaccataaagcctattgcactcgtgcctgtaaatgtctttggactttgcagagaaaggggtgaaataaaatacaaggtgtcacttttttaaaggcttcaatccagccaaaggaaagggcatctggagaacagcaggcaggctcttgccagggagtgtgtgaaaccaggccacaggcgttcacctggccccagcaggctcctccactccctcccagaagaggtgcgggcaggcactgtccctccagagaaggtgacctgctcagcatctgaagcctctctgatggctccccttcttcctacagagtagggacagtcagagcgaaaacggggagagcgtgggcaagcctgagcaggccacgtgtagagcagacatccactccaggcctttgatagcctctggcctctcttgcgtggcctggtccaccagcccaggccaaacacagctctctccccttcccttaaaagaaaaaaaaaaagaaaaattattgaccaggcatggtgactcatgcctgtaatcccgccagaggcaggcagatcatctgaggtcaggagttcgagaccaacactgtctctactaaaaaaacaaacaaaaaattataggagtcaaatttacaagggagtgttcaagatttagtctgatctttaccatttttccctaaataaggagatggggaaggagacaggaggcagagggttaaagggaggagtagaagaaaggaaggacaaatccaggcaaaggggagaagatgccctgtgcctgctggatatgaccatggcaacctgccaggccttccaagggcagcctggggtgctaggggtcctcgtggcccttgaatgttcctgcttctggttcacaaggagttcgcatccccaaatttctcaggcctaaactgtgctgcagggacctctggcgtcgcaaactctgtacatcacccattatgatccattttctgagtagatgtggctgaatgattgttcacactgcacagggtggggacactgaggcagggacaaagggagtccttgtttcacagttccccaccacctctgccacaaacataggcctcattagcctgaggaggcttcaggcctctcagctcccaaaattgcatttctgaggggtcaggattactgaatacgattcttccccttggctgggcacgacagaaggacatcaacagccacgtacaaaaagagagtatacatttggctggttacatcattcactaaccagaaagtcagggacctgtgactctcttcctctgcagaacctcttgaagcaagaagcccaggcaagatctgggacaatgacagatttctccctaagtttccccgtggcttggcttctctctctctgaatggggccccaagtgataaaggtgccattgagtcctttgaccaagcaccgtccaggtcttcatgattgctgaggtccccagctgtggcaggaggtggccctgctctttgtttccttgaatctggggtgatgggggagggatttttaagattgaaacagtggaaaaatcacaggacttgggttcaaatggcagctcagctgcttcccaattgcacaacttgctcctactgttctgtaacctgactttccttggctatagagcgggtaagcttattggagcgatggcacctggtgagctgggaagcacttcaatgtaagatatttcatgttgattttttgtgtatagaaatcctgcctggaacaggggtagaatggctgcagggtgtggccctagcatgcctcttgaccacagcatgcactgcaaacacagtatgcattgctgggtctgagctgaaaccaccagctaattacagtacctgaagcagggggagggagggtcccccagggcctgtagacctgggaggtggacatgtagagaacagatgccagggctgcctgggcccgggaaggtgaggctaattggtgaaagccttcaacaggtgagggttgatgtggcttcctgagcacctgggtgatgggggaagagaatgtttgctccagccctggctgagccttcccctgggccccattaacagtgagattagagccacagccagaggagccaggtctggactctgctattatcaggagcccagccatgccctaggcctggggctggcctcctgtcactccacaaatacacaaaatgtttggccatggttatgataacccttgtttattagagagcaactctactctcacaaggaaaggaaataagcacccattaaatgagaatttatatggagcccatttggacaaccctgtggacagacctagaagccctgagagggccacactctctgggtccctatccagaggactctggatcttttttcactggctcaaatgtcctcatagaatgcatggggtacaaattaagatggctgatccactgtgctccaaggactatgagctcaaggacaggggccacgttttatgcatctttgtacccctagcttagtgcctggcttataataggctaatacaatggatggatagatggatggatggataggtggatggatggatggatgggtggatgggtggatgggtggatgggtggatggatggatggatggatggatggatggatggatggatggatggttcgttggacagatagataaataaaagcctgagcttcacagtggctaacagtactgaaccagaaccaaagtgcttaggtttgaatcccaactctgccacttaatcctgtgtgaccttgagaaagtcacttaacctccctgtgccttaatttgttacctgtagaatggggattattacaatagtacatactttgttgtactgtggtgaggattaaataatttaaaacatatagaacaatgtttggcacttagttctatgggagtgttcactcttgttgtttgttgtcattagatgggtcagatgacctctgcggttctcagcatctttgaggaaattcatggtatctatctcagaggtatcatgaaaattaaaggggctaatgttgtgaagatgaaatagcaaaggtagttcttcccaaatatcttccagaatccgatagacatttggtcacaaagctgactgaaggagcaggggaatggtctcagatccaggagactgagcgctattcattagaaatgcaaattcttgagctccaccccagacatattggattaaaaagtcttgggtgggggctcagacatcttcatcttcacacctctccaggtgattccaaccccctcttgctaaggtttgagaagcactggcctggatcaccatggagggcccttcctagctgagggcactacagaacacagcatgtgcctagcatcccgactcgggagcaggaccctgagctggacctggatgcagagagccctcacagcagcctccccaggggcctgccacgcagtgtggtggtggtggaggtggtgtggggagctggagctgacactccgaattacaatctaatagcttatggcgcttccctcgtgcaccgcagcaaaggttaccgtgcaattacgtgtcgccacatacaaatgacagagcagttacggttactttaccaattacagggaaattgctcccactctgcagagagattggcactctgaaaagctctatcatctccatgaaaaggggattttaaatgcagacggtttccttcctccagcagttccccaggctcaggggcagagctgcaaagccactgccactgcccaaggaccccagaagtgcctggtagtctctgtggagactccctgggaagggctggaggaggaggtagacctggggaacagtggggggatctccccaagaactctagacatcacccccaaccctaggcctcaatgacacactcttaaggaaccaactatcacccactctgacagccacatcaatccatcttgaaggcagcaggtgatgaggcggggtgggcccctgatccccaaatcctcccctgaccccagcctgcacagcccctggtgtgagtcctgattgcacctcctctgccaagcaaagctgttttagccccggccctggcttgccccacctttgcagaaacctcacattgagtccttattacagaaaggtcagaaccaagccagagctcaatggcccaaatgcagtgctaatgaggtgaaggtcagcaggtccatccccctgtgggccaattagcttagctctgggacacagtctcttccatagccacaggctgccctcttactgcaggcatccactgtttacaaacatcctaagctgatcctgaagaggcagaccaggtgaccagcagggatgtgccatgcagccaactcctccagccacctatgtacctgccctgctgctctggggcagcagcagccatctgagccccaggatggaagacaaaatcagatctggtcttcccattgctctgtgggcaactcctgtggtccaggagagagaggatttctcccatctgggagaaaaccagctctcctgcccttcctgaatggaaaagtatcatctagcctcatactcctccacagctgggaagtccccactcctgtccgttgcatagggtaagaagacatcagagattttcccaagctcacccatggtggggccaactggatctttagaccaaccttttcccaccaaacctttggttccttgggctattggaactccctgcgttcagcaagggaaataggcactagatgaagacaaggctatttacttttcctcacttactaatttgcttaagagcatttatgaaaaacctactaagccccaagcactaggtgagcccctaagaatagaaagatgaaaaagtctcagttcctgccccaaagaactgcctctttcccagtgtggggatggacagacctgggccatgactagacaaagccatctgggccctgcttcagttatgtgcctgggggagtccagagaatggaccaccaactgccttggggagcaggcatgactttgaggaagaggcgaggtctgggctcacgtccaagttctctggcttatgaaacagtattctgcccctctttcacacatcatatttcagatgcggaaaataactcaggatcataaaatccaacagccccattttacagaaggggccactggggcctggagagtgaggtgcctcccctagttacctatcaagttgctgagaaaataggtaccaaaaccccaaattcctggtgacagaaaaaacaaaacaaaacaaaacaaaaaagcctgattttttttttagatggagtcctgctctgttaccagggtggaatgcagtggcacaatcttggctcactgcaacctccacccgccaggttcaagcaattctcctgcctcagcctcttgagtagctgggattacaggcacctgccactacacccagctaatttttttatttttagtagagacggggtttcactatgttggccaggctggtcttgaactcctgcccttgtgatccgtccaccttggcctcccaaaatgctgagattataggcatgagctaccacacctggctaaaaaactgatcttaagcacgggtttcctctggggttgttagagggtggtcccaaagacaatctattccaggatcagaggaaggcaggggactgctggggaagagactatgtgtccagtccctttcccagcaccagggatgagtgctctgccatctccagaaactggaagcaaccaactctcccctcccaaggaggcccctgaccactcacttaagctgggcttcttcctttcctgggtctgtgcatcccaaaggaaagtgagaaatgacgttttgaaaagaaattcaagttaggagaaaaagggaagggaagcccatgagctgcctattgatacagaaaagaaaaggtctttatattcttcatgttgagcagccctaaatttcttcccattaattacacttatgcacacttgtgcacgcacgcacacacacacacacacacacatacacatatcctggttgctgaccatagcacacctccactggaaatggggaatcagtgaattacacatgtgggatttctttttaaagggagatattgatcagataaactgtaatagctcatgtctaaatgcaggctccagttgtaaagctctgcagtacagggagataatgatcacccacttattgggaaccgtatctcaaatatgacggctgacccctaaggtgttcataaatacacaaaatgcatccaccccttgagatgacatcgtgtttactccacaatacctcctcaggggtagaggtaagtggagagtgtccacagggaggtagaaatatctctgggagtctctagtaggcttaggtttagctcctcagaaagcctattattctataagatatttccatgtgcttgagtgatgattctgtaacaaagaaatcaaaaagacctgactatccaatcctctgattgctttcctgtaatgcctaaactttctcttttatgactcctagccctccccagaaggtctgccttcagacacgtgacattgagacacaggacccacgctggccctatgagattgaagtctcttgaaagcaagccagagaagtcctataataggtgaaagttgacccctgcaccctggttgtgagcacaggccatggaaacaatgctggagtgagggctcatacactcagttactaatgcttcatctcagaatgattctttcgggtgtctttttcaatgagattgtagggaaaacgaatgtgtaacagaaagagggagagccagcaagccacagtcacaacaacccagttagacaaacacatcattgcaggggcttagagaaaagtgtattggggttggaaaaacaacccaacaaattatagtagttcccctgatccttggcttcactttccatggtttcagttaccgcagcttcagatcaaccactgcccaaaaatagaagagtagagcacaataagggatttttgagagacagaggagacaatgttcacataatttttattatagtatactgtcataactgttctattttatgattattattactgttaatcttttactgtgcctaactgataaattaaagtttattataggtatgtatgtatattagtccatttgctgataaagacatactggagacttggaagaaaaagtttgatggacttacatttccacgtggctggggaggcctcacaatcatggcagaaggcaaggaggaggaagacaggtcttacacggatggcagcaggcaaaaagagagagtgtgtgcagggaaacacccccttataatatcctcagatctcataagacttattcactatcacgaaaacagcacaggaaagtcctgcccccatgattcaattacctcccaccaggtccctcccacaacatgtgggacttcaagatgagatctggatggggacatagccaaaccatgagagtatgcatgggaaaaaacacggtatatatggggtttgggactatctgtggtttcaggcatccactgggggacttggaaagcatctcccaaggataagtggggactatcatatggccccagttctcaagaaccaagagctttgcttctgggcatctcaaaaaggaggagagcagaccagaaaacaggatagaaagtcattgtgttttaggaggtggggctggggattttgatgcaaatattcattaaatgaatgcatttaactacctatggaatgatgaaagccatttgctaaaagcaacacttcttttaatactcattttgaagtttctatgtgtgttttgggaccatctgtggcccaagcccaccagatatctaagtggtctttcactcatcatgaaaacaagctatccttctaatagggaactaatgtcactaaattgagcagttttccctggagaagggcattaagccaagcacacattctgcaggccaggctgtaaccaatagcgagctttagcagtgcaccccttctaggggttgctgagcatagcagccaaagacaagcttcagctcagaatcctaggggttgaacccatgaccttctcctcattagcttagctgccaagagcctcgtgttcctccctctgagaagcagacagggccatgccctgggaatagtctggacaggccagagctctaggccagcctaccaagagaattgaaattctgcagatggcattatccctgggggctggtttagcaaccaacaccagacccatgggaaatcccagggaagtttctcagcattgcgaatggtaacaaccaaaacctactggggtgccacctctctccttttgtactttagctccagagaaccccagtggctacctgtcaggggcagataaatcccatgccaccagtccatcaatcccaaatcccactgtccctcctggagtctatggcaggcagactcagcagccacaagggctgtcattgaagtgagaaataccatgatgattaagtttgtgtgttttctggtgggtgctgggaagcagtggccctgctccccaggctgagttatggggtaggtcattccctcattagtggaaataaattttattagccccactctcacggcaatgtatcttcctctcttgctcctcgggtctaggtgtgggtctgggtaatgttgcctgcgtgtgggataaatcagccgaacaaatcccattatattttggaacactgacggagacacagtaatggcacagagaccagggaagggagtgggctgcttctctcccactgaccccgtttcctgcccatagggccacacacactagggaaaacatgtaaattgagaggccagatggagaagagctctctcagttgtctctttctccttctctccactgactttcttgataaaagaaacaagcctggtgtggtgatgtgcagtccttcccttataccttacaaaaactaagggacatgtgaaggtaacagcagcaagcactggcccaaaatgtgtcttgtcacccaaatgcattatcttatcattcataacctgtgctatatagaaaggaaggcaattggagggaggccgaggtgggtggatcacctgtcaggagtttgaaaccagcttggccagcgtgatgaaaccctgtctgtactaaaaatacaaaaattagctggtcgtggtggcgcatgcctgtaatcccagctactcaggaggctgaggcaggagaatcgcttgaacccgggaagcatgggttgcagtgagccaagatcgcgccattgcactccaccctgggcaacaagagtgaaacactgtctcaaaagaagaaggagaaggagaagaagaaggagggggaggggaaggggaaggggaaataataataataaaggcagctggagcacatcctagggcctgagataccaaacaccacacctgcattaagcacagcccaaatctctcaaaagcaggtattggtgaaggaaaaaaaattctaagcatgaaatcactgcaatattattacgcccctttctgtccccttgggtggttattataactaaaggaggagacacaggatgatgctatgaagatgtttgagtgtcctatgaatataaggggctgtgtgtctatcgttattaacatctgtatatttctctttccttaggagcttccggactctttattaaaaggatacttttttatcatctccttcttgaagataaaatgtgtgattcaaagcaaaagggaaactgcttgcccagtgatatctcacaagctgggactggctgagacccaaagatcctgactcctagaccagtaacccggccaagacgccaccctgtgaggacgaaaggaattgaagggaaggcccagaagtccagatctggattgttaagtagggctggtctatgtgcccattgaacaagaggtctggcttcccattttggcagggttatctcacactgcatgaggcgtgtgtgtgtgagagagagaaatctcattgtacttgctgctgagcagagtgtgtgggggtgagggagaacaagtcacagaaatagggagacagagaaaggctaagagaggaccgtgcaccaagagtgtgagtgagtgagcaagaggagagaaacagagaaagcaacagacagcaacgaggaggacagacatcaaggacagaaagaatgggtgtgtgcacatgggtgtgctatgggtgtgtacgccactgtgctcgggctcatgacatgcagtccatgtctcagtattgtgagagcacacatcctcaaacctgactttgtgctaagctctcctggcagcagtctgcgttaaaattcagcctgtgtgactcctgggtcccgcctcactccctgctgacccgatggcctccagggtgggcatcctgggagagtacatccagcctaggaagccagcctcaactttgctcctgccaaacccaacacatcgcccagggctcagctacctgtcacacaaagcaccatgcacactagtctgggatgggacttttactgcaaaccctgctggccaaaaagagggaggtgggcgggcctttcacctaaatacctgagacaggtgccatctccgagagagtgggaagacttgattctataaagattggggctgtgatatgtcaggcacccagtgctaaataagaaatctggagtacagggtcatgggccatgagaggtgggcactcagaccaatgtgttagatttttgatgtgtgcatttattgggacatgagtgtggcatgggccatggtgtgtatggcaagtgtagtggagatgagagaggaaggatggtgcggggaagaggaggagttccaggtctagagaggacaagagctgagcagaaaaagcaagcctcgtctaatgccataaacaacaggatacaaccccatcaagtctgagccctgtgcttcctgctgacagggaaaagaaaacaccccaagaagacctgcagaagccaggccccagagcctgggatgcctgcctggccattccggatgctcactttcgtggagtttcaggatctcaggcgccagaccaacctgagtaaccacccagactggaatgtgaggccagcccaagtccaagggggtgaccctgtctcctgctcaggactgccatgcctaggaaaccagtgagtcaaaggaacggcacgtggaaggggacctccatcgccacccagtcatgcacacagcagggcaggaaggggagctttgggttaaaaagaaacagctccatctcctgtgcctgtgtggcccttgtgggactacacagggctggtgggtaaactccagagtcaggtgggagctgggtctagcaatggttctcaacgagaggcttctggaaatgtgagaggttttctagtcttgtagtggctgggaacttccactggtgctcagcactgtagggccccggatcacaaacgccctacaatatcaggcagtccctgcaccaagaactgcccaccccagacactgctagcacactcttgtgaaacaccacgggaagagcaccaagctgagaattaggatacagaacagccttcagtttactaattacatgaccttgagtgaaacacttgagttttgtgttcctccattccctcaactgcagaggatgcctgcccttccattatcctacagtattgttgggagaagaaaagttgtgagaaagcccttgttaaccatcaggtaccatgcaaactccagtgtgttatttccagacagccgggaggtctctgccctctgctcccactactggggtttgacaggtgtcagttggtgatgctggataatagtttctgctccaaggacccaaattttctagttgagggacactcaggtcaaggcttgacagggagattgagaagctgatttctgcaccttctgcatgccacctttctccacaccgcctaatcagtactatggccgagactatctgactcccatacccatggctcaatcagttccaaagtcagggaagactgaagtggagtgaatgacagtcactcccatgaccacagccattgttcccatcacccaggccataatgacctgctggtgtgcatctctctcctccactgtgtgggctcctggagacagatgccattccacaatgcttggtatccaccaggagggagtgcattgccaagcccttccctagggctccatatatgtttcaccattcattagtttattaagaggtgctagttcgttagtgttggatgaggttgccccaggaaggtgaagaaaggagagaaggtatagataaccctatgcctggggaattctgggatgccaggtgcttggtcaaacccagcatcttctccagccagctgcccactccaagtcaggagtgtcaggtcccccccagagaaggacagacagccatcaccttctcctgcataaggtcctggcacatgacagaggccacaggtgtgggctccccagccttactgtctgtcacatgctctgcagacagggggcctcagggagcctggatggcagccttcaaaaggggctggggatagagatgcaccagtgataagccacagaaactgagaaatgaaatcactgccattccccacatgagtgctcattagcaaatcagtctcagcttgacctctagtcccctgagtcccaagacaattggggctctgacagaccctctaggaccccccctcatacccatgtcctcatgagatcctcagagttactttcagatactaacccacttgttctgggagacctctttccacccaggctggagaaagccaggacaggggtaaagcatggctcagagggtgaaggcggaagctgctgttcccaccctccactgacaccagaaagccccagctgcttccctagcctccacacttggtgcccactcaggaatgtacatttgtgacaggttcgtttatgtccacagcaacacattcccatgaggaggccactcctggccaaccagccctcatctccaatgggagcacagccggccttccctgattcacctgaagttgaggtacagctgagctctctgggggctgcaggtcagcaggttctaccccaacggcccaagacttttccctctgtgcggtcctcaggctctggcctgcccagtgctctgtggatgctccctggcacaaggggccttgtagtaggggttcttcttcccattccttcctatcccccaaatgaacacagccaaagcaggtgctgggaccttgtgaaggaggcaggtggcccaggagttttgcggatcccggctctgagttctggaggtgtgagttcagggggaagaatgtgggtctcaggatgtggaaagggctagaaaagcctgaagagccccatgggaggagcattctaatttagagagctggtacagcctggagcacagttgacattcattgctactcaaatcccttcttcaagcttttagagttgtaactatgataaaacccacaggggaccccttaccctacaaaatacaagtcctaaaagccaacctcctgggccttgccctgccctctgtcatcttcctacaacagaaacaccacaggacagaggtcatctgggactgagttctcaattcacagggctcaagggagtgtcagactccgtgacaagagagatctccagagttcatcttgttcatcctccacctctaggcaggaagggaacaagaaaaccaacccaacagccttgtaaatgagttgaggaagagctgggtttgcaaatggtgccatcggggcaacacagagcctggcctggccgatgtcgcacgaaacacgtgtggtctgagccgactccaaaggaatcgtaacaggagggtgggagcaaaggaactcgggtatctgccaaatcaaaggaaactgatactgtgcattaaacaccagcctggcctttttcagactggctggagagacagccccaggcctgtgcagagtttctggcctcctcctttctactctcggccctgaacttgcctgtaacttgaaagggctaattaaagccaaaagaaaaatcaaaagcttgttatcttgctccattactccccgtcccggcattagcctgtcttgcaaagctgttttccctctattctctccaaggctaccacacggtgttaggacctgcagctctgcagacttccatgatgaacttggctttttgtattgtggcaggaagcaacggcagcacgaacacttgcccatgggcagccagacggacgcctgcagctgatttttctcccaagagcatcgcccaaaaagtcagggttttaagaaagttttctacaggaaactgtcagagattgccaactcctctggtctcaaaagaacttgttgttgtttagtaagtgcacagtataaacttgccgtcttctaacataggcctgcatatgtgtgcatgctcgtggggaatttattacatgtatgcatgtatgggtgtcctgcaggcaagggggattctcttcaattggtggctctgttactcactcctaagatgtgtgaccttgggcaattcattcagcttgctgagtcttgagatactcaatgcaaaatgaatttttaggccaaggctctctaaaggccttctcaacaccaacattctaatacatctcaccacagacccatgtttgagtgtctaatagacatgtccagaacagcctctgtcattagctgccttcgtttggaagcagtccatacccccgtaagttcacagacctgtctcatggactctcttaagtggctccactactgccccaaacaaagggctccaggggcattcccaaaggttgtcacctgctaggaagactcagtagataaagtggagtcccctccattctccagtctggctctgatttgtcaactttttgctgccctgcttggtccatagcacctctcctatttcctttgtgacatcagggaactcctggattttcaagacctccaagaagagacgacatctcttagtttcagctggcccagtgcctggaagacttgacagtggaaaacagcttaagcctaatgccagggcaccatctttctcctccctcttccctatctccaacccaaatcccaaagaccagagtgatggcctctccacactctggctggggagggtgccagtccccactgagatctgcctggcacatagttatactttatgaaaggaaatttacacttttttaaacaaccaaaatacatttcctaatatggaactccaccaaagtttaaggagtcaagaatcacatcagtatggatgcgtacttctgtccaatggatacattttcctttcttcttctccccaaattaaaattagagaattgatgttctcagactaggttcataatctttaaaatgcacagttataaaaggaaaaggacaagaacactgaagatgctgatagctgagccttccaagtcacccaaagaatgatagtgaaaaagcaggaccattgtgaagaggaacagagtcaagccacaagaagggggatgcttttcatggtggggcacacgtgagctaggctgtgacaggcaggagtctgtgtcccctgcttcacctggggtaacccagcaaggccatacccaccagccatgcgaagacccctaagccaacccttctcctgctctccctctggctccccacagctctcccatcatcccatgctgctctccggctgcttcctgactttctcacatgtctcttccaaggcactgtgcacacagaagatgctcaataaacacaatttgtcccttcccatcccttttctaagttagctttgctttctctatgtgttcactgcactcttacctgactgtgctctcattttagcatttcctaaagacatacaaagggctaaaaacacacctctcctgaaattccatatctatcccaaatgtaggatgactcctcacattctcctctccttctaccatatggtttttattctaagctcccaggaaagttatttgcaggcttggtgagtacaaagggcatgtacgtgtcttgcactacagcacactgtgatctagactccagccatgcccggtccctacgacatccatttgacacaattcctacctatttccagcactccccgtcataactagtgagccaatatgaggcagagaaaagtacactgatgggaatttatgtttcagctcccactctgactcttatacattcaatgtcatagttgcagaatatttggtgacactctgggtccaatgagactcagagatgggatgggatatactcacttcatctgcaaaaggggaaggatgatacacatcccatgggggctacaggctggggttctcatcctacactcccaaccatcccagcgcgcagccctccctgtactcaccgcactgctgcaggggatgtccttcaccttgagccaggccaggtccagcgtgccctcgccccggtaacaagactgcagccgctccttaatgcggtcatttatctgcttcaagatgaagatgcacagggccgactcatccagggatttcattttccgcttctggcccttggagaagacggtgaagagcaggtcatcatctggatggactccaagggtcctgccaagcacggcccccgctttggacaggtaggcagcctgcagcaggcggtactccaccccactgcgctcacagccaatgggcacctctacataggagttgaaggctgtgtcctccttgcaaagcctcacgagcttggatgtatacacctgctccttggtggtggagcctggtggagacaccatctcaggttggagggtcaaaaagtagacaaagttgccactgctaaaaccatagacatagtagatatcaaagtcagggatgatggtgaaggtgtccgaagggatcttaatcatcgaggccacgaactcatcatggaagacgtacgcgaacatgccatccgcctcagagttcttggtcagtttccggctggagatggtgggaaaatactcgggcttcccatccactgccgtggcaatgaacagcttgtcatccaggttgctgtaggagacgatcactccaaagactgagccgctctcgttgacacctgacagatagtgctccttcttatgataaggctcccccagcttgaagaggtcctccagcctcagcagcttgcagatgccttggtacaggctcccacaggcaatcagcctgttctccttgtagtctatgaggagcatcttgttgacattgttggtggtggtcaggggctcattgcaggtctggacgatgcggggtgggtaacacttggggttgtcctcgtccggccctgtctcatgcgtcaccaagaccttcaggtcgctggagagcttgtaaatccgattgacggcccccaagtaaatgtgtcctgtcctctcatccaccaccaggtgattgaaaccctcggcgggctctcctcggaatgtgacaaatgaccgctgcttctgggacagcggggctggctgccgggtgagcaaagtggaggagcccatgcccaccatgaggaggtgggagagaaggcaggtccagttccagggcatggctttcatggcagaggcgggtcccagtggcacagcagcactcaggcacagtcgtcccctcagagggccaggactcagcaatgcagtctcccctactggagaaagggaagacaatgagctggataacaatgccagtggcttcatttcaccccacagcttgtctgcctggactttcaaaatgttctgcacacactgagcagaactgcactggggggtgctggaggctgactgagtcaacccccaccacgggcatgtgacacagtcagagccgggtggcagcagccccaggaggacacatcagtaacgataatggtggtgatgataatgacatgataatagcagtgatgatgatgatgatcatgattaacagccattatctactgagtgcctgaatttgtgtcagacactgtccagcactgtcacccgggtcaggtgccaccagcaggcagcatccgcaaagactggctggaggagaagagggagggagggagggagggagggaggaagggcaggaggcggggctgcctgcactggctgcaagctttgtccggtgttccccacagcaggcctctgcacacagtttctccgtctccaggctctgtgaaccacctcctgctggaccccatctggccgtagaggtggtaacagagacctcactattactatccacccatactacattgccccttaaagagccacacttttatgaatagcccctttattaaccttttctcaaaggaccaaatttgtatgtgctgtctattacctgctgggaccctgattggtagacctccgaagtacatcctattgtagccacattttatagctaaggaaagcaagcttagggaagtcatgtaacttgcatagctataagtggtagaggtagctccaaatatgagtagtgtaaatgtgcacaggttcgcaatcttaactgctaaaccatctcagttcaccccaaccttgcacagttggggctgtaccgtggtccctgtcccatgcagcagaagaattaaggttgatcccttctcggggctgtccattacagccactacctccagttctctgtgtctgtacctactactgcaggagaaactttcctctgtgcctcctctgctggatgaagaggccaaattaaaaacccacatcctcaatctcgtcacactgcagctgcaaccaggtcctctgggttcactgcccaaccctgagccctaatgttattttaacaaggcagatcttggcttcctcccctagcagggcctcctctgagaggttttcattaaagggagagaaaaaatgctttaagaagcagtcaagcaaataaataaacaaataaatacaaaactccccgaggaacaagatcactccccatcctgagggtctctttctattcaaggtgcttcctgcatgtgttcccattggacagctttatgtttcttccagttcgagagaattcagggcaggaattgccaacatcctatctgggggcatctcagctctgtggaatttttctcattcacccccaaacacctcaaaagtagagaatgagaagaggtagatcactaagcaatggaaaattccccagcagggagcaaacgctaggtcagatggaaaccaagagaagaaggaagaaaaccaaataaagactttgcattgtcagccagcatcctaatgaaaagcacaggccttctccagtcaatatcagaggaggaagactggttagtggaacacaccacaaccaagagcagtgctgaaagccaagggccttcattcattcacccatgtggcaaatgtttgctcagaacacacacaaaatgtgcaagacactgtggggcccaaggagcagatcctcaacgaatgcgtagtcaaatcaggccgataccaccagaacctgaactgatacgcacgacaaaaagtcacatggcatacaagagagtgctttgaaagttcctaggaggaggaagacttctaacttagggtgagagagggcaaggagcaggctgcaggaggccttggggagggcatggaatttgggctgagctgtgaacttcaagaagacagtcagagcacgaagggaaagaccttctaggggaggggtctacatagcagaagcatgggcatatcacatgagggtgtgtacaaggaagagtacgtctggagaacatagttcatgaatgaatcaggtggaagatgaggctgaaaagagagagcttcagccttgccaggatgtcactgggaagttgagactgaaatgcacagtgttgaagacagaaatgaaattgtagaggaaaagagcaaaggcccccagagaggagcctctccctttccatttagccttagcctttgcagaaggagagtttggagctgagggtctgtgaactccacagggcagggctgggtctgtcttgctcgtcaacacattcacagctgcacatatagaggaggctcaacaactgtttcttgactggcagaaagaggggctggaagcatagacgaataccaatatctgtggagtatttactgcaccccagagcccatgcaaatactttcacatagcttggctcacataatcctcaccactgttccctgggatcagaattgtcttattcctatttcaggtgaggaaactttagctctgcaaggacactggttaagatgtagcagaactgggtttgaagtccaggtttcaatcaatgcaaaatccatacttttctagaaatgcacatttccagagcccagaagatagagcacttagaagcccttgttaactcatgtaagccccaaacagaaatcctgggatatcacctaccagtatcatgagaaaaacaaagtcctctctgaccttcaggggctaagctggtagataacaccgatcaggtgagttctgtggtttacctctgaaagtattaatgactgtaaagcagcagctgcacagagcctctgcctagcacagttaagtgcttaggaaatgatagttgctgtcgttgttatcgttagcaagattaaaataggattagaaagattaggattatgataatgagatggttcctggtggtacatctcaagatgagtgatgaagagtcaagatggttcaccttgaattgcttgtgcaaattcaaatatcaaagaagaatctataagtttttgatctaaaagagataatccagcttagtgattcccaatccctgattttagagacaaggaagttgaaatccaagaggtcagatgaaattgcaagaggtcacacattgagttgaagacagtgtaagactgggtctcacactgtccatcccatgctctttccaccaccccggcctctcttctgactttatgtgaattcactccagcagctgcttccagcctttgtctgaaagagactgctctttgggcaccatatgctctgccggctaacagggccctcaaaacgtctctgccaacaaccaaattccagcagggctgataatcccccttccagacaggcaggtgcaggtcggggctccgccaccaacttttctgaggagagaacttcgcacagtctctgtatcacaacctgccgtatgctggggaatgtgtgcctaccccacgacctgccttactgtacatacacatggatccatggccaatcagcagctctctagtctgcaagaggtgagatgaagaatcctataattacgaatttactgagcagaaaggtgccatggctcattctgcatcttctattaggcactgaaaggagacacagttatgcatctcaaacacttatcaccctcatctggggatggtgagattactacacccagagaggaggggggcccacagaaacaataacatgtactgggaataaccagcctttcattttacacactaagaaagggactgattaggaaacaaataagagagaaatggaagagaaaaggggaaaataaggatgtgagctccagcttgcctcaccaaagaccccaccaggaaccaccacagaggtgacaccccgccgagcttgggacccacagatatgcagagccaccagccccctgtctccctgagctgtctaaggctgctccaatctggcaaagcaagagtttccaggggggtttcccttccaggatgtcaattcttgtaagcggtaaccccaacctaggaaacccccaccccaatatcagagcctacccaccatttcgctctcaagtcaccatttagctagtttcaaaaccaagtattagaaattacattcagcccaactctgattcttaaaggcaagtaatgggaccaaataaccttcacgattgccccaaaggattcatcgaactacgtagagtgggtaagaaggcaggagaactgaaagaccccgtaacccaactcaaacatgctacagttttcccttctttgaaatcagattttaattttgagtagtctcaggggagatgggactcatttatagaagctgatcatcattttgattaaagaaattggggttgtctttgttttaggcagcaagtttcaaagaactgaaactaattttcatgaaatagcaccatcctctcagattcctgagtggtagagaggaaagttattatagagtcgtttaaaatagcaattaccctgtgaaattactttagagtttacaaagtgttttcatggatattaccttgttctgaatttcttgttcatgacaaccctgttaggtagatgaggtatttataagtatgccttctttaaagataaggaaaccaaggcatgaacaggtacagctcttggctaaggtcacacatagtcacgttgggcattggagagctgagctcttcaggcctcactcagttattcacaatatattccctggccccttggacagagtcctggtcctcagaccttttattatggggtaataggattctcagaaaatgtgccctaagatggcatttcaaaattcacgtcacaacacaccatgaattaggtgagtcacaggtgttttttgttttagtttttgttttgttttgttttgttttgtttttgagatggagtcaccatctgtcacccaggctagagtgcagtggcacaatctaggctcactgcaacttccacctcccaggggttcaagtgattctcctgcctcagcctcccaagtagctaggattacaggtgcccaccaccatgcctggctaatttttgtacttttagtagagatggggtttcaccatgttgggtcaggctagtcttgaagtcctgacttcaagtgatctgcctgcctcagcctcccaaagtgctgggattatgggcatgagccactgtacctggccaggtactcttcttaatgaaataaaatagaagggaaaatactagtatgtcacatagaaaagataagcactgtttggtgagactttttttttttttgagacagagtctcactctgttgcccaggctagagtgcagtggtgtgatctcagctcactgcaagctctgcctcctgggttcatgccattctcctacctcagcctccccagtagctaggactacaggcgcccgccaccatgcttggctaattttttgtatttttagtagagacggggtttcaccatgttagccaggatggtctcgatctcctgacctcatgatccgcccgcctcggcctcccaaagtgctgggattacaggcatgagccactgtgcctggccggtgagacttttgttttacccactatatagcaaactacatattgaatgtgatgtaaatatgtgtgatgtaactgggtccctgggatggttaattttatttgtcaacttggctgggccacggtgcccagatagttggtcaaacattattctggaagtttctgggagggtgtcttgggataagattaacatttaaatcagtctgctttgagtaaagcagactgccctctataatgtgggtgggcctcatgtaatcagttgaaggtcatgaatagaacaaaagactggcctcctctgagcaagagggaactccaccagcagatggcctttggacttgggtacaatattggctcttctctaagtctcccatctacaagcctaccctacaggttttgaacttggtgcctccaaaattgtgtgagccaattccttaaatcaatctctgtgtctctatgcacacacacacacacacacacacacatcctcttggttctgttttctttgaagaagcccaactaatatagtcatggtcaaaaaaatttgaaacacactttcagagacggtgcatacctgttgtttttgctgtcattcatttatcctctgggcatctgtgcctttgcccaaacacttctgctggaattgactccacctctggttcaaagcctgagccactcagcacagaacgggggtcgggagggcatagtgattggatcaggaatgagaaactggttaaatcaggtctccgacaagcaacaggctttggatagggatactaggggagaaagttctagctcttccaccagatgtaaccttggagaggcaagggcctaagaaccgctagtgccatcttgtaatcacaggggtgagagcaggggacaggagcctggaagaatgaagccaaagtactgagaagagcagaactaagccaaaggatagagagtactgggtcccaggcctggcgacatcctataaatgtctcaattgtgtccactgaagccagctctatgcctgtactttccggttacgcaagtcaaaaaaaatttttccccttttgcagaagccagtttgggttcggttttctggcacttgctgatgtaaggatcctaacctatacacagaaaaatcccaaagagtacagtgtctcccaccacaacctctctaatacactatttttccatgggatcaagtgagcaagccaaacagatctgtgccttccactgcccacagagataaactatggttttacagatagcgaggcacaatcccaggtgatgttcgaacgtgtgtgcacgtgtatgtaccaactttcagaatcaaacacaacacttccctatctgctgagcatttgccttaggagctgcaccagcagagctcttgggaagtcttcaccaattcatgcttccgggccctgagttagactcattgttcaaatgaaaccttctctgatcaagccactggtctaagatgcccctactatatattagtgcaggaaccagtgccaccagagtctcacattttacaaactctgttatatttgtccattgatgctgtctcctagcataaaaatatgagctccttgaggacaaggattatatattgcccctcttttctccagttccaagctcagagcctgaaacacagtaggtgtataatagatgtttggaaacacgtgaatgaatgaatgaatgaatgctccatagcagagtatatgagatggcagtgggtatcatgtacagctgaagtacaaagtaaatcttggtgcttcaagtaaatctttgagccagtcaattcaaacagggaccaacctaaaaaactggttgtaccctgttctaaaccagggtttataaatacttaaaatactccattttgtccttttatttatttatttatttatttatttatttatttatttatttgtatttaaaggtaaagctcttttttaatttttattaggacatgagttcaaatgcatcagagaaactacgtctttcgtatatgatttacatggagaccaaccggtccaccagctggaatatcataaaaagctgtcttgtgttagcaaattggactttgagaaccaccatcctatgcagcaaaggaaatcagtatggacctggttgaacagaagaagctgagcctgaaaataaaattgcagcatggaaaacagacaacaacagaaaacagccacaatgcaggagatgccagttgctagaagtcagcatgcactcctgtattcagccaacgactattgatggagcacataccacatgatgagttctgggctgggtgcaaaggatagatacattccagagcaaaaaacagtgtccctgccaggagtggtgactcatgcctgtaatcctagcactttggaaggccgaggcaggtggatcacttgaggtcaggagtttgagaccagcctagccaatatagtgaaaccctgtctctactaaaaaacaattagctgggcatggtggcacatgcctgtagtcccagctactcgggaggctgaggcaggagaatcacttgagctcaggaggcagaggttgcagcggtgagccgagattgtgccactgcactccaacctgggtgacagagcaagactctacctcaaacaaacaaacaaacaaaaccagtgtccctgctctccaggggctgagggtcttctagaggcccctctagctgtcccactggcaagctctgcagatcctccccttcccagcctctattagaaacccagaacttcctacaacactgtacaacaggtcatttaatctcaattgtgcaggtggattgggaagaggaagctaacttttcacaaataacatgcgcttccctatgcgtgaggctgctggtatgaagtcagtgagaggtggccatcagcgatggatgacatttcccagcctctccatttccacatggtatccaggtgtgactgtgtgaatagcaaggtcatggtgacatttccatgccaaagcagggaagaaataagtgtgttttctctacggtttctttcaccacccagctggataaagaggaccctgaggccctataggatggtggagcctcaagatgaaagattcgtgcacccaccaggaacatcagacaagaaagaaacctttactgtgataatactgaaactgtggatttgtgtgtgacaacagttaacctcaccctaactcacaggcagaaacacagcaagctcactgcatctcagagctgggattcaaacgtaatgctggggggctccaggcctctgttctttgtggtgcatcaggctctggccctaggaagagttctctttagatgtcagcagccccctcccttgtttccaaagccagattgcaagtgggtaagcccagagatagaggagatggccaagctaacatatacaggatagagaaatcttcctgctcaatggccatttccaagtttggggctcagggaggtaagtgtgtgtgcagctgagggcagtgagggagttggggagcagcaacaggcctcatttccatttcatctaagaaacttcaaacacttattgatccatgcaaacaaaatggacacatgctatttgtagatttctactccaatttgtaatccgtgcattcaacatagcgtcttcagtaaggtcagtattttttcatgtctgtattttttttactttaaactcttggtttctagaagtgggagccatgaattattttacaactttccctggagaattctatttacacccatctagggcccaatcatgcagctcgctacagtctggggcccatgacagacaactgaccccatgtacttggccacctcactgcagctccattcgtcccggccttcactgtccccttgccccttgttgctagctatctcagaaatgagtgtcacattcatcaaaggaaagagccagagggtagggttgacacagcaaaacccatcactaccactagggggaaaagtcaagtcaaagcaactgtcttcccaagagaaggtcactgctggctttgggcagtctcagtgtgggtggggcctggtggggtcagctcagccacaacacagccttagtccagaaagcagcagtccagcaggggccatgggagccctccttccggtgtgcttccctctgcctctgcttctcttctgagagatgggaactgtgaaattgatgactggtgggagggctggagaaaagtataaaagatggggaagagggagcgatggagggccaggcactgatgtagagtcttggcgccaccaggcaaccagcccggtcccagggaaatccagcaccaagctcagctacgcggggctcccttcatccttacttcctagtttattaaaaggggatgaggagaagtgattaccatggacagagcctttggacccagcctggaagaagcctctgcaggaggctgagcctgtgagcctctccattcagagatcatgtcccagccggacctctgagatgtttatacatggtttccacgccctccttcctttccctcccccaggcctccttgtccttggcctggagggtgttccctcagggtacaaaaccacgtctccctggccaagtctgccgttcccagtagagtcgagcaggagctccagccgaggcccaggcagccccatgtgaaactctccattaccacgtggagatcgccttgagattccaggcactgtgccttgggacagtcactaggcaatggctttctttactccaagtgtggcagcaaggctttaaaaacacagcactctcaataggatcctggcttggggaggatagaatcctaaacttctttccagcatctcacttaaagaaacaggccagccaggaatttggagtcagatgccccagctggagttggtgtcaagacctgctctgcaaaatggcacaggctggcacctatgtggccactgtctcctacccagtccatgaggaacactctatccagggtctgtccaggggtactggctcctggtcttcaaaggggacccaatggcctctgagtgcacagaaatggggggacaccatgggaagttgctaagctgtagcaaagggagacttgctgtcacgtctgctgccccaagacctgagtggaccttgggaaccacagaaaaggggcttgggggtcaccacaggctggggatagtcacctctccagtaatccctgtctcgtgcatgtggcctgaggcttgtccagctgacattttcaccaggagaggaggctcactgcatccctgcctgccactctaacctacactccctgtagcctctctagctgctctggcctggccccagtaggcaaagccacattcagtggtcttcacccaaatgagctccttgctctcctttcatggtaaagggaagaagtgggatgtttttggctcacagccagtcatgcatcagccagtgtcacccataaaagcctcctctcagaattgccatggccaaggatactattggcatcaggtcattctaaccagacacgtcctgctaagtgacagcctttctttcttgttgcctcagtttccccatctgtaaaatggcgtttctggaaataggatggggaagagagatcacccagtttcttcttgtgctaaatccagaagtgagagtgaaatgttgtaggcttcacagaacacaggctatcattgaggttgggaagtttccacaaacagcctttgtggaggtgcagggcagagccacgtgatgtgatgattacaacacccaggggtggtgttcactgggtgacaaaaagctggtgctgaagtttctctccaaagactctttgcatctttgcttaagttgcctttttagctgcctgaatctagattgtggagagcctcaggaatgcctgccagggttgaattccacagtctgccctcagagaactcaggatactcatctgttaagtggatgtaagtcacactctttggagtctattttctcccttagataaaaaggaccaagcacattcttaacagctcaggtgttggtccatttcactgagcctgacaagcaagttgatctttctgggaaaggcctttgcttcttccggcctctgaggacctgggtccgcagcaggaggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttctggccccacagagtcttcactcgaggaagcccataatcccaccaaacattggcactgtgggggagcaggctatttggggctcactcagccaaatggcagggcttctgttgtcaccaacatctagtgggagtgcctcactccaggccccttttgtccctctaccccctctcttctttctcaattccccgaaaaatcaggaagtgaacagttgtctcccttgctggtctatattcatgtaattagtgctatttaattccacgatgagccaaagctcataaaatacaaaacatatttcagctgtgtgctgaaaatcttggcagaaatctccactgcagccggaagctgaacggagatatatttgctccttgaaaaaaaaaaaaaaaaaaaaaaaattcagaatgacggcaacaaagttttggggccaggcactactacctgagaatatgtaagggggtagcagaatagaggattttaggacataaagtttggaaataatctctatcaccatgacaacactaaatttaagaaatatttagtatagatcaagtaacaagtgtaatatatagtgtacatgccagaagaacatgtcatacatcataaggaggttgttttggtcccactcattccttactcccaagaattaacacgtgctttaaggatttgggtcccagtctccgagtcatcctgcctttcccattgggcacacacctgcaagtcaaatggccaagaagatgtgcagtttctggcaatgattccaaattaactaacacatcctcatctcccagctctttttcccctgacccctggactgtgatgaaacctcaccctatctctgtgtttgtgccagcaacacctgggcaaggaacaggaagtctcatccccttcctccccaacttcacaaaaccgggcacagaagggtgaagcaccggggactccatcctctcaggtgcccatgactgtaaagtagatgtgtcctcaacaagccgacctctacctctgaaatcaacaccaggtcctaacttgccagggctgctgacataacagattccctcccctggcacccctatgacttggtcatgccctcttcctttttcaggtgacaggaatacagaaaggagcatgttggtagagggcccagggcagggcctggcagaggggagattcatgttggatgctactgacatccccctttcaggacctgctcagaagctgtgtccatggggaaagagaggccatgaggtggactggggtgtgataaagggtcagatccactgcaagacccaggaggcctttcagtagactcagcagctcttctgaatccactctgtggatcagttccacggacacagacacagcatgctccatgcagaggggacaacacctgccagctcccactgccctcctactcttatgccacccaaaactccatcataaacacaaccatcaccacctctcattggtggaatgctttgccttctctaagctccttcataggcaataagccactcatggctccaaacatatatgaccaccccaacccaacccattaggattattgctgaggcatgactttggatgtcagagaatctcattaactttcccaaagtcatgcctttcctctctctatgcctcagatcttcagttgatccaatactttcctaataaactccaaagctggctgggtgtgttgactcacgcctgtaatcccagcactttaggatgccaaggcaggcagactgctgcttgagcccaggagttcgagattagcctgggcaatttggtgaagccccatttctacaaaaaatacaaaaattagccaggcatggtggcacatacctgcatttccagctactcaggaggctaaggcaggaagatcacttgtgcctaggaggcagaggttgcagcaagctgagattgtgccactgcactccagcctgggtggcagaggaagactctggctcaaaataaataaataaacaaaccccaaagccactcaccagagtcatcactggggattgtatagcaaaagtgggaagggaaatttgtctagaaggcccatgataaatgcacagatgttaactgggaagagagaaaagccttctgacttgttctggcctgtcaccttgataggccttgaaaacttgtgcacaatggagctcaaggaggtggcaccattgggcaagctctcgggggccaagggcttgtcagaagaaactaaccagcaggcagggaagatggcccatgtcttcatgcattcgttcaccaacacttattcagctccctagactctacaccgggaacctacattctgggggtgcagcaatgagtaagacaacaaggtttttggtctcacagagtttacatttaatagggaggatacacaataaacaagaaaaataactattttcagatagtgttaagacctaaaagaaaaaagaagcaaagtcatttgctacaagataactgttgcaagcgtgacctcagagagaccaaccctggcttctctagttggaatagccatggtttgtatctctgaggtgacacttgcagggggactgaatggccagggggagccagccatgcaaagatttgggagaggagctttctaggccaaaggaaatgtaaatgcaaagacactgaagcagacttggcaaggaaaaggcagaaggccgacgggctggaaggcccagaagagcacggaaggatgggtgatggggtgggagagaagagagacagcagatgccggagggtatattccaaatggcaggaaaagccatgaaaaacttctaagcaagggaatgacatggtcagggtctatggctagcaagctcagtctggctgctgtgtagagaatggtttttgggtggaagaggagttcactgaggagtgacagcagcctgactcaggtgacagtgtcagaaagcgagactggttgctccagcaggggttgctggtgatgtggaaacaaggggggcggaagagagggacttagtcacacctccttgatttttggattgaggatctgggtgggtgctggtaccatttaactgatatggggaaatcagggcagtggagcagagaaggcaagagttctttttaggatgtcaaaggtgaggttgtctagagggcccacctggcccaggttgatgctcaagagaacaatcaagggaggtgactcacagagaaccacactgtgtgttctgcggaaggcatctcatgtaaatgctcctaggaggatgctaatgtcatccttattctctggaagacaagctgattctcaataactacaacgaagtgaggctaagatatcaacctaaccctgcaaaaagccccatagagatgggggccttgtaactgtgacggcccctgggtagatgcagagattgtaccaagggtccttggctggaagaacgggatgtcaatgaaagaattttacttaggaacctagaatttgatgcttatttttttgtgaaggaagaactaccacagcaaaacttgattttaccaaagggaaattactgatgcttatgcagtacaggctactttataaacttcacaaattcccaaccaaagttaataacattaaaggattgaaaatggaaaaggggaaacagcattgatcatatacttcttagcaaggagccctctcttctctcaagtcataaagagtgccctgggttccccattatataaaacagtgaagggctaaaggccagcctgaaggaaattaggctgaaatcaaaataactcacactaagagcaagacttttttttgttgttgttgagatggagtctcactctgtcacccaggctggagtgcagtggcatgatctcggctcactacaacctctgcctcccgggttcatgccattctcctgcctcagcctcctgagtagctcggtgcccatcaccacgcccagctaattttttatatttttagtagagacggggtttcactgtgttagccaggatggtatcgatctcctgacctcgtgatccacccgcctcggcctcccaaagtcctgggattacaggcatgagccattgtgcctggcaagacttttttcaaaaaaaacatattaacatgtttaaaactcgtgataaaatatacattacataaaagttacaatcttcacaacttttaagcgtacagttcagtgacattaagtatacccatgtcatggtgcaaccatcactgccatccagagccatttcatctgcccaaactgaaaccctgtacccatcaaataccaactctccatcccctcaccccctgcccctgacaacctccattctacattctatgtctatgaatttaactatcctaggtatctcatatgagtgggatcatttagtatttttcctttgtgtctagctgctttcacctagcttaatgtcctcaaggttcattcatgtggtaacatgtagacaacatggtgtctttttgttttgtttttgagagactcggtctcgctgtcaccgaggctggcatgcagtggcataatcacggctcactgcagcctctaacacttggactcaaacaatcctcccacctcagccttctgggtagctgggacagcatgcacaggctgctacaccaggctaatttttaaaatttttgtagagttgattctcagtatattgcccaggctggtctcaaattcctggactccaacaatcctcccacctcagtctcacaaaatgctgggattacaggcatgaaagatggtttttaataaagatccattttgtggggggcaccagaaacttctgggttttaagtaactctggtttacagttgccagttcatggacacaggtgagaaagggaagacctagagaaaacttgtgaacaaatgcctgtcaagcctttttgggtgaaaacatgtccctttcaccaacctgcatctccagacccacaggattataataatatagcactgagaagaacaccagtccctcccaaggctctgccctgaaagggtcccctattaagcaagtatgagcaacactgcatcaccctcctggggagccatgatgcatgtcagctcactaaaagtcctcagaggtggtgctttgataagcaaacccatggaaggtttgtgaaacagggtttctcaaacttgtttgaccaaggaagtttttcttgcttaaaccctattatgacctctgggaacactgttccatggtacacaccttgggaaatgctggcatgttggtttccattcctcaaggcactttcacatctattttctcactgagtctttataaaaaccctgtcaagtaaattgagaaacttagagcaatttgcttcacttattgaaaagaaaacccaagctctcaagatttagtactggaaggaaaatctctaggtgaggagaagcaacgggtgcgagtggtatagactgcactccttgatattcccttcccaccaaaggctcatgcatggaacacattgcatcctccatcaccatggccccatggagacatagcagccctcccgttaatctcctggcagatgcctgcacgcctgtgacaactgccttctcctgatcctcttagcacagatgagagaggtcacaattttctcagattataagaaatctgacaggaaaacaaatgtagagaaaggaggaaggataaaatgagtctatcggaacaaagtgtaggtttcagtttcatcccctcctagctcattcccagactcaaaggccccgccaacccacacacccaaattgctgatttgacttctaaggtgccctgcctgaatggttcacttccttgctgcctgtagtgcatgtactcctggcgcccctgttggggctgctgttttatttggggataatgactcttctgtcctgccctatggggtaaggctatgcttgtgagggttggacatggcttctcaagaaggaggtgaacatttatggtggcagtcatccaggtggctctcaaataggtcactaggactgatggcacaccttcacaggtaggacagggccctcccatccctctttggtgcatagtcttcatgcctaaactttaaggggtcttgagggtctggctagtggtcaaagacagaccctgccccacggtggcacaatgggtgttaaacagggccactctacaagagacactgatgaagcaaaataaaccataacttggaaaccccattgacttgttatagtaactgtctctatttatttcacttttatcacccccaggccccgggttaaatcctgttaaatgtccagccttatgttagccatgctcttagaagttaatggacagttgtaaatccaaacttaggatgtagattattgggaagatgcattccgttctctggacccaatgtggccaaagctgcagttactggcagaagaaactgaaatctttagacaagagctgaggctgcaggacctcagcacctcctcaagtagacgttcttcctccattgccaagtctagagtctgagttttattttgctcagcaaggtaagagttaccttactgagaaaatcttgccatccacctctcaggagctactctcccagatacccaactgccttcaaaacttgtaggcattttaggcaggaattaccatccccattgagcagatgaggaaagtgaagtttaaagaggctaaatgcctttctccacgtcgtagagattttcccaggaaactacagtgagtaagggcagcacaatgtgtcacagtgtgaaacagactcaaaaaaaaaaaaaaaaaaaaaaagaattggaaagaaatgaagcaacctctagtgaacggactaacaagattcagtccaaagtgaaaaatcaatgacgcaaaggctcagcctgcaaaaatcgatgaggcaacggaccaataacctgtattcccagctgaattgacacccgactgcattacagtcatatttgtatttgcccagacctattccccatgccacctgccagcatactgcccacatgccagactcaacctccacgcacgtgcccacctgatccaatctgaagagcatcttccaacagccctgagaggtaactgatagagcctgcacacagaggcacgagaacagagcccctggaacaaggagataaggtgaccttctgagagttaatttagtaacaatcaagacatctgcatggaagcaccagatatctgcagaaaccaccttacaagggcaaggtgtccccaggtctccactgaaaaagcagggaagtgaagcccaatcagggtgacaaggtttcttccccaggacaagaatataacttaagaaggctataatctaaacagcttgaataaagaaggtattaaccaactcgggatggtcggctcggagaacagagtaagcagcatgagtgcttggtttttaatctcatgccagccagggagggagagttgtggttgactcaccaggaaggtgaactcccaggaggcgcagcagttggacacgaggcttctccatggtgcggactacattgttctcaagaacacccagcctcctagtcccgatccatgctcccccaaggagcagccaacccaccaatgtgtctttcttactggaatattcccaactgtattcaggagttcaccctccacacatggccgcaccccagaagcaggcagccatgattggaataagccaatgattcccagcatcaaccaacagctgtgattggattaagccagtcatgctggtctccttctccctgccagtgatgagtttaggaacagccatgccacccaagcctgatgaatgggactgaatgagaagcctgccaggggcttcaggaatataatttttttgctctttaaaagagactcatgtgagggagcacctctcttccttacttgtccacctgtttacaatgcctggaactgtggcagacttcttgtgcccatgagagaggcaccactgatgtgcctgcaatggctgaacagagagaagggaagtgccaggagtaggatgatgcaggggagctgctgaatgaccagttttagagccgcccaacttgggtcttcttgtgtgaggccaccattcacttatggttcacactattactgggtcctaccagaaggcgaaagcatctcactgactcacccagtaatccctcaggctacagctgtgctcgctgatgatactttgctgccatgaagactatgaagggtgtctaggacagcaacagccattctttcattagctggataagagcagactccagcaatgaataagatggcattttatcttaaatatcaatatccttgggactagaatgagttagtcctgagaatctgttcatctctgggtacacacaccagcaaagccagccccagtccataataaccccaccctggaaggccctacctggcagccactggctgcctcccattgcaggttggtgtcaccttgtttaacagcaatcaaagggaataacagaaatagcagaaaacacctgctaccttctcatccccactctacctcatatctcctcaaatcctccctactctgcatacttattttcatgtctttagatgagctatatctttcttacccacctcgtggcattttggaaagaataaaattaaatcaatatcaaaaatacaaggtgttacagaaatcatggaatttgggacatgaaggctgtgttgaaaatcttttcaacttactatgcattggattcactgggaaagtttttttaaaaacacagatttcagcaccccacccccagtaactctggtctaaagggtctagggcagacatcaatattttttaaaagcttcccaaataggtattcttttttttttttttttgagacggagtcttgctccgtcgcccaggctggagtgcagtggtgcgatctcggctcactgcaagctccacctcctgggtccatgtcattctcctgcctcagcctcccaagtagctgggactacaggtgcctgccaccatgcccggctaattttttgtatttttagtagagacggggtttcaccatgttagccaggatggtctcgatctccagacctcgtgatccgcctgcctcggcctcccaaagtgctgggattacaggcgtgagccaccgcgcctggcccccctaatggatattcttatatgcagccagagtggatgagaaccactgataggcaaaccctgtcacgtgcagatgaggaagcagtcccagggttcaaaatcacgcatctgctggaaagaaagccagggcccttggggtctgatctcttgagccccagactgggtatcttttcatcatgcttctgtgtcaactccagggtatttagatcattattattaatagacagagagaggaagcacaggaggaagactcaccaagggccatgaggaaacttctagggatgatggatatgctcattaccttgattatagtgatggcttcacaggtcaaaacttattcaactgtctaaacatgcagtttatggaatatcaattatatctcaacaaaactgtatttaaaaatagacccaaaaggtaacaaacataaagagacaacatatttgcaaatcaactatctgataagagtctaatatccagaatatataaagaatttctacaactcaacaacaaacagataaaccagtttgaaaatgagcaaatgacttaaagagatgtttctccaaagaagatatataaatggtcaatctgcatttcattagccattagggaaatgcaaatcaaaactacaacaaaatacaatttcacatccactagaatggctataatcaagaaaacagaaagtaacaagtattggtgaagatgtggaaaaatgggaactcttggatactgctggtgaaagtgtaaaatggtttattcagctactgtggaaaactatttgatggttcctcaaaaagctaaacatagaattaccacatgatccagcaattccactcctaagtatattccaaaacagaaattcagacagatatttgtacaacaatgttcattgcagacaacgttcaagagttaaaagatagaaacaacccaagtgtccatcaacagatgaaccaagaaacaaaatgtgatatatccttacaatggaatattattcggccatataaagaatgaagttttgatatgtctaaatgaatgaaccttaaaaatattatgctaagtgaaataagccagacataaaaggacaaatattgtaagaatctacttatctgaatctcaagaataggcaaattcctacacagaaagtagaacagcggttacccagagctgggaggagaagagaatggggagttattaatggcaacagagtttcagttggggaagatgacaaagttctgcagatggatgacaactttagttacacaacatcatgagtgtaattaatgccactgaattttacgcttaaaatggttaaaatggaaaattttatgttttatgtactctaccaccacaagaatttttaaatacagacacactgtagtcctctgccatccaactctcacaattactgtctgtatttgtaaaacatgttacagattaattaataacaaggaaaaggcttatgaaactataatgcactaagaactctacatgaattacctattctatttctcttaatagtctataaggtagatattattatgatctttattttatagacaagaaaactgagtcacagagagcaggaaatctgtcccagaccacaaagttagtatgtaatagaatagtgtttttcatctggtaacttcctagaaatgcaaattctcagacttcactccagacctaaggaagctgtgtttagacaagactgccaggtgattctgaggcatggtcaagttttagaaccgctgtaatagagccaaaatcgagttcagttaagaacctgaactttcgagtgctgtgacaagcagcagtcattcttaacaaagagcagtggttctctcacttaacgatgcatcagaatcacctgagtgcattcttgcctggagtgattctcacctggagcccatcttgagtaggctgatttggtgggtcttgggaagggcttggtaatttgcattcttaacaagtttccaggtaacactcatagcccagggaggacactttgagaatcactaatatacagaatctcattattatccacattttacagatgcggtaactcaaaatccgacattgtaaatcctagaaccacaaaaggggttagttattggctgggcctagagcctcagtccaaagtttttttcactacagcataaagccatcaccccagtgttccagatgcttccaggtgtcaacttggcacaacctcccttaaagccaacacaggttgaagacataaaagacgtttttacccattccaacaaactggcattagagtgatctaaaaaactaactggcacttgtgccaaagaaacgcagtaagaagacagaaaaaggaagggacaataataactagagcctagtttgggggtcaggactctgtcacagtggaatctaaaacctgaccatgcttcagaatcacttggtggccttttataaacacaggttccacaggtctggagtgggacatgagagtttgcatttctagaaagtttccaggtacaaatgcgttgatgcagttgggaagaactagaatatgggtcacttcctctttattcttatgaaatcagttgcctcttatgtaagtgaaagaaaattttctttcctgccttgtttgaaaaaatatgacatcataccatcctttatgcacaatgcattatccttcatatgttttattaccatcacctgtaatgttctatacatctccagattctcctctttccaaaccatttgtcgtctctgatcatgctactctgctactcgagaatcttcgatggctccctattgcctacacagtgagggacagacttagcattgtattcaaagacctccatcatctgacttcatggtttccactctaatagaactactctctattgcccatgcatgtcctgtgctttcctgttgtcatgccttcacccagttgttccctttacctaagattcctttttcctccttccttccccatctctacacttacaaatgtgacctgagactaactatttattccctctaggcctcagttttcttaagcataaaacagagatgacagtaggatcttccttgtaggttgtgatgaggaataagtagagcaatcagtggaactggttgccaccaccacaaatccctcctaacttccaaaccgaagggatttctgtccttcctttaatttccagaataatagaacctgtatacacattatcattatcatgttctactttgcacttgccataatgtttatacctgtattccctttgcagctaaggaaaccccattaaggtgaagatatgcttcttattttcagttgcatgcacagtactcagcacagtataaacacccactcaaagtaggaggaacaaatgatcaggactgttttaccttaaattgcttcctagagctgcccttgcagtgctctgaggtcccatcataggtagccaaatccttgggtggaacataaactcaggaactggagaggtgcaaggcccccaacatgaaaagaattaacttgtctccagacatcacctgttcaaagggttccctggaatccacagaggccagccttagcccaattttccaacccaagcaccttctaataattcaaggattcccatccacatcaggactcccctgtgcttacttaaaacaaaaaaccttggctccacaagaaaaccatttttctctatttgatgctctgggcctctgttctccttttgctctgctagtctaagaaactgcagctgccctgcccacctcggggagctctgatcagtggaagccgggcttcttgagcacacagcctgcaggaccagagagctctgctctcccttctgtgcctgctgccagcacccagcccttcctcccttcaccgcccatcttggagccatcacctatcccacactaacccacctccttgaacaaggccacctcatcctctcatcttagaaccaagaactctggtttgggaccacttcccacagaaccagacccctgtggggttgctctaaaggacagaataaggatattactattattattattattattattactattattatgttaacaagtcaccaggcaacaaaggcaatgagattcaaagacattccttggtggctgagtgaaggctgaagaaagggaaataaaatggttgctttatgagaactcccaaggccagcaaagaggaagaaaagaaaaaaggccagtgaagaagaagccgcagcttgagtgtgtgtagtagtaaagaggagaggggaacaggaattcacactgaaacagaaagccggtcagcttcaacaaggagaggatacaagactacttggctggaacagggatacctggtgagaaatccaatcagcaattccagatcttccctgactctgctccaagtctccccaagtcaccagccccagggccaccgcccctactaactacttccaccattagaccccctcccctctgtgagagggcccatgaaacagcagcaacttccaagtgagaggagccaagtgagagacctgaggttccttccaccccagccctccctaccctggcgtccacatatctaagcctgatgcagagaccgagaatctggctccaggggccctgtccacgggtgcctgcccgtgagtgttgtgtgtgcatagattctgtagtggcggaatggggtgaggaggcacaaagagcctctagcctgagagcagccgggagctggagcaaataggatggacactgggttggctggcactcaaagccttttattttagtagtctccaaaagaagggctatggaaagaaaatactagaacttctatttaaatctatttgtacctcaaaagactgaaacataacagctctactaatatttgatatgaagaatgggcgccattactgggcgtgttgaggggcatggatcttacaggtgcctgagagcagatggcaccatgatgctgaggctgacacggcgcccccattccttaacctgccacagtatttagcaagatatgacagtatacctgagccaattcaggaaacttacgatttactgtgttatttcacttcaataatccagtgttttaaaaactaggcaagtggctttaaggccttcctatcaggagaatatggatagaaaataacacataaataatgcaggcactggtaatcaataagaaaatgaagatgtgatccttccacacctagtatagatcttcatcatccatattacaagctgcaggaccaacttatcagaccagaaatcaacccgtctccaaataaaaaagaaatcaaaactatgaagactattttgatatctggatttatgttcaccatcattaatgatgaacctcccaatgagcgctgatttacttacagacaatgcccaatggatgggggcacatgccaaaaacatcagagaccaaacgtcattccccaactttgttgagggttctcctggcttgcagaggcagaggaggggctgtggtctggttggtgggtttccatgggagaacagcaagagggggccacactcaggaacctcaagacccagcccttggtaacggccttttgtggctgaggccaatgagcgtatctcccctcctaccctcttcctcatatcagctgcagagttggggctccagaggaaaggaaaggggtcccttggtattcaggaccctgattcatctcatttacctcgatggcagccgccccatagcccacacctcactgtcccaccaattcactaagaaagccaaaaggaaagtgtgaccccgagagaatagaacccaggtccttttgttcccaggctcatgcattataccttggccaagatcccctctgcaggccacacaggcaggatcttttcccgatgattgaaaaatcaaggcatcttcccctgcaccaataggagctaattacagagaacttgccacaggccaggcacgtggctgaacacttgacccccatcatctccattaatccccaccacaaccctacaaggtaggtcttattacctattagacagagggaaaaactggggtttacagagagtagatcattttaaaggctgcagcccagactcaaagccaggctccagaatctctgctcccacctctctcctgcttcccacagcaattgggcatgccaaacttggagaaaaacttaccttcgtcttatgaccttggacgagttactctctgaacctcggaccctcgtgcataaaatggggttataataggacatactgcattgggcttttgtgaagattaaatgagttaataagtgtaaatgcttcaaacagtgctgcacacatagtagctgctgtattggtgtttgcggttattattgccatcatgactgtgttacattgttctccctagtaagttcagtttttcttcccgtcgttccctataagtgactaatttttatccttttatcctagtcttgatccttgcaacagaccaagggagaagttgtgcattacagaggacaaagactaaattcccctccctaagcctacctccacctctgcatgcaccccactgacacatagaggtctcaacaaatagaacgacgacctcagtggtgcagaaggaaggagaaggaggcttctgaacaaggcttccttcagcccctgcagggcccccatgtggcaccgccaagcttctcctctgagcaaacctgccagatataggctgatctaccagggctccagacacctggagattaattagaaggccagtccttgggcaaatcagcccagaggaccagccacaaggagctgcagagagaggctggtaggctgtaatcctagagccagccacggagctatgcctggtccagcagctatggcagtggcagcaactcatacaccacccctaagcgaggaaatgctgccctaaacgtatggctgacttttacaagtcgaaggtcccaactccaggaagttagggcagaaagagacagtcatgaggaaagtatttctgaagaaaagcagattattttgagcacgaactgctgagtccccactctgtgtcagcctctgcttcttgccaaggagtgttgctaagctgatcttcctcccaggagcattaggctgatttaaaagatggcaaggaagcaagcaactagagaagtccgggaagccttgaagcgacaggttacgtataaactgcacttgggggctgctgcctggaggagcgagctttctttctggattcttccaaagggcagaagcagggcctgcaagtggaggtcagaagacagagatcttgatcctgtctgagaccacgccgtccacagggccagcctggcaatgggtcaagctaccccagacatatccaggcagcagccaggtgtccttttcgtgtgcaccagactcccctctaaggcaggaggttggagcaagcaatgcctaaaatgagctcttggctgtgtctggcacctaccaagcacgacaaatgaaaactttggtggaattaacaatctaatgataagatttggtggttcttttttggcctgacacaatgaaagtagcctcttaggaagaagccttaatcctctaagtccatacattgccctgaaggggccattttcagcacccaagttcctatttcaaaaaagttaagatgtgctttaagggctttagctaggattctctagttagagacaaacaccagaagcagaactgcagggtgtctcgggactgaggcacatgtgcctgaccagacccggaagagggtgggaggcatctactcaacatgctctactgtgctgcatggaagtgggagtgaggaaggccagacaggaagagagaagtgaagccaggccctctgagagtgaggtgtcaaattcacaatgacagcaaagcctctggtaagaatgggagctgggaaattcttaaaaaaagaaagtctttatctagatcaagcccttcctcaagccatgaccttctgttgtcaatttcatggagaagtgcacgggcagtgggggccaccacaacccgcacgctcagcctggacacacagcctgggatcatttatcaaaccagcagaggggaaaatcccccagcacagagcaactcctctgcaaaatgtagagcttcgctgatcctgcccgaccccaaacctgctcacatttcaagtcctccaagaaaaggatcagacaatcgctgtcctctcttgcttccccttctccagtcctcccaatgctgccacccacatggaggagaaatgtgtaccaggcttgcagacacagggtggcagtggagcccttgcctgcttccacgagcacctgcaccaccttcctctcatgagcccagagacatgtcagtgtccacacagcagcccagcaagagaggaaaggagtcctggtgctcccgaagcggagacactcgggccccatgaagttatatgatcagcacaaatgcaccggcaaggtcttaggcagaggcagtctgaagcctggagcatcaccagcttcacaggaagggaatacctgcttccaggcaaggtgaatggaactgaagtgtccccaccgtcaggaattcagacagagcaagcaccaagattgtaagtgagcattactgcaaaagcattaaagttgggggctatacctaaggctgccctggactccaggcctggctctgttatttgctcattgtgtaaacctttgaaatttctgaatctctcaaacttactttatctataaaatggatttcaaaaatagaatccatccctcacaactataaggtgtttagcatctgcccctgcacatgataagcagtgggtatcatattatggctggaagcaccttcaggccaggagagccaggatgctgtaggctgctgccgcaccccttgtccattatctcccggcttcccacactttgattccagctgctgccatcatgaccaaccagaggcagaccttgttcccctcctaacatcctgccctaagcacgagggaaagaaaatccctttccttggctcctctttgaccaagttgacattgtgaaaagcagagaatgaaaatctgatagtcacagaaaacacaaacacagtagaaataattaaagctcctgaatacaggtttcagatcctgtaataactcacatcttctatgactttttaacatcccagcccctgcctgtttccctgtgactgctgccaccctctcaccctccttgctcttctctctccctgctacaaggccccaggacctattgtgcctacttaggatcctgcctctccatcccagggctgtgggacacagggagtctcaagagattgacagtggagtacaacccaagtgagactctgtccctgccacaaagaccgtgccctgtccaaggccacgtagagccatacaatatcccttgatgagtgtgctgtgtgtacatggggagagggacagaccctccacctgtcttcccagagctcacaatacattccaaattaccggcagttacgaattggagggctccagtcagtggttctcaagttgcaattggtccccagagcagcaacacctgggaacttatcagaaatgtaaatctcaggcctgcttcagacctacaaaatcagaaactctgtagctgggttccagcaatctgatttttccaagccctccaggaagctctgaagcacactgaagtttgaaaagccactgacctgttatagtccggctagctgcacaaccttgagtaatacacttaagtctttccatctgtaaggtgggaccaaaaccagtttcatcatgtgttaagtgggaatgatgatggaacctatttcacagggttgttggttacaaagattaaataagaccctgcatagaatgtgcttagcaaattgtaagcactcataaatatttgctaatattgatcttcctaaaaacctaagagatgagttcttccacgatcactaggcaactatcaaggatctcagtgaaggcttagagagtttttgaaaggaatcgttcaaggtcactcagctatcaaagatatcttaatagccattccccagagaacagagcagtgttaactgaaggcaaggtgttaacaatgcctttccttctctctgacttgcaaaaggtctcctctggggccatttcccttccccgtgggcatctagaaatgtatggaggctttgtggttgactgagtgctcttggcttttaggatccagagggtcagggatgctcctcttgcactgtgtaagatggctctgcataatgaagaagcatcctacttacaatgccagtgacatctccactgagaaacactgatcaacccagagtttcggagctatccagagcatgcagcatgtctctgcctagagaatacgctaaacaatcacaacaattgctgtggagggctggacgtctcatgggacacgtctcctgctcaagtcctactgtggatgttgcgagggccagctctcactctagacatttcattgtcttatttaacatgcaattgcttcaaatctcatttaacatgcaattgcttcaattgccctagctccaatcaccccttcccaaacctgggctagatctccagctccgtgggcccaggcaaacattttccaacacggtgttagtaggaattccccaaatttccccaaagttcatacaggaaatggatgttggctcaagagagcagaaggtgtagtgtggaccgttctttttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggtgtttcaccttgttagccaggatggtctcgatctcctgacctcatgatccacccgcctcggcctcccaaagtgctgggattacaggcgtgagccaccgcgcccggcctggaccgttcttaaaaactttgtgctatttattatttgttactcagaaagggagacggaggtaaggatgagaggagaatgttggtactgttcagaaacttaacaatcctggctgtcaaaaatgccaggagtgaatgtaatcagtagaatcaataaagatttatttcaaaggattcccaaggaaaaagtgccagacagagagccagaggggagaaaagtaacagcagcacacaaaagcatgcacgattcacaggtttcccgaagcactggatgaaatgtggcttggatgaagttggccatttcccctaacttaacacctctcttcccatacatagcccctttccctagagactcctacctagtgctttcaccagcttccccctccccataagagtagcaactgactgtgctaaaatgttccttgccccacaaaccattaagctgtcaagctgagttggtgaacaaacccagagagagccggtgctgctggaatgctaacggtgaaaaccgcaattattctttctgctctggacaattcctgcttcaactttactggccccaggtcatattttgtgatctttggatgctgatggaagagagacggcttgatagagaaaataaccagggagattatgtcttgatagagatggaagtaactagtagaggttttttcgttgttttccttttgacatccacataggtgtcatataatggcttctggttataaagccccctatccaaaggaaaaacaacttctccataaataccttgcccacgtcagtgaaatagctgtgttacacacttgagcaccattttcgaggacactttaaatagagcatgggttgctgctttcaatttaacgtgtgaacaggagctgctaaggcaggcagagatgataagttgtggggatgggctcagtttccattggtgcatctgctcagattctaacagatccgcaggcatttaaggcatctcagggacaagccaggtaagccacgtgagagactcactcaacaaatgaatgaacacctactatgcatgagtaaaaccagatgcgaatcacttcctctagatgaaatgggctttacatacaaattataacagttccaggaaaatctaatatatgtttagaagaagaggtgctttaaaaaaaatgaaataggtggtacatgacaggtaaaatactagacaagttcagaggagaggtgggtggtctctgtgttttcttgtgtaacaacctctactgagttttatgagaattaaaagaaataatacatgactggtgcccaggacagtgcctggaactaagtaagcacttgataatgatagcagtagtcaaacaagtaggattaatatggttgacattaagtttttactgataattttaattataaatccagttggaggtaaagacaggaggattatcagataaagcttggtaaataatgggtaacatctggacagatgaagatgagggcgtgggggaatagtataggccaaggtacagatgcaagaaaattaaagacttgctcaggaaataacaaatactacaatgtgtcttcaattttctatgtttgtactgtgacaggtctgaatgtagatttcttatttaacctgcttagagtttacagaccttcttgaatctctgtattgatattttctccttgttttagaaaattcatagccattacctcttcaaataatacttcttcattttttttctttctttgtagaaatccaattagatagataagactattctcactgtatcctcgatgtctcttacctaagttttctgtatttattatacttcattttggatgatttcatttgcccactgccctacttcattaattatctcttcagctatttctaaattatttaaaatacatccattgaattcttaatttcagttgctgtattttttcagttccaggatttctttttggttcttgtttgaaatctactatgtcatttttatagtttctagtttgctgccaaaacttgtaatcttgtcttatttctacttgaaaaatagtaagcatggttattttaaatccatggtctgataattgcactggaaattatccaggaaacctgtgagtctattatttctgctggttctcggtcatgttgacttatttccttgtgtgtcagcttatctttgattacatgctggacattgtattcaaagatttatttgtagaaataatacaatgactaggataaggtatcttcctccagatagtattgtttgcttctaccaggtaactgacttgcaacatagtgtaacattaatcccatttcagaaattgtcatttttcttagctactcaagggattcaaagcctgacttcacaacttgcaaaggctggtttacttgtagttccaacccaaaatgttcccatgcttaataggccctggactccagcttgtgtcctgtaatgccctgatgctgtcaaatgcattgcttagaccctcggctgcctctttagaagccagcaaaagtctaatccctctgattagttaacctcttgatttccagcttcttccaaaatttggccctatcaatatttaccaccttactagctttcatatgtcttcaagcatgcttttgaaaatatcttctccactttctgaatttttatcagtaggaaggtcagtcaattgaattagctagtctgcctttactagaagcaaaaacctcccagctggtatttgatttgactggaacattggatttacttttgggaggaaataaaagataaacccaaacaataggccagttccaaaacatggataaacttgaatgctaggctaaaaaggaaggatctttaataagcgatggggagccattgaagattctcaagcaaaggagttctccttgggagctatacttgaggaagatgaattggacacttacgtgccaaactgattagaggggcatgagaccaaaatcaggaaggagagttgactccttttatcaaactttcagagaagaaggcaaactatctgagctagggctatggtggtggcaacactaggaagacagagacagatgggaagtacagggttatttcatgagtgaggcacaccaactagaagatggtaacagaaatcagaatatggaaagaaaaccagatgaaggacagagggagaaaagtaaaatgatatgatttgcccattaactgagagtgggattgaaagagaaagaagaatcaaagatgatattgaggttttgaacatgggtagctcagacaagggaaagagattatgagggctaagccacaacccacccatcctctttttagtcatgagacagctcaaagaaaagatctgtttcaagtaagtgacagtggccactctccaacccaaaaccctcccagaggagagatgatttcatatgagaatagagaacctacccatggtgtcactacaatcaggcaggtgggacaacctcttggagagtcagagagcaacccattttgtgatattagagattctctaagtgaaattggctgacagcacaattcccgttttggggaaggagaaagctcccagagccacttgttagtaacagaggtcctggagcattggattacaagccaggaagttccatagaaaagaaggagcacacagaaatagacttaagtgtgcagagggtgaggggggcacaccctgtcactatgtgacaggtgatccatgggggcttctaggattctcactattggttctactgagtgatgaaaaggtgcccattagggttaacttcccaggtttttaggtagggtccgaatggagtggaaatgtaaacctttaaataattatggctttcttggcctagatgtctgtcatgcactacagatattttttcctcccttccatgtgtatgagtgaatatcaaaagtaggtacctgtaaaaaataaaaatagaaaactttcactttcattgcaaagatcttggagatgaaataaaataaaagtaaaatgtaacttgggaaagggctatataaatttcacaaataaatgactgaggttgacattgatctgaactggacctgtgctacaatagaggggactagtacagccacaccaggcaaagctctccacacaacctgtttgcttttcattttcttattgtctacaccaaatcaataagatctgcaaaaagcaaatgtagcaaatgtattttttttctccctattctgtaccaggactcctctccggcttcagacctggaatttaacaggatgaccacccctcccccagtgtcctctgtgctcctattgtctgccccaagaaagctcctactaattctctcaaaaggaccttacctcctgcagttacttcacatgctcctgtgggcagctttaatttatcccagtggaagtcaagatgtaggtttgtgtagaggcctgggaaacctatcaaaggagaatgaggttgaacaaaaacatcccagggatagactctcagctccctgtgggttgggccatgtttgccactcacactgaacccccagcacctggcacaatacctagctcataaaaaaacacactataaatacttgttgaattgttgaactgagagagctgggatgagaaaaacaagccaggcatcactttcttgtcaaataatccttgtacatttgccacccaaaggcagggcaatgggttgacccaaggtttttctttcatgaaacagccccaaagagaatcctccctataaatgtgctcattttttctctccaaatgcctttattccagaagaaagcaaaacagtgagtggatgactttcatttgttttttgcaggaaaagaaaaaaaaaatgaggattaagaaaatttggaactaaggtgttaagaagtgtaatagggtagaggaggctaagaaaaaccagtgttgctgtagtagggagaggtttgactgactgactgacaccatccaccacaaagtcatcaggcacctgcgggcctggaccctgcaggaggtggctgggtgtattcctgctgactgataggataactatgcacattcaaggctaagaagaggaccagcagttgccaaccaacccccaaaactgaccagtgctgagtagtcagtcacctttgataaccacaatcatcattagtgagtccaacaggggactggctttaacaccaacccaaatgctcagaagggtgcatttgactagcttgacctacatctggttcccctctgtgatgttttggccatcacccaagtacttgggatctttgtctctagctagagcttcaggaatagtagctcacctactcctaaaactaatcttcagaatgaaaaacaatggcagcactgcagaaaaagggctaggatgtggaaatgcaggaatagatgcttccaggaccacaaaaaatgcagcatctaagaaaggacaagtattagggatccctttcatatggtcttgatcttccctcctgctttgacagttttagtgggttaaatatgctaccctgttgggaggtaggaactgagagactaaaaatcccaatgcaccagtaaaatttttttaagtccagagaaagtagaactctggtgaaagccatttgtaagcatatctccagaatctaatatatctgtgtggccaaaaacagtgggcactgttaattcacaaccagacactcactgagactcaggaacagaagggggcaggtgctggtaatcccttgagtgctaagcttttttaataatacactggagagcagaggggagaagaaacagcattaatggaaatgattgaaacaaatgccccactagtggacagtgatcttgttttgggcttacaaaactgattgattatcagatccaccttaagcctcccttttgagaaggttctccatccccacccttgctcctaacacccttgtcgattctggttacatcagtctggaacaagggcagggactttgtaactttcaaaagttcctcaggtgaatctgaggacaaacaaggcttaggaatcatgggtccaacccatgagattcacaaaatgaaaatatgcaagtcaaatgccaaactggcccatctggtttcactattccaggaaagggagcccaaaaggatgctaatttgttacaagtggcctgaaaaatacatctatgttttaaatacttcctctcttgaaatagtaaactgaattacagcaagctagctccatggtgatattttccctgattccagttcacagagagaatttaaagtgaaaaatccttttcaaaaggaagatacaataggctgtgctcttcaatgatgcttgctctgggcccagtactgatgctgaccacttcacacacgtcatctcacgtaatctgtaaggaaggcatcatcacccccatcttacaaatgaagtcactgtctcagggagatttaagtacatttgcccaaactacaaactggtgggatgtgaattgaactttaatctgatttcggagtctttaccttgaagtctatacagtatgttgctttcttaaacccccccacacctacatctctgcttcagtttctaggtctttgtatgtcacttaacaagcatcccctccatgccaatgtggttgcacccatttcttcgctagggtgctcctgaatgcatgcaggcatgggtaagtgtatagtgagtagtaggagtcaagacaagaggctgggagctgtctggggctcctcctgggatctcctggtggggtgcagaactattccagggattccaactctggcctactgtacagaagaatcaagggacagacattccaacagccaggcaaaccagaaccacagagaaaacagggaggcagtcaaagccatcaggaccccacaaatatacccaccaggagaatcaaatcagggtctgcggaggcaacaagagagtttgttggtggcctagatttttactctttggaccactctgtatttcagcttcacgcagcagcttgcaaaagagccctggggatggcaagaaagcagaaagcacctctctttgtagccacaactacagatcccaagaccactatgaccaaattaggacagaaagccttcagtgacgcacacacaggccctggggagtctgaacacgagtagatctaatgctgttgaacaaaacgtgaaaccgaagaaaacacccagccacacagagccctttgaattggtggcttcactccagggctgcaagtggggagagagtgaaaagagacaaagcctggctttggaaagtctcaaaagagtttctaggaatgccacgtcccaaatcctgtggggtttgtgaggggtttggagagtcctgcttgttgaaaagcacttagttgtcatagtagaaagtggagttctagactcccctagccctcattacaaatcaatgagtagagtttaattctaattgtgagatgactgagaaaggatttttatgataagcagatgaggctagggcaatttcaagtgcaagtaaggtctttatttattggctttttaaaaaatgtcccaccattttgtatgtatttgggggttttgcttgtggagagagcccaggagtgggacatggaggtagacaacactgataacagtgagagacgctgccaggcagtctgagttctctgttcctagccctgggccaagagaaatgtgctctgacccaaggttaggcatgttctcacccaagaccaagaccaaggattctcctaaacattccaataaatacccaacgtagcttttaaaccttaatctgttatttcctagtttgcagagtaaaatataccctgtcagaagtgtttgaaccagagtgactccatcttgaataggggatgggtaaaatgaggctgagtcctactgggctacattcccagaaggttaggcattcttagtcacaggatgagatatgggttggcacaagatacaggtcataaagaccttgctgataaaacaggatgtggtgaagaagctggccaaaactcaccaaaaccaagacggtgatgaaagtgacctcgggtcgtccccactgctcattatatgctaattataatacagtatcatggtaaaagacactcaggccagcaccatgacagtttacaaatgccatggcaacatccacaagtttccctatatggtctaaaaaatggaggaaccctcagttctgggaaatctctgccccttttctggaaatctcatgaataatccacccctcgtttagcatataatccagaaacaactgtaagtatactccatcaagcagctcatcctgctgctctgcctatggagtagccatttttttactcctttactttcttaataaacttgcgtttgctttactttatggacttgccctgaattcttttcttgtgtgaggtccaagaaaactctgttggggtctggatcaggatgcttttctggtaaggcccctatcatcatcccacctaagaaaacaggaatcccagggaacctaatttcccctcgtacaaaatatttattaactactcacacccttgaggtgtcttggtaggaactgaaccacttagttcagacattggaagtgattccaaacttggctactcatgagaatcacctagggaacttaaaaaaaatcctgggtcccaaccctggtgatgctgacacatttgggccctcccaagatttttgaaagctggaaccatcaatgcaggaaaaaccttaaaagtgagtggaccctaaaatcttcctgggggcagatttccgtgcttctgggagggtcatttccctgagtcattaccctccttagtgttctggaaaatggcaaagtacatcaaatgcagggaggattcctcagcagtcatgacaattgctatttgggttaagttactgctacatctttaatattcccttggggtgagttgtttgtttgtttgtttgtttggggagcagcatgggggctaggatttttttcttaaaatgactttagaatgctcagcttatttttgtggatgggcagacaagttataattcaaaccacagtttgaacattaggtagagagaggtagagttatagtttgaaaattaggcagaagaagacagcacaggtgggtgagatcctcactttacaagaaggtggaggctgagcccaggatccagttgcagtttggagcaccaacccagactttggggttggaaccttgttctgctgtggctgttctgtgggttctataaggctagggctataccccacctgctgcccaagggtaaggtttaccctgaaggaagtgaacgttccctaggaagacaatgaaggctggaatgtgggtcttcattgcaactcagagtacccctgacccccacagcatggtggtgagcctgcccttcctctagggagcaggatgcccaggagtggggcatgaggcacccacaagtgaggacaggtctaagcctggagatgcctacagtggctaccttttgaagaagtgttaagttactctctgtgtttcctttattacccttgatccatcaaaaaaagttgtattcagacatacagcctgatctctttgtgctggaaggaatctggggaaggacctcttccaggctaggattaacagggagaatagcaatgagagggaggggtcagcatttcttcagctgcaggaggcaattagtagacacttaaagaggatctgagcacagctcagctaatttaaaaaatcagcataatttgagttttaaccaaaatatgactttattttgtatttgcaaggcaccaaggtctgctatacacaattaacctcccctgtcctcccctccctcaaggcttctgtctgacagactcagcgggaggaggaaaggaagagtccagctcctctgctgctgatgaccctaatagtcctcctaccccactgggctgcaatgaccacatctgcacctatagtccctcatccaatttgggacttattgcagtgcagaccttaatcctggtctctccctgacctcctggccactcacacacccagtatatctccatgctgtcccatagacacttcaaacccagctcctcaaaaacaagccccacctcttccttctcctgcattctctccctttgctagagcacaagcacccactcggtcctccgtgcccctcagctgcctcatctaattctcaccaagacccacttctgggcctctgccttcccttccacttagtacctcaggcccagtcctcatcatttctcccttggaccacagcagcagcctcctgacaattccccaacactcaaagtgcagtcctggcatgccgaacttggagacagcgagcttaggtgcacacccaggtccccagagcactcagcagctttcttcacacattttctcttcccttctctcttgaccagatacagaagagccagtgggaaattgagaagcccttaacaggatggtggagccacaacatggaaggaacctgggctcctgaatgactgtatggagcaaaatccccccacatactaacccatattgaactgtggtggtttgttacagaattaaccagccatgattaatagtgagcaactcaagaacaaaaagaacaaacctataatagaaaagcaatgcttttccattcacaaacctttcattacaaaatgccggtcgtgtcctacagccagagtagtgagtatacctcgctggaggctgcaagggccagccagtccccatacacaatcagagctctctgcaaaagacgtaataccaccagccctgtactgtactctctcaattgccctctagtttccccaccccaatattgcagtgtctatgatcactgaaggaaaatgaaatatgattctaggtgtcacctttcaaagggtgttagtgactgtcagctaaagtgatttaagccccggaaaaacctctgtgtccttttaacatccaaaactaatcctcttcacaccagacatcgatgttaaataaacagagatttccattaacctacacctctgtacatctatttttaaaaagcggtgtcactctcctttaaatgaacatactaattagtgtattaataaatagctgaatggaatcaatgagacatgtaatcaaggtctgaccaggagtcagggccaggttgaagggggtggggggaaggagaggagggaaaagaatcttattagcaggtttgctgaggagggacatgtaaaatcaatgctgcacatgcagccaagatgcagccgaagttgacagtagatggaaagctaagtgcttgctccgcctccttcctttgacaggaaagctcccggtgagagttaatgtgatgagcaaggaagacattaattggggcaggaaaagccattcagagatggtgtccaggatcacagctggcagagttacccagaacctcagtgctaaagccctgactcctagaccttgttttaaaacactaagaaagaacacacttacgagagttgatttagttctcagcaaacacttggtcaaaaagaagtcacagggggagttatttgtttggggctctttgttactcttaccccccttcaaaaattctggttcacaagcagtagctggaagtacctttgccccaagatgctaggcactgggaaatgaagggcctggattctctacaggcagccctgggggtgggaatggggcagcccgcttcttcatcagctcccaatttcctgtagcacaccccatagctagaaggctctggaaggtgagaataaaaagtccttctgcaagtgtgaggtttccagctgaagtggtatctgattacccgagccgctgctcactggatctcaaattagcactgatactccattttcttcatctggagacacaccccctttgggccacaaaacactggacagaagaaaagtggactttcatttccctaaagattaatatcaggagaaatgcctttctgtataaaatcaattaggtgcctgagaccctcaccccaaagccagctcagtgatgctagttgaagtagaagttgtgttaggataaaagaaactcaaaaaaaaaaatttgccttggggccagtactgcccattacaagccctcttaggggtgattctgccaggaggcaggggattggcttgttagcagttagaatgcttggctcaggattctggggtgctatgggctcccatgccatgaaactgaagttcttcctaattctggttgctggaaaagccagtatctctgggtggacctcacaggcagaaaacctgctgctctgaatgcctagctctggcacggcatccacacatggatgatctagaagccttgcagatgcgtcctgagatatgtttctgccagccccaggcatggcctgcaacctgctcaccctgaggtcagcatttcctggaatgacagggaggacacacataaaggaagtgtggggacatggcaggaggcagctctcagcagcccttaggctattttccacattactgcgaatggtattttgcccccaggaggttcataacagtcagaaggatctccaggttccccagacccatcagaaaagccaaggggtgatggtcatcagcccagggggagagcttcctgacagggtacatgaaaattaagtgcaaaagaggggccagagacagctgtcccccagctcaatctgaagcacaggcacctagagaatggccacacataggaccttcccatctggtttgagaggtcctagcaaagcacccctgcaccagtccatatcttactccctccattgacgtgctaaaagtctgccactggaacatggtttctttgggtcaagcatcatgctttctctttcaacaacctacaccttagtgtacctcctccatcacctctgtttttctgtggcccaaggataaacagaagagagtggagagggtgcaaacagcagggtccccactgatctacatggctatttgctgagaattagggagtgctgtcctctctggttgaccagaacttggtaaacagaaggcatcttgggggaagaaaagggcaactcttcctgagcaaagagatacaccaagccttggccaataaaacatgagcagaatttcagcccttatttgctcccagctcacaggtatacacactacagtgtatatcaccaaaagccctgtctaaagaaagaaagagagaaatagagaggagatacccaagtacttggggcaaaattcaactatttctcaattttgcccaaggatacccatttggagatagatatagatatagatacatgactattttcaaaccaaaaatatcaggacacacactcaagcaatggcacagaatatctgaaacacaggctgttctagtgaacacagggcctgtggtcactgtagaagggctgaagagtagaggatggcagtgacaaggaccctggggggacagtgtgacaatgaggtgccccttttcctttaggggacagagaagcaatggcaaatctccccatggtgtgctatgtggtggaaagaccacctccacaagaccagagccggactctctgctcacagatgtcccatcaccttcaaaatacactgacacactccgtttccagagtctccaagcttttgttccctctccacaggggcaaatcacctttctccacagtcaaccagtggttctttcctctctcagcccgagtgttgctgggaataatgcaatgtttccagcttaatcgtttgtcatcatgcagagatttcactgatttcaaagctaaggtgcctggaagaatcgagcacgctctgaaccagggtgcctcagggcagagggttctcactggctggctggctttacacaggagaatcccagaggcccttactcaccagtttaaggctatctttccaggaaaccagggcctggggctgaagacagctgagatgggcagtgttcataaatatcacctattggaggcaagtgaggacatccaagtatgcaaacaccatgtacactgaacacacctctctggtctctgatggaccacttcagctttctgacttcgttgcaggcaaacattagcagatgccccatcctgcaatgcttggcataattatcaggtaggctccaggcaataattactcactaatggttagccactgctttgagccaagagtctcctatctgctctccctacaccaaattcagagtcttgggtggtaaacctgaaggaaaaaaaaaaacaaaaaaaaaacagtaaccatcaccatggcctggcaaaaaaaccacattatctaagatatcactccaggtcctataaaaataacgtatgtttacatgtggatggctgatctgagcacagattgaatatataaacgtggctgttaattctagactctgagaaaattctgagtcttccaaaaataaaggaatccctacaaatatttttaaatctttttttaagaggtcatactctgacagagagccagaattaatgcaatgggaccagccacctgctcttcttcccttcccatttgcttatagaacctcaaggcagtagacttgttgaagcccagtgttagaaacagatgtgactatttataaaccaagaaaactgaagtgttttaatccaacacagggtggcaagaagcagaactgacaagctttaggaatctgaagaacaggcaacaattttcaataatattacctctccacttattgagcatttaatatgtgtcaagcagtgtgcaagctatttcccacgtattatgtcacttaattgttagagcagtcccttattttactcttttaatgataaggacactgaacctcagagaagacaggtaacatgctgacgccacacagctgagtagccaaggcttgatgatgtctgtaaattactttaaaatgcatcagcttaaacagagtggtataatgtaagttagttccaatccttacccaaggatggttagtcgacatctgaagtattgtaactaaccagggctggtgacttagcctttgaaagccttgcatcagagtctacactgtttgttaaaaaacataagagatgttggaaacaatttatcagcaggaaattaagcagtgtcgaatatgcataattggttagaaatgccatccaggcatctctgccctttgggcacaagaatctggcaagcctagagccctctgtggctccattcttggcctaggggtcctactagggtctatttcatctctcaaaggatgctgtcctctaatcccactagaaggtgagctgaaacctgcaaccacattgccacatctgcctcaaataaatcttccttgaaataaacttgtaagagttactaagtcagtgcctcccaaactttctcacttcctgacacttgcagaaagtgataatatttttaccacaccctggggccagagagggagcttctgctgctgcatgcccctcgtgccctctggctgtccacctgcagggttgaggtgacccgctatatcagcaaaccttgatacccttccccggcacactagttgaggcagacagcaggatccacactgagcttcaaaaacaggctgtatggctatttatgtgcctggttactaacaaatattggtaggtagggtagaattgagtctgcaacttgcttttgtaggaaggttgtggaggagaaggcccatagctctcacctgcctataatcactggaaatgagtccccacataatctgcccattgggcatggccaagttggcattaagttgggttgcagtgccagacctgtctgcctccaaagtctatcctgggtcctgggtgctcccctgcttctggagcctaaagaaagtgaatcaatggttatttgtcaaacccaaaagggaagctcttcagaaaatgccatgtcaaagggttccgtccttggcgctgtgctgtttcatacttttatccgtaagttgaatgaagactgagagtcacatttatcaaatttgcaacggacagattccaggacttgtgaaggtcaaatgagataatatgagagaagtcatttaatagtagagtaagactcaacccattgatgaggatgaaacaaagtttaagactatcttagcagcctgaaacagggtcaaaactggaaccccaaaaagaaattgaatgtgacaaacataaattcaaattttaggcttcaaaaaatattaatgaataaagtaccaggtggcagaagtttgtgtaagacacacatataatgagggtgggagaagcttagagacccactggttacgaaccagcagtgggatgggggctgcccagaaaccctgccacatgaatgaattttgacattgggctttgctatccacacctcctgcagatggtgacctgcacctgtgatcagtcacaaaattagatgtggagtcagacctacctgcaccatgagaagcaatgagctctccatcaatgtgcaaagcagttaaaagagaaggaaccctctatcacgtgctactgaagttgagttgttcccatcccctgcaaaggctcccaacttgccagcacagccaggatgtttggctcagagaaaagaggtggcaggagagtttatcaaaacctacaacttaagattttcttcacagaagatggaggaaatggcggcagggggggacgtaaagataggcaatcaattaccaaggagcccttgaataaaaatctctttatttccttgaattttcctttaatttatcttttttttaaaaaaaaaaaagttttcacctttgcaaaacctttggactttttgaccaaagacaacaggaagtcagccaagtttaatggagttttcattttgaaaaagatgttatctgcagctcctctgtgcctaccaagcaatatggtacgtctgtggtctagagaccaactcattaggtgctctgtttaccatcagctggtgaaaaatgataattgtatggaagaataatcaccaagacatggacatcactgcctgcagacttcgccaggaagctacttcccacttcctgtagatccgcagctgtttcaggatgtgtaatgccctctactgtcctaccattcaaatacttctcttttcaagctcagaaaaccaagtttaaggtagggagagagagagagagagagagacaatcaaacaaccttatgttgggtccagagggaactgcaaatgtgtctaagacaatgcctgctttcaagaagcttgcaattaagtgggaatatgagatgtaaatactgaaaatacaagccaataaatcatatattaccaggaaattcttggcaggctgagttttcagaaagtctctacgtgtactactgtctgcacacaaaaatgcccagacctggcatgtggctaagtctacttgtaaaatttgttacctggttaaatgctgttccatgcctaccaatatttttaagttttcaaatataagttttaggtgaaaatgccattctttcaaaacagtatgtgctggagaaatgacattttttcaaagcaaattttctatatttggtcatgtgatattctgtaagcttttttataaaggctctttagaacattccaaaaatgagcatcatcaaattaaaacaagagaacttctattacattgccacaaatcctagatgtaaataaaataccatttcactcaataatgattgccagaaatataaatacagtttagaaaaattatttaattagtttatttttaagtatttgccaagaaggcttcggtcttgctagtattaagtcctgggagaaggaacaaaggagagtgaaatgagctacagcaacttcatgcaattgggcctgggtttagcaaagctcactctctctcctccacacccccaacaatcggcctggggccaatgacagccaagattctttgtccaatttgacatcatgcacatggccagtaccccgcctctttcgcctttgcctgctttcttagatcttctcatccgagcataaagccagcagcccctttgaggacatctgataccccaggtcagtaagtagtctctaaaatgaaacataagaaggtggtacaagaaaaggggaaagtgtagggattccctacctttgttgcaggctctgagacagccttggagagggctcagctcaccaatcccaaaggccttacccgcagtggacaggggcatggtgaggggatgtaacaaggacacccccggtggcgtcaactgctctattccagtcctgaccacagatcactgtggttaggttactttccttcttagagccccaggccttgacctctgcctcctagtaaggaaacaatgtgccaccagataaacttggagaaactgctgaattccctgagaccaaaagtgcagctccgtaaatgtattacatgccgagaacagttgataaaatgtacaagggctgggaaaagaggcatgaggaggaatgaacagaaatcctgccacctctatggggtttttgaaaggttagagctcaaaaacacttaccctgccccctgtttctccccacaagacagcccaaagcacaagacaattttattagcagctctgagatacccagaagcaatccagagaagagggtagatccatcgtttcacttgatgttgtactgcaattttgcagctaaagacattctttgggcctgaactcccggggtccctcagtcttgaataactggtataaatgatgcccgggctagtcagaggccctgcactgtctggggcctctccccatccccaagtctcactaccttccgcagcagcacagagggttgaaagtgtctgggaagacttgaaggagttgagcatatctctctctctagcactctgctcaaaccaatggcctgttctctgcagttcctatgacatgaacactgtaatggaacacaggagcccatgtctacatctcctacaacaaatgaagaccactaaattataaagctctcctgcagaatgcaaagcatctgtcactaatatgctaacccattcattttttccccatgtattggaaagagagagaacagatactgcttgggttttactaagccctagactgtgtctgctattttaaaaataccttcatcatagatgtgtgaagcaaagatatgagaaacagggggtagaacctggagaggggctgccccacctaaaggcattcccatgataaaaatttttccttggcacttgacacgcctggaccaagccaaccctatctagtcgccaggtcctacctgcaggctttgattgtgcagactttgtcctacctcccagaatgtgggattagaccaacaggacattattcctaatgggcaaggtcaatattttaatcaccaatctcttagctcatggtggagttcatttccctagaccacactgttttgagcatgcgctcattgaagttggaggcacgcaccgaggaagggaacaagcagaacagaggcccaggtgcgctctgttccaagcttgctctatagcactctgggtgctactcaacctcccgggattgttctttttccactggaaagtagtgggactctcctaagggaaggtgaatacctgggatgctttcagaacaatttcaagtacattgtccaagacagtatgtttacgccgaaacatgaaccacttgaaaaatgcaagaatctctaggtggatcttcttgcttctttgtcaagtttctgccagatcccaaaaggaactcctaagtctgcaactgggtccagaagtaaacagcactaggtaagcatgaagttgaagctgccggggacacaagagccttgtatccgccggcctcctggtcacttccgcctgcaaatccacatatgccccaattcaccttgttcagaaaagaatgcagcactcctgccccaccactcccccgacagcctgcctcagtccagatttctccagctccactaatggcatcatctcccaccagctgcccaggcaagacacctgcaggacaaccccactgcccgttccttgctgcccaccaccttcaccgccatatccaccatcatctgtcagcgctaattcctacgatgcacttctcagatcagcccctttctctcctttgccaccccctttgatcagccccggctcaggatgctttgatttactgcaatagcctgcttccagttgttctccacgtggcccccgctgaaccttgctacagtacaaatctggtcttgttgattctcttccttggagatcgccaaggcctgactgctgcctgatggataaatcccttagctggatactgacactggtcctggtgcagcctctgccgtgttgccccttgccccacttcccacctctgccttgaactcctgcagaccccaagggctgtgctctcacctctctgtgctgcttcctccacgtgggacctctgcttatgagttcacaaagccaatctgagggatccttcaaaacatcctctaaaactcaactggatgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgtcttcctattcccagagcaccctcttcatgccccagtctcactctctgacacattgcatgtaaattctctattcccacgtatgttgtggccacactaagctgtgaactccctgctgacagaagtaggtctttcatctccacacaaattctcacatagtgcctagcacacagtaggcactcaataaatattgcttgaattgactgattgcttgatcaattgattaaatatttcataacatcatatcaacctctcttactaaaatatgcaaatatatgtgcatggcgcttggtgaaatgtaggcatcgaggaatcttacgaatccttttctttttctgcagtccccaattgaacctactactaccaggatggagatccccccggggacccaggcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggtgtgatgtgaggcctaagctcagttttcattctctttgtcttgattttctttcaccttgtgtgtaaatagactctttcttctgatgctcacccaaccctttaatatgcaaggccacattcatcctcacctcctgggctgcagacgcgaaacagcaagggcttattcctggctttaaagaggagaaactgaggcctagcccagagaggggacttgctgaaagacattcagtatacctaggattagaagctcggtctctgtattccctggccagtatataatacctcttcaattgctctgaaaatgaaaacctcaggattattttgcaggaggaaacaaaaataggcctggaaaaaccacagccacatttctgacaagctccattcagagggcaccataacttacataaatgatttcctattacaccgcaattgtcactgcaacacgacagtcttgcagcttccttgaagtgttctctttgttgttttttgtaaagatcctccagaaagaagaatcaaatatggtccaagcagggaaacaaagcacatgacatccgcagacccagattccccttccgcatgattctttctgaggaccaaagagaatgccatgaatagtcccccgtgggcctgagccctctcccacctgtcttcctcccaaagctctgctatatccttgcaaataggattcctttttttgaaaaaagaaaaaaaaatgaaagccaatggtttatgaagaagaaatgaagtggcaatttcccagcatggctgggaatcaatacaagctgttgtcagggttttcctttcaaagggtggctgccacacttctccaaagtcaagagcgacagagctccagtgcttgacttacaactgcttcatcatagcaagatatttttaatttaaaactcactgcagttgggttcgaactcagctgggacttgatttactgctaattcatttctctgattcctataattctaagctcagtcaccaaacagtttaatgctgatagaatcaccagtgcaatgctttatgaatgggcgtcaggggaattttgttagtgtgtgttagcaactgttattcactctggaaaggagcaccgtgcctgcaccaagcatgggggggctctataattgggcacgtgaattaccagtatccccaagtgattcaaacccaaataccactgagagggtacccccttttaccccaacccacatacacactcccacactctccctctctctctcacacacacacacatacaatcattacctatgtgagatgaatgccaggcagtgaaaacgctttccatgggaaatgcctaacttcactctccaggtcactacccagtggtggaaaccatggatttacagtctaattagaaatcctcagccttttcttggatggcaaagttttctcttcccaagagaaaatttgtttcaaccgtccaaagtttagggagatgtgtcttaataactcaagcttcctttgttaatttgataaagaacatttatctttgtcagttatattgaagcctcttattcaagcagttggagaaaaaaaaattgagaaggtgaatgtcattactcacatattttgcaaacatccatcttgatctgttatgtgcaaccaaaaagtgccacttgtgggaaacatgtccacaaacctgtcagagtggcattcacactttttgaatttgtttctttatgaaatatacacctgaaggcagatcacaaggccactgtcgctaaagttttgtgagaattcgcagtcatttctgggagtctcaaaagcaaatgacaaggacaagaggcaggcggtgcctctgaaagttggggtcacaagtccctacaagtccctattttatcagtacagtgaattcattcttctggttttttcacctctgaagtaaaccaaaacttgaaagcttccagttgaaggtcaccatctcccaaaatgcctttctatggaaccgtctttccaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccccccgccgcaatctatcagtgccaaaacccatagtgagttttacacagagagaaataatttaattccatgtgcatccatgtgcaagaccactgcacctacctgtccccaaccactatgacccaggatgctggagggtaactgaggggctcagcctgtacccatctggattcatctgaatcctctggaatagccagtcagtctgacttgatgtgatccctactctgtccctgctgcagagtaagaacccaccatattagtctggttcaccctagccttgatatttttaaggtcattcttctccaccttatcctactccatttattccttctatttttacagcaaatatttatcaattgcttccagtaagataggctctgggttgggcaatgagtatacaagaagtaagaaatgatccctctcaacctaaaacataaagaaatacatgattcccactgttttcattgccactgccagtagcagcttcttcaccattattaaaaagcatgaattgagttactgatgaaacaaaaaactgcttgaagcaggggctgaccctaccttctgggagctgcaactctcaggcagaaaccctaatgcaggcccacgtctctaggtcagtgatttgctcacatcaatcagtggttaggggcaagtgcatttagggaggaagatagggtcagtatctaatggacaagagagcagggaaagaggtcacaagcacagcatgaccattagtcctctccccagcctgaccctaaagggccttcaaagcacaagagtagtaaaaaacgttgatgaggggcaggactagctagaagcaatgacttacaggaaatattttatgcagaaatgtcccctgttgcattatatttcagtgctttcattatttcttaaaactgggagggtggcagaggtcattacgacctccccctgcttcccagcagccgtgccatccctgaaatagtcacacaccactatgcggaaggctggctgttgcttagtaagccccaaaacattagaaaagtcttcagaaatcggattggcacccattcttaatgtggtttctatttggggtttaaatgggataatagtgtagtcgactagtgttgacacagactcgtgaattctggggctcctaattggagtaccctgccctgtcttgccatctgactctgttctgaagaactttatgttctttgcatggaaaccattatcccagactcccaatttatgtatctgcccaaatctgctgagtcccacctgacatcacgccaccccaccccaattctgaactgcagccattttcctgttgaatccttgttatcattgccactgccaggagcagcttcttcaccattattaaaaagcaggaattgagctcttgattaaacaagacactgctggaagcagaggctgaccctaccctctaggagccgcaactctcaggcagatgccctaccgcagacccacgtctctaagtcagtgagttgctcacatcaatcagtggttaggggcaagcatatgtatttagggaggaaaacagagtcagtatctaatggacaagaggcccccagtgacgctttctgctgttcctctggccctaaagttcttgctgtcttttcttccttcagagtcaaaggctgggctcctgcaggggtaaccctgacataccttctgcagggagagccaaggaagccccagccccagggcctgacccacagaggctctagcttgacctggtattcccaaccccaaagtgaggggagttgactcatgcctcgtggggtgacttgtgaccagtgagctacagcagaccagaaggacctgtggattaactgctggctgtgcctcaccaccacagactattctgagacatactgttcacaccaggcttccctggatacctcctgagtgactgagccaccagctgcttttcactgggaaggcagggccagcttggtaatacactatttgttctccttccttccctacctctcctcctttgcttcatttttgcttccccgggatctcacccctcaataaagtcataacacatagcttcttccttgagctctactttctagggaacccaggctgtgactggagtgaaggacagacaggcaggggcacaaggcccaggccctccatagttttgacaagaatagtcctgcttgcatctgttctgtgcactggaattccatataaaatttcactggagcaaagattttcactgtatacatgttaaaatatgtttaatcaccgatctagactaacctcctcattttataaacaataaactgaaacataaaatgatttttcccaaaatgctttagttagagttatctacatctatttgtatccaaagcctagctttttccacaacagtggtttttaagcaaggggacatattggaatcatctaggaacctaagaaaatggacacgtgcctaagtagctgtctctttccttggaaagacaagggacaggataggctctgaagaaggctgagcaaatgctgaggccagaggtggactctgtacctatctggcacaattctgcttgagaatctattgctcacacaatcaccagaatccagtacttggtttacgtaatgcaaaggttcagtggaaattttcactgtagaagccacccctttattcacatttgacagtagtcatagcaaagtgcttgtcttagtccagtgtttctcagtggattccaggtccactacacagtttatatacttttgtgatttcacaatccatgtgagtgtattaaaggctctgagaagtcctgcagcaaggagtatctttagctttgctttacacccagggttttgcaaacttacttgactgcggaaacttttttgcatgtaatgcctattgactcccccgcagaatatactttgggaaactctagtctattttaagtattactttcaggaaagcaggcctgagatggagaggaagaaaacgaactccaactgactctagcaacattagctgacattccaggcaggctgcttcagttgcacatcctgacgtctgctactgtctcctctctcactctctaaccccgccacaagaacggaagcaatccaccagctatgccttgcttacttctttcctcttggcctctgggtcaaagccaaggaatgattggttcaccttctagtttgagcctccacactaccaaaagggaaatccagctgtgctcattcgagaagagttcagtgagtatgtcagataaggaactgatcttgagcgaagaccaggaaagcctttcaactgccatggttttcctgtcctaaatttccagcgacctcttcctccactgcttctctcctcatacttcataatgaaaatactctaccctgtaagacctcgggaattgattcagcgaggctgtgttcagcgcattgactgcggagactatcctcttagctagtgatctgttttgtgttggagtgacaaaacatcccaaaatccaatttgctgttgcgaatcctggttcatggaggaaacaccatagagggggaggggaagatccaagcttagaaggaaaagagaggatgcctgagatctctccaacacctgttggtttcagtttgcacaggactttacctcccaatgttttatccactcattcctactgctgcctcagaggggaggtgatgaaattccacgtgcaccccttctagccacctcaagttggacagaacttttactcacctcacagtgtagagaagtcaaagaaataatgcatggaataaaagtttgtcttttggagaaaaagaaaaaaaaaaaggcaagtaaccaaagtgcctcacttgtggctttttcctaaaatgttcagaccagagggactgaggttagccctggctttggagtgggacagaacccaaccaggcccatgggctccttcagggattcacacccacacctttttgcatcaggatgtaattcctaatgccttgccttagcctgcaccatctcaggtctgaattattttcttcatgcaaatggggacctatcaaaattcctctaagtgctacaggatggctatcccctgacatggtccgttggcaccaacatgcgatgagtctctgctgcaaccaccataggatccaggcacccagcaccgcatgatgtccctaggcactgatttcttccctgcttctggatcctgaagtcagaaactctaggagtaataaatgaatgaatgaacaagtgtcaagtacctaccgtgagtggtgtaatggtaagaatctttgcccaagagtgaaaaaaccatccatcccttagcaacctggcgccttggacatctcacctaaactctcttctcagccttagcttctatgctatcaaaatgggaataaacaatacctaccttgcacagctattttaaagatgaaatgaggaagtgttgtttccacaatactagcaatttgaagcagtcaccagggagaattagactcctatcagaattggagcctcatagagtctaaagtaaagatgggaacttcactcattcattcatttactcattttttcctgggagaaaatgggaattgccaaatgaggtgacagtcaccctcaggacctgagcattctgctagaatgatccatgcaattttataacctaccaacagccaaggagaagactcatcccccttgatgaatggggaaatcgaggctcagtgaataaatacatttgcctggcatcacagaggtagtgcaagagactagggaccagatattctaaacttcctcccaagcactcacccataaacctcccaagggggcagcagtacagtgagcacatatattctaaggaggaaaccagcacagtgatgaggagaaaggtcagattgctcacaagtgagacttggctccatcactaagtggctgtgtgatctgggacaaagtctttaacctcctgcatctcagtttcctcctggaggaaatagggaccgtaatagcctatctgggttgttatgaggcaaactacttaaatggtatctaaaccaaatgagtgctcaataaatattggccaccatcatcattaattatcatcttccattccattgtttttacaagaactgaagccagtactaacatcctcacagcctcttcctttgggaggctgatgccacaggaccggacaagtgtgtgggggcatacacagactcacatagggactcaggaaactcttcttccaggctgctccatgccatgcagggaagcagcctcctccttcaggaacaaggcctgggctcttgttccaggggaatcaggacccctgcctgcctttcgttttaaaatccatctcttaccactcagcagcagagcccccttcagtctccctgtgggctccaccttcctaccgcaacttgaatggtacagcctgggcagtgaggacaacatgaaagaagaaagaaaaagtctgtgcagctagaggggatcaggtgggagtctggggagggagcagtggagcttgcagcttttaaagagacagtgtcctgtccacagggccctgtgtggaccaagcatagctcgatagagcctataggccaattaccctaatcatgtgcatctcccaaacagccatttattagtgagacgtctttttaaaatgccgcttttaaatataaataacacttaatcatccagctgtcgttaaattcatgttatattgatttcttggagtgccgcaaatttgagggcgaatgggctggcggatgtgcgcacaaagccaagaggtagattagcaagtggtgggggcagagaagtgggggttggaggaaaaggaagggaggtgtcaagggagggaaatgaacctactcaatagcccagggtctgagccagtttcacattgggtagcactggacacaaataagaagagaggagacgctggcacatctgttgcatagtctaatgagagccaagatcatggtcgtgttttctgtattgctgccgcccccttgtaacccaccacagagccgctccaacaggtctctgatgtgcattgtctgcgtatgccttctctaggtgaggatggggagaagcagctaagaaatgccccctagctggctaggaggagagagatccacagcgatttctctgcatcaaagcctgatgataactatgaatcaagagtggttaatgacccagcccctttagctctctcccacttcgggactgctgccatcctagaaagcccccacttcattcccagcagccctcattgtgatgaaaaggatcccgaggccaagtgtatgtaggcagactctgccgtgcagatttccctgtctgcagggagtagcagcagcaggcgacaggaaggcacagagaaggagaaaggaaacaagttgactgccttggagtcctccagaaatgtctgcagtgtcccagtgggcatccaggaggaagtcctgggaggacagatgagagcccggggaggcgtgattgggtaagaaggagcagcttgtaggtgacccatgcctagtgctcacaggagagctgccttaagcaccgtctaccaggcagcgagggtctgctgaaaagaagcattcatggctggggtttttctagtgtgactcccttcccagtgagaaagacctcagagaacttaaaaggaagggcacagaagagtggcagagagggtgaatgacagcgtggcatgctccagggctgggcaagagagccaggaaaacgtaatgtatactccgctttacagagatgttaattaatgcctgccttgtcctagaaaccaaattggtacctaatgctaagtgcagaaagtgcagagattttctgaacccagatgtttagcttataaccagcataatgatactagctttgcattaaaatgatggatcctgaggctgcgaatacatgagaaaggaaagagggtagggaggaaagcagagaaaggagtggaggtctacagggaagacacagacatttcaggaagatcctgtaccctatccctttgcctcttccaggtcccatgagggactgtttacctgggaggcacccactgttgctggagctcattatttcttttgcaaaccatgtgctgctgtacgcgtaggtgggatctgcctgtccacgccctcaaggggcatgtggggagaaatgttccatttcttccacagcccggaagacagaggtggaccccattgtcacacatggcgggggcggggagctgaccacatttagccagactctgagaacgcatgtgtgtatatatattgggtgtgtgtgtgcacacgcccaccattcttaaaaagcaaataaggtttcttccccctactggggtctctccattgtgagagatttgctttattccatctatgcttttcaatcaatcaaagggcagctcacacagcacacagcgggaatacaatctccctcccggggtgtctgcgcttctccccagcctagccagagacctttgcaggagctgaaaaaagtttggaaatagcggagtcagggtgctgaaaaagccctttcattcagcccctatcttcaggatttacaaaaacaacccaaattctgagcctagcactgaggcctccttgttcaaaagaatgtttgctcctcttccatcatgttctgtaaggctcctaacatattttttccactggtgggtctgtgggatactctgaacacatgatcttggacagagggtacaagcttattcagttttgtgggaaaatgatatgatcatgttgcctagaaagctacctcaaagtgacagcaccagaaacacaggagcttgtacatatatattcaattccgaatttgatttggatctcatgttcttctccctatgacaactgagaccctaaattagttgctcttagaccccaagaagggaactatggaaaagcctcttagaaccccagccacttcctacctcctccagaaaaagttaaaatgagcagcctgtgaaattccagccagagagaacaagaatgaaaatgctttcgggaaataggaccttaaagcacgggcgtctggggagtgattctacaatcggagcaggcttgggctctgggggacgctggcagacccacgaatgccttgccttctccggtgggcagtgccgccacggtcgtgagggaggggagcctcctcttttggaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgca

SEQ ID NO: 2639 - DNA, 79977 bp, Homo sapiens
caaattgagggggattctacaaaatacacgacccgcactcttctaaggtgtcaaggtcatgaaaaacaagactggaaaaccaacacagactggaggagactaagaagacctgacaactaaatgccatgtgggaccctggaggggacccgggaacagtagtagaagagctggtgacatctgaatgaagtctgtaatttgggtaacagtactgtaccaatgttaatttccctgctctgccaatgcgatgaggggtatgtaaaaggttaacattaggggaggctggtgaagaatacataggaactgtctactgtcttgacaacttttctgtatatctaaagttccttccaactaaaacatttaactacaaaaaaaaaaaaaaaaaaaaaaaaaaaaaaaaaaagccaggcctagcctatattacaatgttcactgagaacatgctgctagcacagacctggtggtgagttgctcagggaacgtatgcactgtagtcatgcacttgctggtactgtttattaggtgcagacatcccagataagagctgagttacaagcatccaaatcaatgacattttaataaatagtttacatatatatatatgcacacatgcacacacacagatggcaataagagatttagtctaagatctgtgcaaaaacgagtttgcctagcaaaacaaattaacatgttgggttttaaactgttgatatttggcatataaaccattggagttttgttttttctattacaaccataaaaatagtttttggataaaattcgaatcacttctgcagagagaaaagacctgggtcccacagaacagttagagaatcactaatgcagtccttttattttatagatgggagtccagacaggcttaaccaaggtcacatagcaagttaggatgagaacctaggtctcctggtttctggttctgagctctctgaacctgatgagtgaaggacagctccagcaatggagcctgaatccccagacagcctggtacatcactgcaaaacaggcaaggccaggttggctggggcagccgagagcacacggtcccatagctcatgcagatagggctggtcaggaagaacacaatggcaactctgaagagcgagtgtcaggcagcagctctctaaggaggccaccacagtccgcaggagggattggatgggggatagggtgtgaggcagctggtgagtgaaagaccacctccaagagcatggaagaaaactccaggtctctgcaagagaagggaacagaagtgccaacacctgggtccagctgctctattgagctgcctttgttgaaggactgagttgaacagcagatcttgccgaggctgccgcttcctgccattcacactgtcccagagaaaccttccctgagcatcatgcagttttcctttctagataactgttattcataggtaagattatctggctcatttgtttagctgtttagtgtctgctttcccccattcaaacgtcagcaacttgtctgttttgttcaaggctgaatcccagcccatagaatagtgcttggcacatagtaggcactcaataaatagctattgtatagatgagtaaatggactcttcccatacccgatgtgtctctgaccttgtatttttctacatcagagctattcctagatgcatctcagagtctgtttgtcaagaagcagaggctttgatggaaaagcactttgctgagaacatctcaggcagcgtttttcttctgcttcattttctcttcctaatgtgtgacaggacggcaccactggctgcaagccatcctgagaccatgctgcttccctcccaggactgtcacatccaccgcatctggtttacaagccaaacactgatatcctgtccttgggtaaaccccaacattcctgtcagatggtttcactgtcttaggaattcagtacttagaaggatattgaaagtatagcccaaggctaaatgagacttggaatttccttaattgaattggggacttcagcaccacagacagatgtttttggcatagtctacttgatgcagccctcataaacaagcatcacacacaaactgtcagagttctaagtccctgctacttatgaccttggacacgagtactgccatctttcctccagattaagaatgaaagaaagacactcaagaataacgaactaagggacttgccttaccagatttcaagatttattaggtagacccatattcttgatacagaagtggcttttgggtcactggggataggattaatttaaataaatggtgccaagacaattgtctatccacacaaagatattccactggatatcccaatgggatatccagggaaatgtgtgaatcactattcttatctcacataaaaataaattccaggtgcactgaagacttaaatacaaaaagcaaaaaactttaaaacatttagaagataagaaaggagagtatttttacaaactcaaaatcaaaaagggacacaaaaagaaaagattgatacatgtcgactactctaaaatcaagaacttccattcaaaaagaaagaagaattttgaggtatcaaaagataccattaaataagtgaatagcaactggagaaaacattgaaaggatatttaatcacccaaggattattatctagaacacagaaataattcttaaaagtcaaagaaaagacaaaacccaaaagaaaaagagcaaaaggcatgagaaaggatgccactaaagagaggaaatatgaaaaacaaaattaaagagaggaaatatgaagagaagttcaatttcattaatagtcaagagaatataaattagaagcacaatatcatactcaccatattggcaaaaattaagaaactcgagaataacaagtggtggtgaggatgtggagacatgggaattcttatgtcagaagtataattattttgtcaggagtatattcaggcattttcgaaaataatatggaaacaccttgaaagttaaaattgcacctaccgtagggtgagtgattccactccaggtacacatcctacagaaattcttacacatgtgtacccagagacatatgcaagatatccacaaccataatgttcccattaaaagcctgaaacaacctacatgcccatcagtgaaagagtgcctactaagtctggtatcttcacataatggaaaattaggtagcagtgaaaagtaaatgtaaatatagacacaaggataatcttagaaacataatgttgaatagaaagcaagtttcaaaggactaccatcaatatgtcttttttaaactcaaaatcaagcagaatgaaacaacatattgcttaataattcacacagatgaggaggtgaaactatactttaaaagttcagggaatgataagcataaaattcaaaatagtggttatttttatggaagagcagggccgtggagtctgttggaggaggagaatgcagagagcatctatcttattggtaaaactctgatttttaatttgggtggtggcttcagcagtgtgtgtttcattagtatgctttatttgttaccttgttatatagactctacatatatttattaatacacttattaaatatatatactaaaatttaaaatactaagaaagaatgtgagggaaagccatctctggtcccaaatcttattatcttccctgaaatacacttgccctttgggggcatgttgagattgattaaggccagataaattcaaattgtaaaatcattgttattcattcatttaacaaaaattatggagcatctaccatgtgcctgccctgaggactggtcactgagcaggacaaacttggctcttgctctcacttcgacagagctaagactctaggagctaacctgagtcctggagaatgtctcctttcttcacttcctcttgggcaagcaatctccatttccttccccacagtgctgctgtcttctgaaaagaagcagtggacaagggataagaacctgtcttgggaggagccaatctcttctggggtctagaatctgcctctcaaacaaatctcactttgtaattagactttctttggccactagactgtcccccaatatggtttggctgtgtcccaacccaaatctcattctgaattgtagctcccacaattcccacatgtcatgggagggacccagtgggaggtaactcaatcttgggggcggatctttcccatgatgtttttgggatagtgaataagtttcacaagatctgatggttttatacagtggagttcccctgcacatgctctctcttgcttgccaccatgtaagatatgactttgttcctccttcattttccaccatgattgtgaggcctcccctcacaatggtgaggtggaatggtgagtttattaaacctcttccctttataaattacccattcttagctatgtctttattagcagcatgagaacagactaatacgccccccaagtaattaaagcctgtaggcctttctatacacctggctgatgccatctgcttagaccacaacagtctgaatttggatcctcgcaccatggttgaaatgtgaatgtaaatggcttggagctatgtttttcacaagtgctggtgtgtcacttgtgtcccgccctatgcttctcaacatcctggtgtgtttaagtgacttgctcactcctgaacacctggtctccctcgacgtgccagggccctcagtccctgcttgcttgctacgtgctatcagagtctgatgacacctggccagtcctatataaaggggaagtggtgactgatggccttgctctgcccaagctgctgctgtgaaacctgcctggaagacactgacagcagctctagccctcccttgtgctaaggagaaaggctccagctctctaagagcagtgactataggaacaacagctcaccccttctgtcagctgagctatccccagcctggagaggtgagatgccacctctgctaacttccttttttggctaggaatatccattttcttcctcattgagtctgaggaggtagcactagaaaagcttacttatgcttttatcattcagatctctgggtaaattcttactcacccagagacaaaaagaacctgctctaagctccatcttaggtgcaaaaattaggtacaagcagaaaaagagaagtctgaaacatgggtctgcctgagaagatggtggaaggggattgcaagtagagactgacagccccaaaaacttggagagacccccccagacaagtcaatcagaagtgcccagagtaaccttcccatagaattttctgccacaatggaaatgctctgtgactttatgtccaatatggtagccatgagccatgtgtgtgtctctggagcacctgaaatgtagttagtgtgaccaagaaactgagtttctaattttgtttgatttgagttagtttgaatctgaagagccacatatgtattactgtattagacagaaagctctagaaaaacgctaaactgaaaaaaaaaattgagggttgtcagtgagggacaaccaccactagaggctttcagcaggttctgagccaagtttagaaatttgcatgggccaagcttcagcaggccaggggaagtggagtttctacctgaagctgaggggaaatccagctccatctccacgaaaatagtattttctaggtaccgagagaagaggttaaagatagatgtaaagaagccatcactgtgttgtttattataacccaaacactggaagtaataggatcaatacaataaaaactgctgagcacatatgatggaacattacacgaacattaaaaatcatgtttttaaaaattatttggtcacataagtgaaaaaatagaatatgaaaaatatatatacatcatgatcaaaatttcatggaggtaaatacattatgtatacatgtatagaaaacagcttagaatgaaatatactaaattatcaacaggagtcatttctaggtggtaaaattttgaatacttttacttatgttttatattttttgcatatttccaaattctctgtaatggtcatttgttattttataccaaaaaaagtcctatttaaaggatgttctaaagagcttttaatagtgtagcaaatgcaacttattgataagcaaacaaagcaagatatgatattgtacatgtaagttctatcataagtacataaaccatatgtggagaaaacattggaatgtttgcaatgctctcgtgaaattacatacctttctactacagtactcttttctatagccatcttttctgcaattagatgtgtattattttctaacacagaggtggagaactccaactcatctggatgaatctccaaccccaaatatttaaacaagcatgttcaggcccttcccccaaccctgggtagacttgagccttgctcctcccacagcgtcttggggacacagtggcagtttcttgcccagcaccctcggtgggctcctgacactcctagtgccgaaatggatggctactcaccctttggggctgaccctttctcctccatcccctcccactccattaccacagcgattcattgaaagagatcaataattatgaaaaacaattgattttctactcccctccacccccttctttctctgagtaagtctgtctgacatgcataacgggaatcaaaccagagaggaagtgctgcggcttccctggtgggacattgtgctctctctccctctcggagggcccctccctctgcactttcagcgatttcaagatccgcacattactctttatcaacttggcagatgctattgcctcttccggctcacaagcttccgtgctgggctcctcttgtctgcttcctctcctgctaagatcccaacaccagcaactcacccagggccggccgaggctcaggctgcaaactgcactacccagttctgagaggatagaaaactatagcagctggttcatcaggcttgatggtgcaccccagaaccttcccttaaggaaggagaattctccaatagattcccctctcagtaaaaaacctcattcccttcatctcaaaacagaggagctcggagttgtaagtgaacccgagttgagtgggaacaccaccaaaccacttccctctggagcccagctttatacagtagacagaatactggcatttacaggcttatcatttgctattttgacccaggaggtccattacccaaagtaacttgcaattttactaaggcatgaatttaaattgtttttgctgaatggttgataaggcaaaagaaaactgaaggcgtgtcaataacgaaatggtcatttggaagggaaactgaggcatcaagagacgacaagtattggtataatgggtccttaaaagctctaatttcagacccacagcagagcattagcattcagaatggttgaaacagaagttgatctggatttattaaaatgtcagtttcttgatatagtggtctcttcaacaaagtcttaattgctagcctcccaccaatttggaaaacacacatacacatacacacacacacacacacacagtttattcatacctttaaactactctgcttgcccttaaagttctccattcattcaacctcctaactgtgaaattcaaatgactcccatcgggccctaatggccctggtcccagatcaccaaaacagtaaatgtgatggttagtattcagtgtcgacttgattagattgaataatgcaaagtattgttcctgggtgtgtctgtgagggtgttgccaaaggagattaacatttgagtcagtggactggagaggcacaacccaccctcaatcttggtggccaccgtctcatcagctgccagcctggctagaagaaagcaggcagaagaaggtggaattagcagacttgctaagtctgctggccttcatctttctcctgtgctggatgcttcctgctcttgaacatccgactccaagttctccagcctttggacacttggagttacgccagggatttgtcaggggctctcaggtttttggccacagactgaaggctgcactgttggcttccctacttttgaggtttgggaactcagatacgcttcctggctcctcagcttgcagacggtttattgtgggggacttcaccttgtggtcgtgtgagtcaattctcctcttcatatatccatatatcctattagttatgtccctttacagaaccctaatacaggaaccctctaggaaacactgctcctggtggacatctgtgagtatggcatcgaactactgtggccaaatggactcctcctcatccattaatctttcttcttattttcatctgcctcaaaccatctccagatttccctccttacccctgtttacctaaactttcttggcatggcatgggccagcctgtgacactggggagcacaaattacatctcaaggagtggggacatgccaccctgggcccaaagcacaagccacatattctgcaggaagagcacacacccccttttggatgcagtgcataatttcttcctgtgtgtgcacttgggactagaactccttaatgcttggcttaccagtcaagtggtaggaaaccgagcagatggaagacgagtagggcccaggtgcatggaggagggctgagtcaggaagtaggaagaggaagagcatttggggaagaagcaggacttgagcagtaagagtcattcagtgggattcatttcggggcaccaagtgaaactttgtcagtcccccagctgatgacacaaactgcgtcattacaaattcatttctgtagctcaaggtttaaatctgctaaaatgcaaatgtcttggtaacactttaaaaagaggtcagtgttttattcagctgtgaatgtgcctccacttcctggaggctggctttgatcaaaaacaggagaggagtaggcaccttgagcgaggagggggccaataaccagggggagctgagagagcctagcatctgggaaggacagggagctcaccatgcaccgcacagccgctccccaaaagtcaacctcaacctcttcatcttttgctttcttttgattctctttcctctattctgcatcttttccctttttccacatatgaatccccattccagccaggatggctagaggtttcctaacttctctgcctcatagcttaaccaggacatgtgtcctcaggacttcctggggcaatttttaaataagctctcctttaacactctccagttcagtagctgtattagtctgttctcacattgctataaagaactacctgagactgggtaatttatgaagaaaggaggtttaattggctcagggttctgcaggctgtccaggaagcagggctggggagccttcaggaaactttcaatcatggcagaaggcaaaggggaagcaggcacgtcttacatggccagagaaggaggaagagagagcagggagaggtgctacacacttttaaacaaccatatcttgtgagaactcactcagtatcacgagaacagcaagggggaaatccacccccatgatccaaacacctcccaccaggctcctcctccaacactggggatcacaattcaacatgagatttgggcagggacacaaatccaaaccatatcagtagctttgtctttcttccctccctatttcctacttttctttcatcctcctttttagttcctctccctgcctctattcatctttccatcaatattgattaggtgcctgtttacatggtaggcatgggaagtataaagatgtgtaatagacaaacgaagccatcattctcctttcattcaaaattcacttcagaagctaagcccaagcttagacagcagtaagcacgtgggctttaattctagttcttcctttgacccctccactgcctcctctcagtggacctcaagcaattaaatcagcctcaatgccttggtttctctattcataaacagggacaggagtaaaatagaagatccttattttttccttcacaaccttgaagagaagcatattcatttgtctataggagcatactcatttgcatccctctaggaactcacagaaaaccaggtggcattattaaacataccagtgaaagatacttcaaaattcagagaatgtctttctattttgtatattaatgctttggtaaatctaccctagagattgtataataatatctcattttaaagtaaactgaatgcattattctagtttaatgcaatcaaatatttaggtatatatgtgacttgtttttcccatctcatactttgaaaaagagctttcaataaagattccaaaacaggttgcgtttttccccctagaattttcattgtctaataattattatatcgctcaaagcatgagttatatcaagactttatggatttttctgagtggcagtgtgctgtgccagatagagcattagactgaaaatcatgagacctggattctaggtataatattgctatttactaattctttatctttttagttaaaattctcttggtaaccagtaatggaaaccagctctaaatgatctttgttttttatgaaaaatttattggaaggcccctgctgtatgaaattgaagaaagagttggacaaccaagacacgtgaagagagagcatgagactggctccagcactcagcattaggagagcatggacttccttccaattgtgccacctttcacagacctaccctcaagaaaccttcagcctgagtccctgtgtcaaatgtcaaactcttgagaaagagactgataagctcagctcgaggccaggagagagaacctgctatctctggggtccaggtcaggaggaatgacagcccagatgtgaccctgaggcctccccctatactgcagtcattctcaggaatgagggacatcactagagctgggaaggcctgatatggtttggttgtgtacccacccaaatcccatcttgaattgtagctcccacatgtcatgggaggggcccagtgaaaggtaattgaatcatgggggttagtctttcctgtgctgtgctcatgatagtgaataagtctcacgagagctgatggttttataaaggggagttcccctgcacaagctctctcttgcctaccaccatgtaaggtgtcccttgctcttctgccgtgattgtgaggcctccccagccatatgaactgtgagtcaaataaatctctttcctttataaattacccagtcttgggtatatctttactagcagcatgagaatgaactaatacaaagccactccaagaggcctctgccagtatctttgggccattatccagtccctgggcctctgttccttctgtaaatgccaggagtttgactagattatttgagatccctcctagcttcttcaccctatggttcatggtggcagtccctagcgcttcttgaaagtgataatgggactctttggacatctttcagtatttccaaaaatgaaacagaaatttttatgggagacaggtttgcccgggcacactaaaaaaaaaaaaaaaaaatgatgtttcaatttatggcctagaattaggtcaacccagtaggatagcaatgacagtttactgatcagaagctctgattggcagctaaattttgattaacataagatggaataataatcattgtttaatcaatgtatcttgattgaaaaaaatgtcttgtgagatcacttagaagttaaaagcattggaatccttcacgtatgttgcaagaggaagcttaatttatttttgtgaagttagagtacatttcctcacccatacccacagacacctacaagagaacttggaaaataaggagctggcgtctgcctctactcagccacctgaataaaaagcccacatgtaaccagtcatggtgtcaacacccgaagttgttgtaaaagcccatatgcatttagccatggtgttagcactcagagtaagaaggtgagcttcagcagtaggcctttgtaaggagaaggctacatttcatctcagaaaagctaccaccaatgcgcttaccctctctaaagaaactcagaagaacttgaagcctaataaatatgtgccactttttctcactgtctggacattaaccatcaaaacacctttaaaatgacagggagccgtaatatattattttgtcttaaagaaagaatgaatttaggactagtcatattcttcctgtagctagtgttgtgtccatggatccatcacctctgcctctgagcttcagtttcctcctctgaagactgagaagctgaatatgaggctaagattctttctagctcaaattttctgtgttccaaaaacatgatgcattacttgagctcttcctatgtgcctggcactattctaggtgattataaatgtacagtatgtcctttaatctccaacaacaatgcatccttttcatccctgttttatgaaaaaggaaacagatccacaaagaggccaagctagggaggaaccgagtcagatgtctgtatcctgaaagtaactctgagcctgatccgctcaggcactggaagcttccctacatcccctttctccaatttcttcaacacaacctgagcagacgcttgcatgtgcagttcttttcatctttcccctgacatcaccccaatcacctaagttacttgtctctgaattgccttcaatttgtcttcatctttctagaacagaagagatgatggcaatgcaccttgcaggtgcagtttccttggggacccctgaacaaggaggtaaacttcatctgttgaagtctcctatagaagagtagagagtctgtctggatggtgctgcctaagaggcaagaaaccacaggacccaaaaatagccatggagcaccacttgggataagtgcccaataaatgaaggggtagggaaatagagcccagggaaaaaggttaaagaaattggaatttgctcacataaacatagtaaaactgatcaatattgggagacacttctccatgggactcagctttttgcatgtcttgaaagcaaggtgttattttatgttctagattaccttttcaagagtatttgtatagcaaacatccctggaagataagatggggtctcactccagagtgaagaacaggaatgtttactgcccattagaaaagatttggattctctaagctcggggtttctctcttacaataaaacttgctctgtgtacaggttgttatctggccatcttcattcccaccttgtgggaactgggtccagggaaccaacacaaataagctgacaacttggctactgcttttgctgtgagtaataaagtcttttttttttttgcgggggggcaggacttaataaatttacttatttttttttattattattatactttaagttttagggtacatgtgcacaatgtgcaggttagttacatatgtatacatgtgccatgctggtgtgctgcacccattaactcgtcatttagcattaggtatatctcctcatgctatccctcccccctcccccgaccccaccacagtccccagagtgtgatgttccccttcctgtgtccatgtgttctcattgttcaattcccatctatgagtgagaacatgcagtgtttggttttttgtccttgcgatagtttgctgagaatgatgatttccaatttcatccatgtccctacaaaggacatgaactcatcattttttatggctgcatagtgttccatggtgtatagtgccacattttcttaatccagtctatcattgttggtcatttgggttggttccaagtctttgctattgtgaatagtgccgcattaaacatacgtgtgcatgtgtctttatagcagcatgatttataatcctttgggtatatactcagtaatgggatggctgggtcaaatggtatttctagtactagatccctgaggaatcgccacactgacttccacaatggttgaactagtttacagccccaccaacagtgtaaaaatgttccgatttctccacatcctctccagcacccgttgtttcctgacgttttaatgattgccattctaactggtgtgagatggtatctcattgtggtttttatttgcatttctctgatggccagtgatgatgagcattttttcatgtgttttttggctgcataaatgtcttcttttgagaagtgtctgttcatatcctttgcccactttttgatggggttgtttggttttttcttgtaaatttgtttgagttcattgtagattctggatattagccctttgtcagatgagtaggtggtgaaaattttctcccattctgtaggttgcctgttcactctgatggtagtttcttttgctgtgcagaagctctttagtttaattagatcccatttgtcaattttggcttttgttgccattgcttttggtgttttagacatgaagttcttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcactatttattaaatagggaatcctttccccatagcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatataaactttaaagtagattttaccaattctgtgaagaaagtcattggtagcttgatggggatggcattgaatctataaattaccttgggcagtatggccattttcacaatattgattcttcctacccatgagcatggaatgttcttccatttctttgtatcctcttttatttcattgagcagtggtttgtagttccccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatccacttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgccagttttcaaagggaacgcttcccgtttttgcccattcagtatgatactggctgtgggtctgtcatagatagctcttattattttgagatacgtcccatcaatatctaatttattgagagtttttagcatgaagtgttgttgaattttgtcaaaagtcttttctgcatctattgagataatcatgtggtttttgtctttggttctgtttatatgctggattacatttattgatttgcatatattgaaccagacttgcatcccagggatgaaaccaacgagaacaaagacacaacataccagaatctctgggacaccttcaaagcagtgtgtagagggaaatttatagcactaaatgcccacacgagaaagcaggaaagatccaaaattgacaccttaacatcacaattaaaagaactagaaaagcaagagcaaacacattcaaaagctagcagaaggcaagaaataactaaaatcagagcagaactgaaggaaatagagacaaaaaaaaacccttcaaaaaattaatgaatccaggagctggttttttgaaaacatcaacaaaattgatagaccgctagcaagactaataaagaaaaaaagagagaagaatcaaatagacacaacaaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggacctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattctagaccaatatccttgatgaacattgatgcaaaaatcctcaataaaatactggcaaaccgaatccagcagcacatcaaaaagtttatccaccatgatcgagtaataaagtctttcatctctgatccaggaatctcatgtcttccaccaacttgaacaataacaggctaactattacattttatgtaaagtaaaatctcagacccttcacaactcttgacattaatagacttgagaacaaatttcaataaaaataatagtatatcttcaaagagaggtcaataaactttttttcttgcttcctggaaactcaagaatatcctcttctacagtctaaaatgagatgtggatccaggcctctggattgctaaatttgctaatacttatgtagcttgccaagggctattttggaatctcctatcccagaatattttaaaatataatctagatacctatccatgtgatatagatcaggcctagacacacttgaatgataaggcaaaggcaagcactagcaatgctataatgtcttaaaaagcaattctgttcatgcacaggcccttagcttggttcttttttcacatgaaatatccacaacccatgaggctttctccaatgaattagctcaaagttggtcaaccctagtcaaagtcttgatggttcccatgacccagttagtcccctttttaagaagtgaataagcctttttaggaagtgaatcctacctttagcttaaggcctgcctggagaagctgctgatggattcggaagatcaccaggatagggactagatggtgccaatctccaggacctagaagcttgggctcctgcccccctcacttcatggtccttccctattctcttctcttctgtcttccccaaaatgtcctcataggcatggcttgaggaatgacaagtaagggattgggcagccccaatgattcatcatttctcagatggttaagtgaatgatggcatggagctctgagcactatggtctgacatgctcatctccttgctcaacacagcacttccaatggccgctcccctatacacatcctttctgatgatgacgtcaaaggatttcacatgaaacttgctacacatgtctatatcattagcactactttacccttgtacagatcttcacctctggcaaagcactgttaactcatttgattccaaaaccctatagtcatggcaaatattaaacccatctcacagataaagaaattgaagcttatagaagttaaaagtgttgcttgatgtcacaagcttgctgttatgtggcattgttaaaacggaaactgaaactgaaaccaagatgcctcattccaggtccatgaccctttctgtacagtgcagaggggggatgcaggcagcagccaggtatgtgatggcctcactttacaaaaaacaagaatgatttgttcaaggtcacatatcatgtgagctacattgatccagacaccaggaaattatagaaggattcatctgtgctcagtcttttgcaattttagtagttggcagaatgttctcggggaaaaggagagagaaggcaaatgatctggggacactgacaaagcagcttgccctaacagtcctgagccacaatgcccagagcatggcgctgagaccagggaccagaaatgccaccctcagccctctggccaggccttgttcctgactgtccagccaaagctggctcagctgcctggaaatcttatggctctgagaaatggccatgagtcaacctggtctctcccctgcctttgcctctggagcttgtttcagatggtggcactgcccagcactatctggcaagctgcagggctccatgcctgctccagcctccatcactacaagaaagctacattttctctgttagctggggcaattggctgagcctggggagaaggagacagggaaatgagcctgctacagtggacactccacttgccagggcccaaggcattaaaacatccaaccatgtcaaataattcaaggagaaaatgtttacagacacagaaaaacagatttttttatccttcttcgaaccactccatctcctgtatctaatgcaccatttccatagcattaacagagaaaaggcagtgggaaatattggttattggattcttttgttagaaaaggctcgcttgaagctggcaggttttattatctatctgtgagatgatcctagcctttagatgggtttctttgcctgccgactgaccagatggagagaaactctggaaaacacagtagttcttggatgatatgaaaaatctgaagcaacctacttcaaagatgagctatgggtacaggagaaagacggaagtcaatttcatgaagagcaccatggatgggtgcagcagcttctacaagaacaaaaaggagattgacactccccagcacatgtgggcctgaccacccatgccacacaccttgcaccagccctccgagtcaataccaccaccctgtttcctgtccatcacattctcttgcttatttcattgaagcctcatttggcccaggtgtcttcagcagcactgtcctggatcgccagtgtccctcaccctctagtcattcctctagaaggctcttcactcagaaatgtcagaactagagaggactttagaattcctttgctccagtttcctcactttatagacagggaagctgagaaccagagaagtaaatcaacttgttcaaggttacccagctagagttgggagaattatacctagaattcatgcatcctggacacaaaccaattattcttcctaccacaccccacctcctctgggcaggcctccttcctgaagctgaaagatgggaaccagatgctgaaaacccacagtcccactaaacctcatcccctttgccctgtccttaaggaaagagaaaaatgagtcaggttaatgtttttccattccagtactccagaaaaaaagctgggaagaccaagaacccctctttaaagttttcatttcagcccccagaaccacatgggctgttagaaatagaagtggaccacccacattttaaaaaaatcttgcagataaatagggcagtatctgaaggaagtcacttatgtgtagaaggggtaataaagtcaagtgggagagttggttaacaggcatccttctgatccttaagttacatgatgctgggactcttggaattgggaagatttggcctggagaacatgaggctgagggaaatgagacaagactttcataactgacttccagtttcaaaacagttataggcatagacaccccaagggaagacaaacaaaaaagacataggctttcgttatataaggaagattcagatcagactgcctgagaacttccaaactgtaaatgcagcaggcaggaaatcaagaaagaacacaaggcagggaaaccaaatgtcttgacctcagaatccttctttcagccccagggtgctgggaggaggtggtcccatggggacagtgttgataataagaggggaaaatcatcaatgtgtgtatcaggccattcttgccttgctataaagagctacctgagactgggtaatttataaagaaaagaggtttaattgactcacggttctgcaggctgtacagggagcattacataggcatctgcttctggggaggcctcaggaagcttacaatcatggcagaaggtgaagggggaagaggtgtctcccatggaaggagcaggagcaagagagagatggaggaggcactacacacttttaaaaatcatatcttgcaagatcactcactatcccaaaaacagtaccaagaggatggcactaaacaattcatgagaaaccactcccacgatccagtcacctcccaccagccccacctccaacattggagattacagttgaacatgagatttggttgggacacagatccaaactatatcaatgtgttaagatcattgtaaagctgatcctgcatccctgctcaactggtcacactgggaccctgtctccccctgaccaagcttctccagctccctgggaaagataaaagatggtcagatagtgccatcttctccagcaagtacagctttgccagaggggaagacaggtttagctctccctcctatcatggactcattaagttatacatttaatgggggtgagtctgtgtcaataagatccgggttctcagcagaaggctcaggcacaggcacgctggagtggcctgtttcctgcacagaggggcaatgtgagcccagaagagctgaggggtaaggtaggggtggggagtagagaaaatcccagctgcagtgtcctctcctttcctcttttctcttgctctctgcctgctcagtgtccacgctaatgaaaataggcctgcacagcttcttctgcagcccaagaatttgttcagagcaatttggagccaattgaatgaacaggaataaacaagcagatattgcagtttatggctggctgcttcaaggccccaggtagtgataagaggccgaggtcctttttatgcccacagcaagaagaggggtggaatttggtctttttaagggcagtaaataggaggcacagtcacaaggaatagggggggtaattatgctctgtgctaatacagggctgtggccatgccacccagacctgagaaatcattaggtgattgagtaaaaggttgaaacagtgggagacagtg[450 bp omitted]agccaagtaaatagctctttttagggctggagtcacagtcttggactcagaactagagacagtgttgaacagatattgttgaccttgaccaagcatctataccttagtgaagtatcttaggtagagacgcccagaatcagcacaaagaagaagaaacaacatctttactaggacatcctacatccttaggcattttctccccctccactactctgagaataaaatctaagatgttgttttccttcaaaccctaccacacacatactttgttctgctttgtagctgtagcactgaagctataaaaatgaataagattttgttcctgctctcaagaaacaaaagtcttactgtggagataaataggtaaacagattatttctacctataacacagaagattccatgttggaaatgggtacaaggtattagacgagccagagtggctaatccagccacatggcatcacgtgagctgagttctgaaagattaggaccaggaattagccaagaataggcaaacaggactgcactcattgtttgaggcagagaaaacagcacaagccaaagcgtgaaggtagaaaattgtatggcttatttggagaattactgttggcccagtattaggaaaacataaggtgtggtgcagatagatgggccagatgagatcagccgttcccagacaccatgctagaaaatacaggctattcaataaatcatgagtgccaatgaagggcttcaaactagtgtgggaggggcggggaagagggtggatgtggccagatttgcatttttggagaaggggtttgagggagcctgggaacaaggagaccacttaggaagttgtgattaaaaaaaaaaaaaagcccagtccagatgagatgagacataatgaaggtctgacctagggcagttgactttagagtgtagaaaagcgaaaggttttagggaattcttaggagaatgagttggtgcttgattggatgtggattatgacaaagtcccaaaagtgaggctgatggccagatttcaggcctagatgagcctgggtgggactgaccaggaggatgacaaaggcttgggagaggaagagatgcttccacttatcaggtgaagcccaagaacttgggggggtatcctggtggagaaatttccaggaaacgttgagtccatgtcacagccccctgccactgtgcagcttggtggcttagaggaaggcatttcgtctctctgggcttcagtgcctgatctgtaaactgcaatactcactctccccaactcaccttctgtaaatagattgcaaagaccaaatatgaaaatgtatttcaagcacttcggaaataaagctgctgtataaacacaatggatttaaacagtttctgtattgggcattctcaggtttcctattgcaatgaaatgatttaaaaggatgaactcactttgtgataggtctgctcttttgacttttaagaggtgtttgaaagatatatgagtcgacaagtgtgatttgcttgactttaactcttttcctcttcggtgcggcggagaggcagggatgcatttcacagagcacatgagcaactcggagggacctgggaagccatgtggctgatgccttgctttacagaagaggacaccaggcccagagagaggaagagactccctgggacagcatgcgcagccagtggcaaagccaggacccacatgccgatccccccttccccgcagccctccctgtgtggcagggttggtaccgatgcgataccacagccacagccctcccaacatcaacccactgggccgcctgtgggcctctgctcttcaaaggaagaaagagctatttgggataatggtcgcagagccctctgaagttccaaagagttggaaaaaatacatctataagacccatattaatgagtctctccctgttcatttcaagcccagaacattttttggatttaaataatgcacgactgaatatggatgggatcagtgactcagagcagcggggcggagatgtgggattgttaataaattatagcccttgggccagagtggggtgtaaaaggaaacagaagaaggacagaagacaagataaatgagccttcagatgggaagggatagggctgggagcaggaagaggctgccctggacatgggcagagcctacagctcctatcccggtgtgagccgggacaggatgaccagatggcaccaagaagggtaaggggaggaactgggcatgcccaagatgttcagacctccaggacctgatccaatgtgaggatgtatggacccttcagtcatctatagggagcccacacgcaggaagttccctgaggctgatccatgaagctcagctcctgggagatggttttccctaaagggactgtggggtgatatgcatgtgcaaagcagcacacaccacgtgggcctcttggcacactcatatttaaaggatcagagaattcctgctgtatcaacctggcttgcgccacttcccaaagctacctgaccacagaaccacttcctcacagacctggccttggaagatacagctggggaccataccctggccctccttcctgtcctcaggtggcagctgctcctgaaatgacatcatgttttcctcttctatggtagctctaggtactggggttccaggagccttactaagtacttaagcagttcaacttgtttggtataaacttgggccaccccaagcacccaaagtgaaaagtctagatttctggtgaggatgcagatgtgaattccatttaacccaatgcagcaagtatgtcctgaatactaagtactcagccctgttgtgaatacaagacaaatacagtctctgctgcgaccacaatctagaagaaggggcaagacttctcctttgggggattcaagaggcaggttctatagatgttttaaaaaagggtgagagaagtcaggaagacttttttttattgtgccaaaataagcataccataaaatgtatgatcttaaccaattttttttaattattattatactttaagttttagggtacatgtgcacaacgtgcaggtttgttacatatgtatacatgtgccatgttggtgtgctgcacccattaactagccatttagcattaggtatatctcctaatgctacccctaccccctacccccaccccacaacaggccccagtgtgtgatgttccccttcctgtgtccatgtgttctcattgttcaattcccacctatgagtgagaacacgtggtgtttggttttttgtccttgcgatagtttgctgagaatgatggtttccagtttcatccatgtccctacaaaggacatgaactcatcattttttatggctgcatagtattccatggtgtatatgtgccatattttcttaatccagtctatcactgttggacatttgggttggttccatgtctttgctattgtgaatagtgccgcattaaacatacgtgtgcatgtgtctttatagcagcatgatttatattcctttgggtatatacccagtaatgggatggctgggtcaaatggtatttctagtactagatccctgaggaatagccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggtttttatttgcatttctctgatggccagtgatgatgagcattttttcatgtgttttttggctgcataaatgtcttcttttgagaagtgtctgttcatatcctttgcccactttttgatggggttgtttggttttttcttgtaaatttgtttgagttcattgtagattctggatattagccctttgtcagatgagtaggtggtgaaaattttctcccattctgtaggttgcctgttcactctgatggtagtttcttttgatgtgcagaagctctttagtttaattagatcccatttgtcaattttggcttttgttgccattgcttttggtgttttagacatgaagttcttgcccatgcctatgtcctgaatggtactgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccaataccatgctgttttggttagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttcattgagcagttgtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggataatctgacttcctcttttcctaattgaataccctttatttccttctcctgcctgattgccctggccagaacttccaacgctatgttgaataggagtggtgagagagggcatccctgtcttgtgccagttttcaaagggaatgcttccagtttttgcccattcagtatgatattggctgtgggtctgtcatagatagctcttattgttttgagatatgtcccatcaatacctaatttattgagagtttttagcatgaagggttgttgaattttgtcaaaggccttttctgcatctactgagataatcatgtggtttttgtctttggttctgtttacatgctggattacatttattgatttgcatatgttgaaccagccttgcatcccagggatgaagcccacttgatcggtggataagctttttgatgtgctgctggattcagtttgccagtattttattgaggatttttgcatcagtgttcatcaaggatattggtctaaaattctcttttttggctgtgtctctgccaggcttttgtatcaggatgatgctggcctcataaaatgagttagggaggattccctctttttctattgattggaatagtttcagaaggaaaggtaccagctcctctttgtatgtctggtagaattcagctgtgaatctgtctggtcctgggctttttttggttggtaagctattgattattgcctcaatttcagagcctgttattggtctattcagagattcaacttcttcctagtttagtcttgggaggatgtatgtgtcaaggaatttatccatttcttctcgattttctagtttatttgcatagaggtgtttatagtattctctgatggtagtttgtatttctgtgggatcagtggtgatatccccattatcattttttattgcatctatttgattcttctctcttttcttctttattagtcttggtagcggtctatcaattttgttgatgttttcaaaaaaccagctcctggattcattgattttttgaagggttttttttgtctctatttccttcagttctgctctgattttagttatttcttgccttctgctagcttttgaatgtgtttgctcttgcttttctagttcttttaattgtgatgttagggtgtcaattttggatctttcctgctttctcgtgtgggcatttagtgctataaatttccctctacacactgctttgaaggtgtcccagagattctggtatgttgtgtctttgttctcgttggttttaaaaaacatctttatttctgccttcatttcattatgtacccagtactcattcaggagcaggaaccatttttaagtatacagttcagtggcattaaatacattcatgatgttaggcagccattgccagaactctattcatcttcccagactgaaactctgtgcccattactccactaactctccactctccgcccccagcccctggcagcccccattctactttctgtctctgtggatctgactactcaagggacctcatgtgagtcacatctttcagtatttgcttttttgagactggcttattttacttcgcagaatgtccccaagtttcattcatgttgtagcatgtatcaaaatttccttccttttttttcctgagatagggtctcactctcctgcccaggctggagtgtgatcatgcagtggcacaatcacaaatcactgccaccttgacctcctgagctcaagtgatcctcccatctcagcctcccgagtagcgggaactacagatgcatgccatcacacccagctaggatttccttccttttagaggttgagtaatattccattgcacagacagaccacatgttattgatctgggtatctttcctgcagaaggcaggaggcaagttttccaagaggaggagagagaagatgataattcaggtgtggataatcaagggtggggacccaagctcgacagctttgtacaggatcctctcaggcacatggaaatgaactggctgaggggatgcccatgcatagctgtgtgacagtgtccactgaatcctcggcctgcaggggactgaggaggtggcagagcctccggcctggcgaggacatggagtaatccctctgcattgctcaaaaaaaaaaaaaaaaaaaaactagttataggtagatggacagccctccctcctgctcctgggagtctctgattctgaggtaggttctggaagaattgctcaattgagagtaatcaggacacgtttatacagaagatggaatgaccccatattcagggtgattcccagcaatcataatgccttctcaaaatctgccccctgatggaagtcatcccacttgttaaccaaataacacagccatcagggcccaggctctttccctcagatcattctcccagtgaggtcctggaaatctgtgtgtcacagagaggactagctgctctttcctgaaggcatttaaaatgcaactttaccacaaccttcatgaccctgctcatggcccaggccaggtgacccagggactttctccatcttccctttggggagcagggctctggccccataggcctgtctcctgcttccctcttcactgaacaatggccctctcattagtgggccgccttccctgtccatgggcctttattacagtaactatggagtcagccactgcacttctgacaagacggaaaagagcaattaggggctttagtctctgccttgcggcctggctgacatcatcctcccttcctccacctccccactcatcattaacccccttctctccctgctgcctcctggtcaggaagtcaagctagggatgcacagaggaaggaataatgagtagcagcccccacattcaaagaggccagggccctggggatactggaagagggaggaaatgccaggcagcccagcatccacagaggcccgggtaatcgctgaggtcactggggcagctcactacccctcctctgccagacctggctccatagccatcactcacctggattccagcacattagaagcctgcagggttggggccagtggccactgctgctctctgacccatccccaccacacatcccactgtgacccatccagccttgtcccaggcatggccaagcactgagaaggcaggaggcaaggtgaaaacccaatggatgatggccattcccagggcaccaaaataatcaccggatcttagaggatgtcaggaattcttcaagcctttcttgagtgcctactgtgtgctaggaactgaggacaggatagaataaaggcagacccttagggaatttccctgtcctcagggaaattcagacagacattgagccaggcagcaggaggagcatgctgcatgctccacggacagcataggcagtatgccaggacagcctttaagaggggcatctaacctagtgttgagcatcaggaaaagcttcctgaagaaagtaaagttttggttaaagccagaaagataagcagaagttaactatgggaagtgggtggtggggttggtgtgtgaaaaggccttaccacgggaaagaagatggcctgtttgaagagatcccagggcccagtgtggctggaatgtagccagtgaggccagagatgaaggcatagaggctatgccacccaagcctgacctcccccaccccatccatctcccaggcactgatggagaagccccttgtgggaaatcccaggagactgttatccagtctctgccaaaacacttctagtggaggaagcacaaggtggtccatttatgtttagctgcagttgttagaaatgtcttcctcaagctaaggtgaaatctgcatcggggtggtgaacgggaaagaacctggggcttttaatttagacagacaggatttggagcctttctcagccacttgccagctctatgagcatgtccacatgacatgagcttctctgagcctttgttttctcatctgcaaaataaggaagtcatatttaccttctagagctgttgtgaggactcacggaaagagcaagaatacagtgcctagcctaaatgtcggcagtgcctagaccaaagctcagccctcttttctcagccatcagtcctctctgtccctctgaagtatatagcatttgttagaagagatgaccctttatatttccaaagcttccgtaaatctcattattactagttccttggaccactcctcatatcacatggttttcaagccctttaccatctaggtgtaggtcccaggataattctgtccctaactgtcagctgcatgagacatgagggcagtgttggtctgtctcactcattgctccatccctagcactcagcacaatgcccagcacacaggaagcaatcagaatatatttgttgagtggatgactatggtctgggcatgatgcttgtattaatgcagcctatgtgtccttcatctttaaagagtctgtgtcagtatcttgactcataacaggctaatagacaatgaaagccctaggactttcatccatgagctgctatggcattaagcttccctcatcctgtccttattcatcctcatttggttagtttttgaactaaaggcaagactttgatttatccctcctacattttatcttgttagtttcagtccattgttctggcctgcccagaccttttttgaatcttcactctgtcatccaacaaattagctctcccatctggctttgcttcatctatcaatttgttaagcatgcctcttatgtctccacatatctgaggataaaatgtcaaagaagacagacacattgtatggttctttggtgaaatggacaaacctcctgtgacctgacccagcactaaggacttcctggttgacactggcttgttaaccaacacatcttggggacagttgttcaactagtgaagaagccatcattcagcctactctactccattttgtccacaacaatagtgcaagaggcaccacaaatccacgcctcaaataaaacccttgctgccttaataattatcatgtacgaggggcctaccaagtgccacacctaccacacaccacctcatttaaccctcccaacaacaccacaggcagctgcagtgcagggaagggagcaggtaggcaagccaggccgcttgagttttagtactgatgctacaccttcctgcctggacaacggtggacaatgaattgccagagtgggccatttgctacaacaaatgatttcaaaacctaagtggccaaataccataaaggcttacttcttgttcatgtcacagtccaatcccacaggtgacctcctatagatggtttggggactgaggcttctcatctagtggctccttctcagaggcctccactgggtcttctccatttagcctaagtgcaaagaggtgggggaattccaaggcaggggcagtgacttatgccactctgcccacattccattggccaggctagtcacatgacccatctcagcacatgggaggctgagaaatgtggagagtgtgggttggggaacactcctcacctatgtcattgacataataacattccttgcctcataatgtctgtatcagttagggatttccacacaagcagagccaataggtgagaaagagagagatttacttaaagaattggctcatatgattgtggtgctggcacgtctgaaatttgcagggcagactagcaggctggaagttctggcaggagctgatgttgcacatgtgtgtgcgagggcagtctggaggcagaaaaccttcctctagagggacctcagtcttttctcttacattaaagaagcccctagtgctgcgtcacaagaggcttgtccatttctccaaagaaccatacaatgtgtctgtcttctttgacattttatcctcagatacgtgaagacataagaggcatgcttaacaaattgatagacgaaccaaagctagatgggagagccagtatgctggaggacagagtgaagattcaaaaaaaggtctgggccagaacaatggactgaaactaacaagataagatgttggagggataaatcaattgaatggatgaggcccacccacattatggaggataatctgctttactcaaagtcttctgatttaaaggttaatcacatctttaaaaaaaataccttcacactaacatccagactggtgtttgacaaaatacctgggcaccatggcctagccaagttgacatgtaatgttaattctcataacgttattgtgagaattaaatgagctatgcctgaaaactatgtgtaattctaattagcccagttcccaatacataaaaccaaataaatacctgcaattattattgccccacttttacagatgaagaaattagggcttgaacaagtaaaataacttgcccaagaccaccgctgccagactctggagccaatttctctcaactcctctccacactccttgggaccagttagttaagagtagctgcagcctctgggtagaggtgaagatggggtacaagctagttagtgggcaggctacatgctggcaaagggtccaacatgggacagtgtggtttgtactcataaaagcttgccaaccaaaatataaaagcatcagtgaaaaaaataatgcagatgtgatactagagatagaactggttcctctctagatgagatatctaggacaatgcttttacttcctgtgatctcataggcctctacattcaccagcatcagtctaggtcagtgtgattgggcccagaaggttctaagtggcaaggccgagtctgctgactcatgaaagtccattctgccacatgcaacaagctcacctttgaacactgggcaagagtcggctgactagaaggtggcaaaggtgaacctgaggccccagattctgttctcaggctggtcacaactgatgcttgcagaaactaggctagcgagtgccctgcaaacatatatgggtgattgcagaatgcaggacccagcaagactgtgtgactggtggtacacaaacattccctatgagggagcaactgaaaccctgtcttgcagcagtaagccagaagtgcagaaagcagagaactacaagggagtctgaggtcgatgctgttctctgctgtctgatgttccttgcagccctcaagctgatctgctgagcccttatctcagccaatctattgacaccatctctagatgcttttacctgctgaacagagccttggactagaaattaaagtctagaccctcatcataaagccatcaatgacactgggggatagcactgatccagtttgagtcccagttttcctctcacatggatctactttcctccagtccaaccagctacatgctaacccgtttcaacatggctttgaaaaccataaagcattatccaatgtccagcactatcactggcactactgttttcaggaaagagattcaaggcagctcccatccagcaagcttctctctccttccatcccagctggtacagacctcagcagtgacacccacagatgccagtccctcagcatcgtctacccatggtcagcatcccaggcggcaaatattgatcacaactggctccatcctggtcaccagacatttcagccaaacgaaggggctctgaggaacaaggcttcaatttctgcacactgtggtaggcaatgatggccctcccgagagatgtccatgtgctaatccccagaatctgtgactatgtcactttacatggcaaaagggactctgcagatgtgattacggttaaggccattaagaaaagtatcctcgattatccaggtagaccccatctaatgacccaagtccttaaaagtggagaacttttcccagctgtagtcagagggagatgcagctatagaagaagggtccaagagatgcagcaatgctggctttgaagatgaaggaagagagtcaagagtcaagcaatgagggaggcctttggaatatggaagaggcaaagaaaccaccttcccctaaagcctccaggaaggacctcagccccgccacaccctcatcttagcctggtgacagccaagtcagacttctgacttaaaaaccccaagagaataaatttgtcattttaagcctacatgtgtgggaatttgttacagcagaaatcagaaactaatacacatgccaggtggagaaagcaccctcttgcaacctggagcacagggaaggagtcagcagaaaaggagagaccccggacaaattcctggactcactcttctgcctctcctccctccattaagtaataaccatccaggcttgaggagttcatgaactggggggttggggggtgttagtgcagagaaagtgatttctggatgagaagttagaatctatatccacatctgggctggacccaccttcatgacttcaatgtgtttctgggttttgagtgtgtgtaagaaagaatggagaacatgactatctctcctatatccatcccccttccaaaaatggagaacatcccttatctgactcctccttcctcccctctccagccagcatccacaagggatagtccatcaccacagcctctccccggtgcctccttcccatcccagcaagagccagcagccatccattcttagctcttagtcatctctttatagcgatgaacgccatcgttaggagcctttcattatcagcgacttgcacgcagctgatgttgatttgatagaatccaatttagcatcccactctgggctctgctccataagcgtttgggtttagcatgcacaggcagtttgatgctgtcttgatggccttttaagcggctgagaaaattgctggcatggcaatttagtggcaggcgggctcctggtgggtggggctggaggaataagggaaggagcaagagaccaaggggacatttcagcccatcgctgtaaaaggcagctaagcagttgggaatcacacattgaaagtgaagcagcaacagacaaaacctccagggtgtctgagggggcctggcctgatgagaccatggtggcttcttctggcaggcccagttctgcctccaaaatcaaagtgcctgtgaagggcacttcaccatccacacactgctttcttccatgatcttccatttccctgcagaatggataaagttcctagagggcagtgctgtgctggtaaacatttaacctctggatctccaaatttaaaagtcctgatttgtagcatttgtccattaacctggtgcaaatactcccactatgccaatttcaagctaccaacgagatgccactgaatgcagacttgggaagagatgtcctcgatgagttctgtgggtttgagggtcatgatgttattctgaatttgagcccattttacaactgaacaagctcaggccctgaatggttccgatttggtcatgagctaatggataaagcctttgccccaacaagaggccacagatgcaaggctactccaccgctttgctatggacagatgtgcagatctgaaaaagcgctgcctgggccagaaccaggaacgtggtagacaggcagccacaccctcttccccactcatccaccacacactgtatttgagtgtgtgccttctcctggggaagggagaggtgtgggatgttggggtgagggcagggccacctcttcctgggaggccgaggacaagagagctcctctttcccctgcaatctgattttagttcaagaggctgaatggcctgagaagtctctttttccttcccacctggctccttgccttctctttctaaccagagacctcagaaaatctatggcttgaaatcttccctctcctgagaggtagagtgtagtgtgtgtgtgtgtgtgtgtgtgtgtgtgtgtgtgtgtgtgtgtccagcctctggcctctggctctcttcttctgtcctctaattggatgctaggcttttcaccccagaggccagaggcatctttagggtgatacagtagaaacccagtgccccgcatccctccttggcccacctctgatttcagccacagctgcagtgcagagttccaggctggctcagattcacccctctgacagtgtcctactttagcaacatgcagccaggctcacctccttctgaccccagggctttctctgtcaccatgtgttagacctgcaagcagcagcagcagcctgaagtacagggagtttatgcccccagggcaacacccaaccaaacaggacaggagccagtgggaaaaagcctcagcctctcagtcttcaggcaggcaattcagggcatccttactaagttgctcagaagccccggcaacaccaagactccatggtcttgcttttctctgctgccccctcctgcttcttgagtcccctcccaaataaactactgatagcagcagaaggcagccaaatgcgtaggcaggtaggggcaggtccccagtgaaaccccaccaccaagctgaagatagcttaaagcctgaaagccaagctacaagtcaaatccacaggtcagattgagaacctgtcttcccatttggtgcactttcctctgattgatccccactcttcacctattttatatatacctactctttcctaattggttttctacactgtcatgcccacctttgagtggtgtcttcactttaaccttttttgcatactcacaaaccaatgagcatatacttcccatcctgagtccataaaaaaccccggacccagccacactgagagaaaaatcacccaactgcgggggtgaaggatcgcctctcccccagctccgcatcccctctccactgagagctgttccatagctcaataaaattattctctgcccattgtcacccttcaactgtcaatgtatcctcattcttcttggacacaggacaagagcttgggaaccactgaatgtggatacaagctataatactgacagcggggtggagaggtgattgccggctagaggtcccagcttacaacatgatcaagaaaattcctgggtcactacctgcaccaactccttgtctcgggctctgctttcagatataaatgcaaaccttctgaggtgataccaatattctccccattttacagatgaggaaaccaagacaatcacaagggtgattgtctacccacccagtgtgcccataggacaggggttcttggagctgcaaccacagcccacattcactgagatggctgggacagggctgcccatgccgggagtcaccttggccataaagaacaccccataatcagtgagtggctgtctctgtttgtgcttgaattgttctctctgaaaagaaaccttctcaaagtttgaactcatttttgttttgcttttgttaatatatacatatatgcatatacacaacatacatatatatgtataaatctatatgtaaatatatatgtgcataaatacatattaacaaatgtgtctgtgtgtgtgtatgtgtgtgtatagttgaaagattggaaagaaattttccaaaatgacaacagtagttattcctggatggtagcagatgatattcctattttgtgtgtgtttttctgtcttttctaattttttccacaatgagatattaccctggtaagaggccaaagcattattgtttttaaaaacatatcaaacctctttgatggaattcatcattaaagtaaaacactgactgctagacagcaggggcccttagcaggtgtgtaaaactccatcccagcagcaagcccatcatttcctaggaaacccaaacagtagagaggacagagggcagagagaagacagaaaaggtgaatgtggaggaagggaagatttaaaagtcagataaagtccccttctccagacatgcaggtgcactggggtgggaaagggggctgggagaagaaggatggggacccagttaccgtacagggcatgggcagtgtgcaccagttgtgggacagtggtgatgatttgacaggaaggactcaagtttgaataagatgcttttagagagctctagaaggaatgggcaagatcttggccttcacaaagctacagtaaatacattaggcaacatttgccatcccatttttggagatttccattcacctcggagtgctgagaaaaggagtattttcccaggtcggccaattcccctttgtccattcatcccacaaatttggatggagcacccctgctccagccactgcactgtcagctccaggagttcaggatcacaatggccttccttactgtggtttccccaacagctgttggcacagtgactggtggacatctaataactgggactgaataacagaaaatccaaccagtaccccacctcatggaaaagaggctgtcagtctgggtggaaagaaaaattagtccaaagaccagagtttttatctctgtccttctagcaaaccacctcacaatctttgggaggtcagctatttcctttatgatccttcttggacacaggacaagagctccaataggaagagcttaccttaaaagaaaatccagagaaggaatacataccatctgttatatacttgttgttccttaggatcaagaactggcataaactgagggcataaatcagtcctgtcctcaaatgctagagccacaggagagtctgaagaagcaccccaggcagtccatggggctcgacgaatactgagactaaggcggtggtattgggggctgggacagcgctggggctgagtgtggatctttctgtttctcttcaatggcctctcccctgggatctcgtggtcttaatggaggctgcattagctaatctagtgattcaattagttctaaatgctcctggcctgagaaggagggacaggcaaggtggggatttgctgactcctatttgccggaaagggtttcccaagacaatggagatgcaatttgaattcccaagccccccacttccttctccattcaggagccccagggtcatcaacccaaatgagatcatgcctgtgaaagcactctgtaaactctttttattactcattccctcctggggggagagccccccactgccttctgcagccacttgatggcccagagggtaagggaggtaagggaggctcctcaggcagaaggaccagcaagtttttgagcggagaccccagaactaccctaagaaataccagactactgatttttctgactttgtagaatgtaaatgatttgttgatcttctgcagcaaacatcaactttttctcttgtgacagctctgttcagttctgggcccctctattcagatggaaaatcctgcaccgctcacatggggacacaggcacaaactgtctctaccattatttcctctggtaaccttctccccacagagagacctaactttgagagcaaggaactcatcttttttttttttttgagaaggagcacatcttaggtggcagttcctagagagctctgctcgggacctggcaggaagagacagaaaaaagaaaatgtagaagaagagaggtcagcaaaaggaaaaaaaaaaaaggacaaaatggcacagaggtgagtctctgccgtctggaggtccttggaggaagatctgcttattgttgctagctccctgggagctgctggaattgggaggagtcactttaccactttgatctcaattcctcccatgtaaaatgcgaagatttggttggaatagtgattccaacttggattgtgcgttggaatcacctgggaagagtttaaaaccacgcatgccttggccctacacacaaagattctaaactaattggcttgggtgtgaagtctggacatgagatgatttttctttctccaggtagtgacgtgctggtaaacctaaacacactctcaaaataaaaagagatctgatttgtaacatttgaccatttccatagtgtaaatattcccactctggcctatttcaagcagccaacaagtgtaacaactggcataccgctgtctctcgggaattctaaagagaactgctacatcagctacttcaggaaaacgcatttacctgggaccatggagcgtcaagtcctcggagtagaggtgagaagaaagggtctggtcataactcccatgagaatgccccccaacaaccccctttcctctcatcccattctccccaccaaaggcactcacagtggtttgcggagataaagggcaaagaaggaatgaaagtcccagtggcctccaaatgctgtcaaggccacttccaggaaacaacctcttagctgttcatctccctttctttcccatctggaaaatctctttaacactgaaagcagttagccagtcatctgaaaggtcaatttttcacacattatccactttcatcagcagtaagatcaagaactgttttcccagaagacattcagaacttctgttagagccagggtgggaagagaaggggcagagggagggaccaatgggaagaaggaagacatccgctcctcctaagcaatggcgaggtttccgacgtttcacctggggccaggtctcggcctctcttcgtcctctcctccgaggctgatcctcttgtattcaactaaatttagtagtatttgttaagtacattcacaaattcagctctgtgctattttgagaatttggttttttgtttttatttttatttatttatttatttttgagacggagtcttactctgttgcccaggctggagtgcactggcgcgatctcggttcactgcaacctctgcctcccaggttcaagcgattctcctgccttagccctctgagtagctgggactacaggtgcttgccaccatgcctggctaattttttgtatttttagtagagacagggtatcaccgtgttagccaggatggtctcgatctcccgacctcgtgatccgcccgcctcatctgggattacaggcggtgagccactgcgcccagcctagagaatctggttttttaattggaaacaactgtcctttgggacattaacaactagtaggagagtctttaagtcaagactcaagggagaaaccaacaagctgaggaactctaagtcgtgtgtaaatcagtattggattggtgcaaaagtaattgcggtttttgccatgaaggtagtggcaaaaacctcaactgcttttgcaccagcctaatatgacagttgggtacgggctgcatatatgagtgttggtgaaatccaggatatgtttataaatgtatttttttatatcccaccaatttccaaaaaggagtgtaagtgatgagacccagaaaaggaccaaagccagtacagattcacactgcaagtcctcatggatgggagacttgtcctgatacatcaggccattgagtgatcccccgggtaaggcaagtccaggtctactgggcctctaggaagtaactttctcaggcagatggccctcagtttgggcagacggctctggcagggccataaacttgtcaagtttttaacaatgggtgggtatgcctccacttagaggggacacctttggctaatgtgctcaaacacattcaactggcaagcaagagacccagaatgagtccatcctgccaacgtcacagagccaagctgggcctccccagcattcattcagacctgaggcccaggttctagtccccactctgcaataaacaagatttactgctaagattcatggatgccctaaaggagaacgggagcatgaacttggataataaacaaaataatcaataaacacttagcatttgggtctttggccattgctgtcttggatttacgttaggtttgggctaatatgttacctctcccgagcccacattgatctggtggtggttggatgcctgggcgagtcatcatgaaatataaaattagatgcagagatttttttgcataggtagagtgaatatttgccatcaacaaagcaccctgaaccacagaattgactaatattgaagataaagggggctttgagatgatcagctcagatcatccaattttacagatgaaaaaaaaaaacactaaagaagtaaagtgtgtgggtcaaagtcacagagcttcttagaggtggacctttgtctcggtgtgtctgagacagaaggcgtggctccagcactcaccaccattcacaagcccacacgctgtgcctgaaaggatatgacaggggaagaaaaggctgaattgcaaaagaaatatagaaatagacagtaatatggatgcaattcagtggcagatcagggggcagaggaaggaaaaaatagattctagaattaggcaaggaccagatcagtcaagggtgaaaaaggagaattgtgaatgaaagatgaatggggtacagaccgtggagaaagatgaaataagcgaagtatgaaatcaaccctcctttggccgtaccttccagggcagccttgaaatatgtcacttactgcctgtcacttgcaggtatagaggaggtgaagttggtggtgagtgaggtggcagtggggatggctttctgtgtgtggccaggtcacagcagagggtcttcaggggagactttcaggaaggagcagtactcctggaaacttaggggttaactcatctgggtagatagcggaatctcttcctcaccagccaggatggaacagtgtctgcctttcttcattccctgctgaacctcttgcagctgcacttgttttcttctctgacctggttcttgtctccatgagtcctgggtggagtgccagatcaagcccctgctgtaggctaggtgcggtggctcacacctgtaattccaacactttgggaggccaaggcaggaggatttcttgagcccaggcgttcaaaactagcctggtaggccaggtgcggtggctcacacctataattccagcactttgggagactaaggcaggtggatcacctggggtcaggagttcaagaccagcctggccaacatggcaaaaccctgtctctactaaaaataaaaaaattagccaggcatggtggcgggggcctgtaatcccagctactagagaggctgaggtaggagaattgcttgaacccaggaggcagcagcctcagtgagccgagattgtgccattgcaccccagcccaggcgacagagtaagactccatctcaaaaagaaaaaaaaaacaaacaaaaaaaaactagcctgggaaacatagcaagactgtgtctctacaaaaaagaaaaaaaaaattaattagttgggtgtggtggcatgtgcctgtattcccagctactggggaggccaaggcaagaggattacttgagcctgggaggtcaaagctgcagtgagctatgatggcaccaccgcactccagcctaggcgacagagcaagaccctgtctaaaaagaaaaaaagaacctgatgcaaactctgcctcttcctcgactattctaatcccacacacagaggtgtgcacaataagcccaggcctgagagtccaaattgcttagaatgaggtcctggtgatcatttagtaacacaaacctctgcccctcgccctccccatcctccctgatcctctgcctgcctgagtctgagaacaagagtttgtactgaattcgactccaagcaggtaggatacaccaaactggaagtcacagtgtgcactttagacagacactgttcaggaagtgaaaaatggcacctacacctgcattctgggtgggggcccttctgacccgtgaaaggacccgtcaagccacacaactacacaaggcttcacctttaggagaaagatgaatacttggtgaaaactagtgttgacagaccaggaagcccaacacacaaaaccaaggggcactgtgtcctccagccaagcatcactggacagatccaggcacctctcctgactgtgagtgaggccctgaaacacaaagattcaaggggctcggccatgtcacacagcaagcctgagacaccgcagggcccaaatcagtgtttcccaagtcagcaccccatctcccggaaacaggctgagcacacttttgaaaggagagagctaaggggctggcatgggtttgcttgatcaagctaaacacgggtttgatttgtcaagctgaaagtaaatacatggggttaagggactgttgtcttcacaaagggagagccaagcctagccaaaagttttcacagtctgctggccacctacaaaaactagacaaaggaacacaaatacccacttgctccctttaacccttctttcccaaatctcagagaagagaaactgggggatctgtaagtgagttgaaaggtgaactgcaaatgcctggacaggagaatcatcctgggagcaaattaaaatgcagactccagggctcccgactcccccaggctctggtctggagtagggcctggcgatctgtatttgtcacagcaccctctgttgtgtctgatgcggttggtccctggaccactctttggaaacccctggtgagatggttatttaaggaaatatcggcagacacacttgtcaggaaggaaggggcagctgtgaaataaaatataatcattggtcttagccctggcattatttcatcataataaaatgatgcttcaggttccaagtcactttcctactcatctgagttgatcttccaagctacccaaggacgcagtccacgcaaatgttattcatgtcagattcacaaaggaaactgaggctctgaaagaagtcaggggctgatctgggggcacacatttagctatgcagcagtgggaatttaaaaccaggactaatccatcactccaacttcacctggagtcaagtcagcactcagacacggatggagatgaatttgtaaaagggagtaacttgattgtcctcagaggccacagccagcatcaatgtgacaacccacaggcatcaccccagggtgctagtggggtgctgatgccccttcagggaccctaagttgcctctgccctgtagcttccgctgtgacaccatgctatccccacccctcctcacccgctaagggccaagtccatgtcagagtcaccaaggagagtggaggtgaggggaacagtggcaaaagaaaacagcatctgagtttaaatcctcccttctgcaacttaatccctgtgtgatcttgagtagggatttaaccctttccagcctccctttctccacccatatgatgaggattttaatacagatctcttaggttcattacaaaaagtaaatggaagagtgaacgaaaactccaggacacagcaatttgtgttctgtcctttctctcctcctaactcttccaaagggacaccatatgtagaggtcttggtgtttccctgaaataggagctggtactgcctgaaagtagagagccaggggatagagaaactggacgtggctgattatcagagagcctccagcctaggcgagctctctcccaattttgcccgtgactcctgcccccaccaaataggataattgggaatctatgcagcaagatgctggctcagcagagaccccatatataaaaattattcttgatggcttcaatagattttgcactgtccaggccaaaatgaaatatgaagatggggtagtggaggatgacttggatgacacccggaagtggtgattgaatacaacccatgagttacattcaatacttattgaagaataaaggtgaggttatttctctttggatcttcctgatattgtctccggcatcacattatacgattcccttcttctctgcgcactccaagaatctctgtatcgctctcggtcctggtctggtggatccccctgagggagggcatgttgcagggaaggaagggaagctaggaactcaggtggggaagcaagagacctgagtcaccctgtctgtcccctgcctggctctgggaccccagacaagccactcaccatgcctgggcctcagtttcctcacttacaaaataataccactacttgctccatttcagtcccagagatgagcaggtaaaggttcagcagatggagcaaaatcgttaagacacctggacaaaactaattgctcccacaatggttaatttggtggctccataaagaggcagccacacaatcattaaaaagtcaggaaacaacaggtgctggagaggatgtggagaaataggaacacttttacactgttggtgggactgtaaactagtgcaaccattgtgaaagacagtgtggcgattcttcagggatctagaactagaaataccatttgacccagccatcccattactgaatatatacccaaaggattataaatcatgctgctataaagacacatgcacacgtatgtttattgcggcactactcacaacagcaaagacttggaaccaacccaaatgtccaacaatgatagactggattaagaaaatgtggcacatatacaccatgaaatactatgcagccataaaaaatgatgagttcatgtcctttgtagggacatggatgaaactggaaaccatcattctcagcaaactattgcaaggacaaaaaaccaaacaccgagtgttctcactcataggtgggaatggaacaataagaacacttggacacaggaaggggaacatcacacacaggggcctattgtggggtgtggggagggaggagggatagcattaggagatatacctaatgtaaatgacgagttaatgggtgcagcacgccaacatgccacatgtatacatatgtaacaaacctgcacgttgtgcacatgtaccctagaacttaaagtataataatatatatatattttttttttaaaaaaggcagccacagaggcagggacagggcctggaaaaattttccaagagggagcctctttttgacccagggcattgtagaaaagttaaagataaatgggactctttgctctctctgcccagtgacaaatcacaggtgaatatcattaattttggaggctttgtttgttcaaaagtgagaaggctttttgcctaatgaagaactttaataggtgttgtttttcctaaattatcatattaaccacagataattaacaagcgtatccttaatgccgcaggatactgacaaacccactgaacgcatctcgttgcctataaatcatccagccatccttcaaggcagctgtttaattactcctgcatttgggaggcgcaatagtgaggctctctctaaatttggttgccaatgaaaataaagtcagcaacaattcaggtcttcatcattattgttccatcttaagatgtcgctgccagttctatttataatggtgaaaactggagacaacccaaatgtccagcagtaggggaatagcttggataaacaaattaaagggtctgaatgtaatgggttctcatacagctacctaatggcaagactcagtctatgtcaatacgtggaaaatgcacattctaaatcatgttaagtggaaaagcaacataaaatactatgtacatggtgattagaactacataaagagtacatttgtcgacaaataatggatgaaaatttaggttattaagtgttgtattgaatgcttattttctactcaaaagtggattcagtttattttttaagacaaaaggaaatactgccagcagtggctggttcaggctgttcttactcgaggcagagtgctgaggttcctgtaatctgggaaaaaaaaaaaaagtggctcagtcctttcggcgccccctctcccaccttgggcccccctctcggaaatgtgctacatgtttacagttacccaagatgagaatggtgctcttaggatggaaatcagctgaatgtgttttttcatgcctcattgttcatggaatcatagaactccaagctaggagggatcttattctcagcagtagcatctattctgctctcttttgccagaattctctcccatgagctagctcagctgcagttagaaccgccctgccaggctctcaagcccagcagaggacttagcctgaggtctggctatggggcgggagggataagtgggggaaggagtgaggggaaaggagcggcatccctgtgctacccacccacaaatccccagcaaggcacgggccaggagctccaccagggagtggaggggcagggggccttttctgaatctgggagagcacttcctattcgaagtttacaggaaatgtattcatcttaatctatcctttacagccattccactgggacttttttttttttaagagaagcttttctctttttccccagaggcaggtaggaaagcagcggggtggaagaaggcagttaggggcatgaggaacagcctgggatggcaggaagccacagctgggtgaaaattcgggtgctgggtggcaggcaacaagccagtcagctagcttagatgctctgcctgttctgtctccatgtctctgtcctgttccgtctctttggctttctcaggccaccaaaatgtgcaaggagaagggaaagggatgcagaggggccaggcgtggtggctcacgcctgtaatcccggcactttgggaggccaaggcgggtggattacctgaggtcaggagtttgagaccagcctgaccaacatggtgaaaccccgtctctactaaaatataaaaattagccaggggtggtggaatgcacctgtagttgcacctacttgggaggctgagacaggagaatcacttgaacccaggaggcggaggttgcattgagccaaaactgagccactgcactacagcctgggtgacaagagcaagacttgaaagaaggaaggaaggaagggaaaaagaaaagagagagagaaaaagagatgagagaaagaaagggagaaagaaagaaaaaaagaaagaaagagaaagaaagaaagaaagaggagagaaagaggaagaaagatgcagagagactagaaagaaagagaaagaagagaaagaaagagagatgcagactctgttgaaagaaagaatgaaggaagggagagagagagagaaagaaagaaagagaaaagaaaacaaaagaaaaagagagggagaaagaaaggaggaaagagagagagagaaagagaggagggaaaggagagaaagaaagatgcagagagactctgtagaaagaaagagaaagagaaagaaagagctgcagactctgttgaaagaaacaaaagaggaaggaaggaagggagagagagagagaaagagagaaagaaagaaagaaagaaagaaaaagtaggaaggaaaaagaaagaaagagaaggaaagaaagaaaagaaaagaaaaagagagagagaaaggagagaaagaaagggagaaagaaaggaaagaaagagaaagaaagagacagaggagagaaaggaagatgcagagagactgtagaaagagaaagagaaagcaaagaaagaaagagatgcagactcgaaagaaagaaggaaggaagggagagagaaaggaaggaagaaagaaaaagagaaagaaagaaaaaagaaagaaagaaggaaggaaagaaggaaagaaaagaaagaaggaaagaaaggaaaaagaaaggagaaagaaaagaaagaaagaaagaaagaaagaaagaaagaaagaaagaaagaaagaaagaaagaaagaaagaaagaaagaaagaaagaaagaaagaagagaaagaaagagagaaagatagatgcagagccgaaggtctcggccggtccagtgatcccagggcccaacctgtggctctctggtctcttccccgcagcattttacttccaaagcaggaggatcactcactgacccagcagcgctgggagctcactttgccatcagcccggactgatgcgtggcatgccgcggggacacatgcctctgtagaggcagacggaggacagcaccttctccctcccaccacccctgctgtttgggagaggtctccatctcctctcccactcacatctgcttgtggtgcactacctcatcggctctcattctcgctccctgcttcctacttctagttaagattttatttctggtcctcattaacatattcaagcaaagctgaggctgaagtcctgaggtgacctgaaccaagacgttgtattcgcttctgtccgtcacggtgtgtgtaggaagcatttaagccaaagctatttttgaggagctctctaagccagaagtaccaataataagcacagttagaaagaggaaggccggccgggcgctgtggctcacgcctgtaatcccagcactttgggaggctgaggtgggcggatcacgaggtcaggagatctaaaccatcctggccaacatggtgaaaccctgtctccactaaaaatacaaaaaattatccaggcgtggtggcaggcgcctgtagtcccagctgctggggaggctgaggcaggagaatggcgtgaacccaggaggcggagcttgcagtgagccgagatcgcgccactgtactccagcctgggcgacagagcgagactccgtctcaaaaaaaaaaaagaggaaggacaagccatcatcatctgcaaattgcccgaggctgatgggagagggtggtgggaaaccaggcagatggacatttcctttcagtatgcacttaagtaaggtcatggaaatacaggcatggccaaagcacaggtgtgatgcgggcactgtcaatatcctcattttacatgagaagaactgacggtcagaagagtccaataacttctccacactcacacagcaggtaggtaatgacaccacgatggaaagccaggtggacaccagaccccagctcctacagagtgttctattctgccacattgatgacccttacaggaaggagtaaagggtgaacgaaagacaaataagaaaacaacaacaacaacaacaaaaacaccattaaaagaaattcaatgaccagccagaaggaatattgaagtgtcaaaatcgtaacctcccatcacagcacagaatctaggaaattattttctaatatgttttgctctggctctgcatccctaaaatgagcttctaagctaccccatggttttctgaagggcctgtttactggggaggctgtgcctggaccaaataacctggcaggttctcaggccaggatcatttatccacttcatttcctggttggcaatgcagcctcctggggctctagggtgagtggagtgctgtggctcacttctgtccacctcaggcaggccagataaccagtggggcatctgcccaacacagcaggggccagggactgtgcccaggtgcaggagggcatccagccagccagcggatcccctagagagctctagacggtcagaaggaggaggaagctatgcagctcttcccatgatcacctactggtgccattttcttacctgccctcttgtctccaacttagcctacatctttactagaaaatccatcaggaacttttactatatcatcccgtgcttcaactccagccagatgaccccttcctaccattccagtggttcccccaattccctccccaagggagccatgcaaagaatgtggcatggatcatataaacagtgattcctagctattgtcaccaatacaaaaaaaattctacaaataaaaaatagggtgcaagagagcgagaggagaaaatataaagaaagtgtattcagcatgataggatttcatttgtgtaaaacttctaattacacatgcttatttgcccagagggtgatctatagttgcctggggtatgggatgggggatttcagagtggtttttctttcttttttatacttctctgtattaaacaaaatcctatactaaacttgcattatctctccaaagagaaaatatattaaaagctctgatttgtttttttgtttgttttttaatggagagtatctctctctcgcacccaggctggagtgcagtggcacgatcatagctcactgcaggctcgaactcctgggctcaagccatcctcctgcctcaacttcccgagtagctgggactacaggcatgagccactgcatttacatgcacctgctaaatatatatatatatatttacatatatataaatatatatatatgtatttacatgcagcatgccattttatgctctttgaaatctaagtgggctaaggccagctcaaaggagaatcacctctccctggaccaagtggatgctccttctccaagtgctgctggggctgccttatttagggctgcttagatccaatgtgtagacttgactgctaagttactctaaggaggcacataacgactacgttttctagacattcgtacattttaattaagagaatatattttcattacctccctatccctctaaggcagccttgggaatgctgataggccctgttcttcactaacagctcccctggggaaaggcaataaacctcttcttcacctgtccccgctgtgccatgacaatgacatttctcttcgccaaagccgagcttgatcagaactctgagctcctatctcttatctctgtgcctgtgtctgtgactcagcttctcaaaaggtacatctttacatccctgtatctatcagtcacttctgattccctcaagcagaagccctccctcgtgacccatggctcctctgaatcccactcaacttccaacatgatgtatccatcagaaacgtgttccattagaaagcctgacttaacaatagcttaaacaaattgagttttatttttctaaatagcaaaaggtctgaaagtaggtggctgataacattgactcagatttcagagtcagtggtctccataattctattgaccgttgctttcatgggcccaaaatggctgccccagctccaaacatcacacctatagcccaggcaggaagaagaattggtggagctcagccatgacatggctttttcatcaagaaagcaaaagctttcccagaatactcagagcagacttccatgtgtatctcattggccagattgttatcatatgattatccctggatgcaagagagactgagtgagcaaatatttagcttttccaggcctctaaagtagcctgttgtgaaaagccataggattagcaaacctgcagtctctgccatacgggtcaaattctttccttaagaagcctgacaaacagaatcacagaagcaaacttttaccaagtgcttgctctgccccaggtctctgcttagtgctttcttttcatctgctgtctcaggtaatccttccaccaaccacatggcaaaagcatgactattcctccattttatagatgagaaacctgaaactcacaaaggttagagaactgacccaaagtcacccagcctgtaagtgtcagagcttggatttaaatccctcttagccagggatcaacaaactcttttgggaagggccagatagtacatctttcaggttttctgggtcatataggctctgtcaccccaactctgctattgaagagcaaaagcagccacagcccatgtagataaacgagctgtgtgtcaataaaactttattatggacactaaaatttgaatttcatatcactttcacctgtgacaaaatattgttcttttttttttttttcccaactactgtatttaaaaatgtagaaaccatgcttcatcaagggcggcacaaatacaggccttcattcagatttggctcacagagccagagtttgccagccactgctgttggctggtgctgtccacatttgtgattctaagcttatgcagggttgtttttttgttgtttttttttctttctttcttttgtttgtttgtttgagacagcgtcttgctctgttgcccaacctggagtatagtggtgcaatcatagctcactgcagccttgacctcccaggcccaaacaatccttccacctcagcctatatatatattttttatttatttatttgttatttttttattttatgtttttgaaatggagtctcactccgtcaccaggctggagcgcagtggcacgatctcggttcactgcaagccctgcctcctgggttcaagcaattcttctgtctcagcttcccaagtagctgggattacaggcacccaccaccacgctgagctaatttttgtatttttagtagagacatggtttcaccatgttggccaggatggtctcggtctcttgacgtcgtgatccacccacctcagcctaccaaagtgctgggattacaggcgtaagccaccatgcccagcccacctcagccccttgagtagctgggaccacaagaatgtgccacctcagccagccaattttttaaaatttttttgtagagataaggtctccttatgttgcccaggctggtctcaaactcctggcctcaagtgattctcccacctcagctttctgattagctagggctataggtatgcaccaccatgcccagataattttttaaattttattttgtacagaaggggtctcattatgttacccaggctggtctcaaactcctgggctcaagcaatcctcctgtctcagcttcccaaagtgctgggatcccaggcatgagccatggcccctggctttatgccgggtttaatgtccacattcacccctgccctctgcttgcccaagctcctgctttggcctggacctgtccattctgctgtctgtggctcccgcacccatgcgcctggatcctgaggacaagacaggcccccaccccacctcatctcagggagcctccgtgaattccttcagccattgctggtgcccctgctggtgatttttgtcacaagagagttggcactcccaaaaagcccggcctgtcaacattggagctcacctgccaaggaccagagcagtcacggggtggtaatttttgtcatgttttagagcatggggtgacatttttctgcccttaacagcaggcactccacaagctgtcgggaaagaagaaaaataggaatggaagcctgggttgcttttctttttctaagtaatattagatctctttttttaggtggatgcttaaggatgtgtagagggagtggggagaagacttgggcacttatttctgctattttctcttcctctcaggtagagatgccctctctgcactgcacaggcctccatcaccctcacaaaaagcacccaggaatttcctccaggctctataatcacccctctgtaaatggcacacttgttcacaaaagccgctgctgccttgaactattttgcttgcctctttgcagctcctctgccaggggcagagaagtgctcatcgctgaagatttccagaaggtcccattggtcaagattataaatgccaggaatggtgtccctggattttaggcgcttcctcctctcctagtgcttaattgtctcagagtaattcccaaaatagtggctgcattttttcactttgactctgacgttgcatagtccatgaatatttgaaagctcccctaggtgaccttggttagcctctctggccactgttgactcctctgtaagaatgatggccactcgatctacttggaaggcttattgtaagaaacaaatgagattattctgtgtcacccttcccgcgaccctagcacatagcaggtgctccaacagtggtacgttctttcttgctttaagttggatcactgaagttaccctccgagactccatgtttgataacccatgagcactttagattggttcctgtccacaactcccgggcctccagccataaggaggatggggttaagtgtagatgaatcaaagccaccagcctcttcacaagataaatactccctgagagtagacagcccatggacagcaacgttggctttgtacaggaaatatagcagctttagctgatggctttgggcagtgttggttgactgaccctgagttcatgcttggctccttcttggctcatacccttactagagggggcacttttcttctaaaagaatgagaaaatccttccgttggccctgattccctttgaagaaggtgctggtctcaggctcagagtctgctctggtttatactttattggtccaatgttatgaatggagaagagtgagaacagaaacaaagacgttgaagaaggcaaacgtgaaatctatcttggcaggcagagtcttgaggttgaggaagagtgccaaccacaaagtgcacttcctagatttcagctctccattctctctcacccacactctcagctgcagacaacacccgtgatccttggagtaggacctggccaggctctgtggctctgaaaagcagctctagaagggaacccctgaaaaggggcttatgtcctctaggtgtcagaaacaaaagagaacaggggcggacttatcttgaaacctagacagctttgacttcattgctcactcattccagccagggaatggacagggctgtcagcacagccaaggtaccctggttcccatttccctgtggtccatggagacttggccagacctggggtgatcacattccttctctccaaggacacagccttatatgcagaaggaaacagggcaaaacacttgtctccagtctccccaaaggccttaggctatgaatgctatcctttcaggacggttccagccgaccacatttaactcctcagcacccaggtttgggctcccacatattctccagcagttttcactagtaccagtactggaggccccctgagcccaaggccctctggacacactgggcaaggctcttcttctgaggttagttccctggcaggtcccaggtctcaccctgggaggcactgggggacacacaattcccatttggaaacgagaaaactgacgctggaagaggaaaatgacctgcgtgaaatcccagggccaggcacaagcagatggatggttgtttgtttgtttgtttgtttgtttttgagatggagtctccctctgtcacccaggctggagtgcagtggcacgatctcagctcactgcaaactccacctcctgggttcaagcaattcccatgcctcagcctcttgagtagctgggattataggtgggcaccaccacacctggttaatttttgtattttttttagtagagatggggtttcaccatgttggccaggctgatctcaaactcctggcctcaagtgatctacccgcctcaacctcccaaagtgctaggattacaggcgtgagccaccgcgcccagctgcagaggaatcttaaaaaggacctccgaagcttctttttagaaaactgtggtaaaacacacataatataaatgtaccacttcgatcatgtttcagtgtgcagctctgcggcactcacattgctgtgtcaccattgccgccatccatctccaaagctcttttcatttttcaaaactgaaactccataccccattaaaaaacaggtccccatccccactccctctccccccagccacccctggtacctaccactctcctttctgtctctgtgaatttgcctattctatgtacttcatttaagtggaatcacatgatatctgtccttttgtgactggcttattttacctaggatagtgccctaaggtccatccatgttggatcatgtgtcagaattctcttccttttgaaagctgaagaatatcccattgtaggtaaatacaggttgagcatccctaatccaaaaacctcaaatctgaactttttgagcatccacaaaacaccacaaggtacctgacacctttgccttcggatgggtcaatgcatacaaaccttgtttcatgcacaattttttttttcctttgagagagggtctcactctgtcacccaggctgaagtacagtggtacgatctcagctcactgcaacctctactttctgggttcaagcaattctcctggctcagcctcccgagttagctgggactacaggcgcgtaccaccacgcctggctaatttttgtatttttagtaaagacagggtttcatcatgttggtcaagctggtcttgtactcctgacctcaagggatctgcccacctcagcctcccaaagtactgggattacaggcgtgagctactgtgccgggcctcatgcacaaaattattaaattgtataaaattaccttcaagctgtgtgtataaggtatatatgaaacataaatgaattttaagtttagacttgggtcccatctccaagatatcccattatatatatgcaaatattccaaaatccaaaaaaaatgttcaaaaacccctcagatcccatgcatttccaacactcaacctgcatcacattttgttcatccattcatctgttgctggacacccaggttacctccactttttgcctgttgtgaataataccactatgatcacgggtggacaagcacctgtttgagaccctgctttcagttcttttgggtctgtacccagaagtggtattgcagcatcacatggtaattctatttttaatatttttaggaagcatcatactgttttcgatagtggctacacaattttgctttcccatcaacagtgcaatttctccacatctttgccaatatttactttctgttgttattgtttttgttgttgtttgataatagccatcctaatgggtgtgaggtgccagagcttctttaaaagcatccaggtgtgtgagtgtgtatggtacagtgagatgggtaaagaatgaggtagactaggtgtttatcactcttttgaagcctgtaagtggcccctcaccacttagccgaagcctcgaggaagtgtatgcaattgttacaggttgaatagcgtcctctcaaaattcatatgctaaagtcctcatgctcggtacctcagaatgcgaccttatttggaaatagggtcattgcagatgtaattcattaagacaatgtcatactggagtaggtgggctcttaatccaacatgactggtgtccttatgaaaaagtatgccaggtgaggagacagagacacacaccgagggaagatggtgtgaagagatagggagaaagcagccatcttcaagccaaggaaggcctgaggcttccagaaactagaggagaaatctggaacagctccttccctggtgctgttaggggagcctggtcctgccgacactgattttggacttccagcctccagaactgtgaaacaacaaattcctgtcatcctacccagtttgtggcactttatgatggcagccgtaagaaatgaagacagaggccaccagatacatgtgactggggacaccacaaagtgggagatgttcccctggtgaagaaagggcctgcgatgatgtctctcagcctctggctcaagtgttaaagtcatttccatgatatcagcccagaaggccattggcattcaagggcttcgcattcatggttttaactattcatgaatgaccccatcatttactacgggtgatgtgcagtcatttgtcacattgccaaggcatggtcatatactcagagccgggtgtaaggacagggcactgggctggtggctttgttcttctccatttgtcatggagcacatgagaggtgataaagcctgtgcttctttgtgggaaactgggtgtgaaaagaaagacagctgctggcatggcagggaagagaagaggtctaactaatcacgtgatggtctaggccagaaagcggctttatgaattacccaagtgctgtatttatagaaccattatggattttaaagaggtactaggtttttcaattatactttattaccttgcggggtagaaattacacgacttgatgtcattctcaaatttggtaattcactaaggtccaaggccatagcctttaagaatgtcaagggtctactctgtgacaataagattccactgcattttctaaactttttcctttaggtagtaggctttccacagactataattattgctatatccttaaaccatgggtatgtcacttgtgtggtataatttggagcaattctgagaagaactttgcactaaatcacctattcttcaatacattttccctgccacaatgtatacctgaggcctgaaaatctgacattatagactcatgcctttgaatgaagacatggcctcaacttacaaagcacccatattgcaaggatttaattatcgataatcacttactcctcagtatgaatgagtttgcagagtctaaaactagcctgaccatagttgctaagagagaaagtgaggagtgcacagatgaccctggcatctggcaggaagaacacaagaatcttgtagacttcaccaggattcgccctgacaggaccatcctgtgtaaggatgggagggaggctcagtgcccactggaagtgtgtgagcctctatcagtgaagctgatgtggcacaaagagatcagaagagggaattcctccagtgacattcagttattggagctatgagttgtcgttgtttcaaataaactcttataaccacacaaattagcgaaagtgtaactaatcatctgttgtggagaaagaaaactcatcctggggtatctcttaagtcttgacttccaagataatgttaatggataacagatttcttgagctcttactctgcccttcaactccctcttggttttcttctttcagagttccatccttccctaccatctctagaatacttttaaggtgattctaaaaaacaaagcaatgtcagtaaacgccatggaaccgctaggttgtcagataaccgcattgttcttttccaagatggccacaaagaccatttttgaaactgtcttgggtttgtgaaaataaggattaagttcgacagaaaatagatagccagggcgtgaagtgttcacaccattatggagcctgtcagttaagcacaaccgctgaggcggcacaccctcaacattcaggtgcttttgcctgtctctatattcaaagaggttttttttctcattttgcatttgtgttcgcagagaacctatactccttccagaatcaccaccaccagggggctcctcaaccaactgacatttattattattattacttgtgtgtattacagcagcagacgttgatcaaacacttaaatgcaagccaggtgctagctaggctacggaggtagggaccattattatctccactttacaaaagaggaaactgaggctgaaagaggataaggaactggtggcaaggggtggagctggggtagaacgtgattctatctgactttggagctgaattgaacatgaaaaccactgtggagactgtcctcaaggggatggagctggagtttgaggagagaaagacaagcattattgtgcagttaagatgtgttgagatggtgttaacaccatgaaagctaagtgtcttgtggaccaaaataggatgttaacatagattttctgaaacagagtaatatgacaattccgctgttgttgaaagatatatttggtagtggtctagagaagctctctccctaccttctaggactctttttcttttttttcaactgacaatcacatctagtttggaaaactgatattccctgggacagatctaccatcctcacatcttgtatagactccttttatcagggcctggtggtcccagttcttcctagagaaacccatagcaacattcttgatggtcagtggtccgtggactgggggggtccccatggccatctgtccttcctcttggctcccttctgaggggcaggcagggtcctaaaaggacagagccctgtggacctggcagcagcttaagtattacaaggttgaattcacctaacctaggctgggagactacagcactgctggtttctttatctaaacttgtataggtatagtttttcccactaaattgcatttcaaaagtataaacttgaatataagaatagttcatgagaattcaggagatgaggagccccaaaggtcgctgtgaggtttatgtctcaccaggctgcacccaaacccactgagcccaagcttctccaagaggacaatgcacttctcagagctccctccacttagggaactctgggcacaaggcatccaaattacccagggcccaaaacactgagcccccttatgtgaaattccaaataaaaatagcactaaactataagggtaggaaagtccagcctggttc[131 bp omitted]actgaaagctattcaaggcttggttgtgtggttgtgttctatcccagagctcctaggtatgccaaggcttcatggcagattgcgacgatgctttgggaagcagtccatctcgtcaagtggaaaaactccccaggtgcagctgttccctccgactcactgaagtcagagaaatcctctattaatatcttcagctttctaagacgcagggagtaactgaggactcagacacagctacctgcaggggtgaggtggttagaactatccagctttggggtctcactcaccactccaccttgctaccacatctcagccctttgtcaatataaaggggcatagttccacatactcgatttgactcaaggtcattagcccatcaataacttatctccggagaagacagtctcctgtgatctttacatgattgtaggaggctctcctcctagattgctatacaagatggtttgaggctttgggggtctgagaaccctgcactaaactactctatttctagcccttccccactgccatggcatatacctaatatcagatatcttaaagtcaacattatagattctggccaggcatggcggtcctccctataatcctagcactctgggaggctgaggtgagaggatcacttgatcccaggagttcaaaacagcctgggcaacatggaaaaaccctgtctctagctaaaaaaaaataaaaaaataaaaaaaaaattagccaggcatggtggcacgtgcctgtaatcccagctacttgggaggctgaggtgggaggatcacctgagcctggggaggttgaggctgcagtgagccatgattgcaccactatacttcagcctgggtgacagagtgagaccttgtctcaaaaaaataaaattgtatattcttccttgttctcctcctacttcaaggaagacatattgagtctaacaagagcccttcagtctcactccttaagccctggggccttggtctactatatcctttccaagttgttccctaatagcatcttatttcaatagtgacccactggggaaggtcccaggaaagatgcttggttttgcatgtgagtgctggagctcagtcaactaatattaatgcaacttcccatctttctctatcagaaatcttttttttttttttttttgagacacagtctcgctctgttgcccaggctggagtgcagtggcccgatcttggctcactgcaagctccgcctcccaggttcatgccattctcctgcctcagcctcccgagtagctgggaccacaggtgcccgccaccacgcctggctaatttttttgtatttttggtagagatggggtttcaccgtgttagtcaggatggtctcgatctcctgtctgtcagaaatctttacacaaacatgcacactcgcacacacccacatacatctctataccccattccagagggagcattcactttccctgtaatgctctcccactgtgagtcgtgatggccagtagagatgatgtaataataattttattggatcaatatatcatttagaaaataaaatctctccccttcactgggtgatgaccatgaggggaaatgcctgtgtctggtcagtaatttatgtctgtcaagcacaatgaatgggatctctagctcaatgcacttgtctttgtgttttactgtatactctatgtttccagcagtgtctgtaaaacatccctctgaagggctctcctttgagcaggaggcagctccgtccccccaagaggtttagatcccagtcaagcagggagctggcctggccatggcttttcatttctttgtgcagcagatgacaaggtcagtttcgttaggccagtgcttgcgaagacacttctttgccttccttagcaagcattaggagacccattttacagatagggaaaacaggggactaaaagggtagagctttcctgcagcccataaggttaaaaaaaaaaaaaaaaaaggtcttcattttcaacagtaataaaacactctgtccatgcctctctacaactttgtggctgggatcagagcaggagaaggtgggtaggaaaccatatcactttgtcatgacagcttcatccaagtccggagcacagagcagctcggctctctatctctttccaagtcctttctaatcctatcatcacattctgacccatggcctccccgcctccatcccctcttctctcctgagctggcaaatcctttggagctggcacttctgtgccatattgcttggtactgtgttcgtgtgccgctttgttttggttcaagccagctccctgcacaatgaaattagaatgcctgggtgctggagagggggttgggggagaagagcacaggattaatggcaatatgcagggagacatttaatcaatcaggggctttctgaaaaaaacaaaaagacaaaaatgagaaaatgaaggaaaccattatttagcgtgtgctgggcactacattcgactaccaaaatacagaaacaaaaaccgcaaaggaaattaatttcgttgaagtggtattgacaataaaatagatgctgtcttgttttgataaatttatatatggtattgctattcctctgtctgctgacagtgcttgagtcatttctcctatagtggagagtgggctgagctaaacttctgcactctcatggcaaactcacttctgaacagggcatccattcatctacccattcacccactcagcttttgaggggaggaaaggggatgggccacatgatttatgtattcaggaccaaatcttataactaagagacacatttactagtgaattatttattgacatctgtgattttagtattaggttgatacaaaagtaagatatactacagattactttgtattaaacaatagtttgtttgagccatatgtgcctggaactattctgaacacaagtggttcgaggataaataagataggaagtcctcgtcctccagatatacgactaacattcgcaacacagatctcaggggttgagttgatcactttggccctgttgaccccggctgagtcaactactctagaatgaaaataaatggtggggtttttaaaatttgttttattttcgtttttataaagggcattcaagcttagaaaaacaggaaggcactcaatttttaaaaagcaggccaggtatggtggctcacacctgtaaccccaacacttcggaagcccaaggcaagaggattgcttaaggtcaggaattcaagatcagcctggacaacttcgcaagaccccacatctaccaaaaaatttttttcgtaattagctggttgtggtagataggaactcctatctattcctaccttatctgcattcctagctacttgggaagctgaggcaggaggattgcttgagcacaggagtttgaggctgcaatgagctatgatcgcgccactgcactccagcctgggcaacagagagagaccctgtctcaaaaaaataaaaaagcaaacctaaatcctgttttttccatcaacttgcctatccctccttcaatgtgaaagctaaactcaagggcatatcaatcatcagctttaccatccagtcattttcaggatattctcaaggctacgaccccacccccagccctttctcctgccacggcatataccagatacctgaaatttcacggctggtcaaagatgtacacaaatggaaagtttggttatctcagaagccccttgccctgggacccttactagagagctccttccccaggagggcagagggtactgggtgaggagaacaggcagatgtttgagttgaactcacagacatccctctgtgagtgttagtgaagctctatgaaacacagcccttagatctcctgtcattcaagaaggatttttgcttctattattgtttaccctccaatcaccagtacctagtactatgcttgccacacagtagaaattcaataaatgggctcttacagttttaattttttctcaaaaggatatgcatacagaaacaaagcaaatcatacacaagtgctgtgttgtgcaaagggagtgtggaggcataagcagctattgccaggttgtgtaaatatacaataggggttactaatggaacatttacaagccagagaagcagcagagtgtatctgctcccctgagcactcatcattctcaaagaggtgggcttaggctgggcctggctggaccaggtgctccaaaggcaggaaatgaccccagggctatccagattagtcgctcctccagcttccatgcacagcagcggtctctgcactcttgcccacttcacttcccacagacaattcctaaatccaatccatttttaattctttttgtgattattactttttttttttttttttttttttttttaagaaacagggtctctcacccaggctggagtgcagaggagcaatcacaactcagtgcaacctccacctccttggctcaagggatcctcccgcctcaacctccaaagtagctgggactatcagtgcacgtgaccacgcctggcttcttctcttaatgctatcaaattttaatgaaagcaactatgccatccatggaatggcaagcattaaactataagagagacatcaaaacttttactgcaagaacacaggcaaatgtcttgctgtggtcggcttctgggaaggctgaatcatactgagctgtaccctagatccctgcactctcacagctttatcctcctgtttcctgggcgacctgaaggccctggtcctcccctgatacttccaggcctctgtgggctgcgtgtggagcaaaagggccaccagagagagtctgggactcagacacagcattagccaatatttgctgttatcattttattttctgagcttgttgagacttctttctgttgacagacctacccatccaactttctggagtacttttctcacagaagactttgaaagaaagctttgaaagaaggaactgggccaggcacggtggctcacacctgtaatcccactactttgggaggccgaagcaggtggatcacaaggtccggagttcgagaccagcctggccaacatggtgaaaacccgtctccactaaaaatacaaaaattagccgggcatgatggtgcgcacctgtagtcccagctactcgggaggctgaggcagcagaatcgcttgaacctgaaaggcggagcttgcagtgagccaagatcgtaccactgcactccagcctgggtgacagagcgagactgtctcaaaaaaaaaaaaaaaaaaaaggtaggaaagaaggaactggttctgtctaacccattgtccatatcttcagccatcatctgtagaggttgtacttccaatatgtatggctcatgtttctgcatacattgtagaacgtttcttctgtttctaggtagtgtatttcctcctccattgattttctctgaagtttcattacatgttcttgatgtatttcaagttccagaggaagcttctgaatctcactttgaagctgtgaattttcagtcggcaaagatgcttgctcagtttggagactttgtttgtcctggaagctcttcattcattggattttcttcacataatttcttggatttttttttttttttttttttgctttttcccttcaaatcttctaaagaaaacatttaagttaacagcatccaggagtctcttcaaatcaacttgtaactgatagacctggtgatctccagttctttctgctttcttctttttctctaatttcaagctgccatcagccatgtggtctctaaagagacagatacacctacgatcttcagcaaggttttcatcagagatgttcactggcccactttatcacccatgacttatttcattcccccctttgcgttttcaagcaggttttctgtcccttcagttccttcattctttgctcccatctcacggtttttttggcaagcagttctagtctttcctgaagatgagtgttttcattcaaactgtccatcattctcttctgttctccactgttctaaaatgcttgtaagatgttttatgaatcagtcacttaggattggaaggattttgatgcatctttgagtgacagtgtctgtccgtgaagtgaaagttcagggagctggcttttctgtccttttccagaaaagtctaccatgtcctcaggtgaaggcctattctgatatttactcagtgctgccaaatacagaatttgtaactgcaaaagactggcctccaccacaggtggcttgagggcttcataggcttgtgtcatcagcaccatcttctcactgacttttccacacactttaaccaagtggaacacctcgctctttttccctccttaaagtgtgtaggctgtttaccataaaaacaaccctagcagcagcacacacaaggatcttctggggaaacccaaagagactgggacttgctcagaggctcagacatcaccagcagaggaccacacagctgctccaggcccggctggagagacattttggtggtagatactcaggccttccgtgggtccgaagggctccccacttctattcagattgctggtatcctgtaggccactgtggaccacacagaacccttgggggacacgggtgtctgtctgtaatgcaaacaagtgccaggcaacaagcacagaccatacatcagctgagaaaaaggaggtgaaggccagtcaggttctataacataatgctccctaaccttgctctgctcaatgcacaaatagaaagtggtactacttagtgcatttggggaagcagaaggtgctgactgcagccagagaccaggctggagctcacgccattcctggccccacatgaccctccagcaaacctagaggatcaagcagcgccatgttggtggtgattaccttaacctaaatgatatttataactctacttcttggtttttcaacttacaatgtcctcatttaaaacttagctcaatgtgtgtggtttcatattttttattgatatatttacttttataacattaaatcacagtacctccatttactgttccatcaattttagtcagtattttgattctccttcagataagatgggagtatttatgcccctacccatccttctcccttctgtctccaacctgctgtcgaataaatttcacattaaaaagctgatattaagatttgcattctgtaactacaatgttatcctctgagcttccatagatgcactctaaatgttgttgttgttagcaacaattatgatcacaatacacaaattgctctgcctgaacaagtggggccagtgtgtcaatttcctttctacaaatctgaaattgcaatccttaggccactcaaagaataatggtcatcccagcataaagctcaatgaattccctttcttatattccagcaattgcttaaagtcatgatacattttgcttattgggatactgactttgtggtacagcttcttgtttatctaggtgcttccaagcacattttttcctttgactaatggtcatttttcatgttttaagatgttccatccttgagaggatattcctaccacaggagtgctctttcttctcattcccccttgcagaactctttgctcttcttttccagtctggattgctcgtcctccaggatcagcctggctgttactctggggtctccttagctgttctcctgaattggacctgatctcctgtctcctggatcccatgtctttctcttcctctgtttacttccccatgctgctgggatatgacctcagatgctgcctaagaaaaggtataaggaaattaaattggccttattctgccctaatatttgattgacaattgggctgagtaaataattttttttaagttaggtcctattctctcagaactttgaaggcattcttgtattgtcttctaacactgagggatacagatgaaaagtcaattgccagtttgagtttagtttctttgagataacttgcattgtctctctgggaaattgtaggatctaccagttgtctttggtgctctagaattttgcagaaaaatgtctaagtgttgggtcatttgttttgctttgctttgttttgtttttccatttactatgctggatatttggggccttttaaacttaaggtccttcttcagccctgataaattttattctactctttctttgctaatttccattttttctattctttctttctgggattgatcttcattttatgtttgacttcaaggatgagctctcatgtctcttaccttttctccactattattttttctctttatatttcttttctacattctgagagattcccttgactttacattccaagcttgttttgaacatttttaattttgataatcaagattttttaaatctgtaagaactatctctttttctctttctgtccctttttcattgcattttatgcttgttttatggatgtaatatatcactgaatttgagtatatgaattacaagacttttttggagatggacttggtgtccagtggggtcagtttgcctatcttggtctatctctttcatgcttctggttcttctctaattcttgtggttcttggttgtccttccatagttaaactggacaaggcagccgatgtgggatttttttttctgcattatgtcggaacccaagaggtctctttttttttttcccagcagctctcttccttagaatcctgattaggagctctccgtggggtgtgaattattgcctggtggcatgctggtggctttggctttaggacgaatgtatgaggctctcacttaaaaaccaagccaagaactccccaaatgccagaacatggagggctctattctggaccaccaaaacctgcactagatgccttagctttccacagagggctgatttaaatttacagatataccctttacattttatcttgaagcagataccagattatctgtaccaaagtatgataggtgggctgtaccaaccatagcaacttttaaccattcctcctcttgtgagtctcatttctcactcctgtgttccactgtacctgccaactctgagcccagaatcctttttgctttctaacaagcatatggattcccacatccattgcagccccacttttattccaggttatgccttttcccgacagttgcttgcatcaaaatcccattcattccatcttccagaaatgtgttgggatttcttgcattcaacaatcttcctccccaatctctttgccatgatagacatctcagaagtgacaaaggtgaaagcatgtactcagcccaccattttgaaccagaagttctcattaaaagtttgtttgaagtctactacaaattccaactagaaacaccattcttctatatgccaagcattgtatctgactttcataggccgccagtacaaaaactattaggctaaagattacattgggtctgtttttattaaaaagttactaaagaaaattcaaagtagacttgagagaatagtttcaaagagttcaagggcacaaaggccagggttggcagcttctggcattccccctgactgcagctgctggagcacacaaggtgtggaggccacctcagctcctgccgggaggaggcagtggctgtcagtcaagagcaagaggcgtgcgccagggctgtgacccccgactcctcaccaacaactttttctccatgtcagcttagctgccaactttgcacacacctgcttccttctgaatcaccagctcagaagaaaggaaggaggtaaggccagccctggactaggctttgatgtgctgagccaccgctgatctttgagtaacagatgcacagagcttctccagcgtattactggggactctaattgccaaaacagaaatgaatttgagctagcttaaggaaaaaaaggtgattttatcataaaggtctgggagtaactaatgaaacccaacagactttagaaagggtgtagaggccaggcatggtaattcatgcctataatcccaacactttgggaggctgaggcagggggatcacttgagcccaggagttagagaccagtctgggcaacacggcaaagcccaatctctacaaaaatacaaaaaaattacctgggcatagtggcatgtgcctgtggtacttgggaggctgaggtgggaggatcacctgagcccaaggaggtcaaggctgcagtgagttgtgatcgcaccactgcactccagcctgggtgacagagtgagacctagtctcaaaacaaaaagaaaggctattggactgaggacttgggagctattaggatttgcctccatgtctcatctcccaactccagccctctctgtgtcctgtttctctcttcctgtagactggctttctcttctcttctgtctacgtggcagaatgtggctacccctctgactgggggttcacatacactggtttggccatgcacagagactgacatttccttagaccaagggctggcaaatttccataaaggccagatagaaaatattttcggctttatggactttacagtctctggtatgactattcaacctgaccattgtttcatgaaaacagccatggccaagttgcaaataaatggtcatgtggctgtgtcctaacaaaactttatttacaaaaacaagaaggcgatgggcagaatttggctggatcaccaaccactgccttagacacaacccagattttcagaaaaatatgaagtattcagtgtgggtcactgaataacttagtcagtccctaagttggtaaacaagagagacaggaaaacacagcagacacatggccactggaggcctggggtgaggtgtgcagttcccaaaaaggagagtctaagaccacaccttaatgaggggtcactatatctacacctcctttagagaagccatagctaaggatattagctcttgcatcttctgacttcagggtaatctcacagaacagggtagcaaaaagccgttatagcatcttgacatccccagaaacaaagtcctgtttagaatgagacatttgaaaattcctcccaataagaaaaggaagtgtgccgggagcagaggctcatgcctgtaatcccagcactttgggaggccaaggcgggtggatcacctgactgtgatcaggagttcaagaccagcctggccaacatggtgaaaccctttctctactaaaaaaaaaaaaaaaaaaaaaaaaaaaaaaattagctaggcatggtgacagacacctgtaatcccagctagtcaagaagctgaggtgggagaatcacttgaacccaggaggtggaggttacagtgagctgagatcgtgccactgcactccagcctgggcgacagagtgagactgtgtctcaaacaaacaaacaaaacaaataaaaaaaaaaaaggaagtgaagaaagaccgtgaagtgaagcaattggccctataaagagtatatagccctggatctgagaaagcttattcaaaacttttattgttccttaaatggacatttagggggagtttttacatttaaacccaaggctctgaaattgaacaaaagcaattttgagctacagttggctgggagattccacggctctctgctcccctggggctcaggactgtacagtggtatggttgaggcttgaattatgtgcccaatgtggctgtaactcagtctgcatcctagcctcccatggtggccctgtagcctacaggcatatcataaaaacgctgcagtggctgttagtgggaatggaaaatggtgcagctactatgaggcagtatggtgttcctcaaaaaattaaaaatagaactaccatatgatcctgcaattctacttctgggtatatagccaaaagaaaaagaaaggtcccgaggagatgtttgcaaatccatgttcatagcagcattcgttataatagccaaaaggcagaggcagcccaaatatgcgttgatgggtgaatggataaacaaaacatggtccatacacacaatggaatattattcagacttaaaaaggaaggagattctgacacaggctaccacatggataaatcctggggacattctgctaagtgaaaggtacctattctaggtgcctcatataagtggaatcatacacttacgtggggcacctagaataggtacataaagacagaagctagagggttgttgccaggggctggggggctaggagctatggggggctgtttttcaatggagtagagcttcagttttgcaagatgaaatgagtttcagagatggatggtggtgacggttgtgcaataacttgaatgtacttaacattattgaactgaacactaaaaatggtacatttagatggtacattttatgtgatgtatattttactgtaattttgtttaagtctgtagtgggaaaggcttcaacctccatgagccctactctattacggcagtgcacagctgtggcctctggggccaagtgaaacatgactcctcacaccagaaccacgacccccaaaagctttcctggaatgaccttgagtctctgccttctattttcctgcaaaaataaaaggttttgtttgtttgtttttctagccacagaaacaaggaataggtgtttagaaacaccccactgtctgctcctctgtggaccattctggggtttttcccctgaagtgagcctagaatcttccaccctaaggacctggccttcccagaagccctgaggcccagaagcttgaataagtccccagacagcaccacaaggggagacactctcacaacagcagtcctactattggccacacctcatgtgatctgctgcaagagcagcgtgccccctcccctgatgggggtcagctagcaaagccccctccaccacccacaccatcccctcctctgagatcagagcctccaggggagaggaggagcccgtgtaatccccagagcctctctccagcaacagagaagagccatgagcttctgcttcaggtacaggcagaccttgctccagcctcctaagaccctttttgcttcagccttgtcccctccagccccttctccatgtggccacctgctgacctctgctcacacatccaagtaggccactgccatgcaccaaccttcattggctccctactgccctcaggaacaaatgcccaagactgtgtgaggcctccagcctcattcccagaagctccctgtcttcatgctcctaagccccacacatccctgccttttcctaagtgtatcccctttgaaccccagtcaatcagtcaagtcccttttctataggatgcacattgttggattgttctcaatgtagcatggtgattgatcctctccatgtcctgctcacccctccaggtgcctccagtttgctcatatcctcaatacagcaggacatccaggactgaccacgtatatcaggggtgactccaacagcacagagaacagccaacgggttcagggaacggcttcacaggtttgagacaccataactaggacaaagaccaactaaagaccatggacccaaattgtggatggagggatttaagatgaacttccaaccatttggatgagctccaggaggtcatctctatctccctggaaatgcccatgggtaagtcagccacagacctggctgggtcactgtggatacagcctggagggagataggaggatgggtaaggtctaggagttcttctgcccctgtgagttacagaatccctttactgggatctccagtcatttctttattctgatggctgcagataagattattctttcatttttttagtcacagaggggaaatccttaaaaaataaccgtcttttactctgggcaaattgtcagcccactgaagaacaggagctgatgctcatgccagccaccatgtgccacatgggtagtgccaccaagagatcagaaactaacaatggaagggaaggatggagtttctaacgcttctttggagtccttggaagactgtgtattaggctgttcttgcattgctataaagaaatacctgaaactaggtaattttttttttttgagacagagtcttgctctgttgccccagctggagtgcagtggcgcgatcttggctcacagcaacctccgcctcctggattcaagtgattctcctgcctcagcctcctgagtagctgggattacaggcgcacaccaccacacctggctaatttttgtatttttagtaaagacgggggtttcaccatgttggccaggctggtctcgaactcctgacctcaagtgatccgtcctccttggcctcccaaaatgctgggattacaagtgtgagccactgcgcccagccagagactgggtaatttataagaaaagaggtttaattggctcatggttctgcaggctgtacaggaagtacagtgacatctgcttctgaggaggcctcagggagcttttattcacagcagaaggtgaagcaggagcaggtattccacatggcaaaagcaggagcaagagagagagagagtgggatagggcagtgaagtgccgcatacttttaaatgaccagatctcctgacaactcactatcacaaagacagtgccaaggcatgagggatctcccccatgatccaaacacctcccgccagaccccaccctggcactggggattacacttcaacatgagatttgggcagggacacacacatctgaaatatatcagatgggaggcacggagtccatgccagaggccagcttctgtgaacagggcttggaactgcaacacttttcctaaattcctaccaggttttcccttctggcagcctggtcatggcatttaacctctctgagcctcaatctccactcctgttaaatggagatgatgctaccaaccatgtacatgaaacgattttgcaaactgcaaggcatgatatacatataagttttaagaagtttctagagtaaataagattggtataaagctaacaacttgatttcagtggaagaatgcctaactcaaggcagacagcgtcattatttagagaatgaggctgggcactttgggaggccaaggtgggaggatcacttgaggccaggaggtcaagagcagcctgggcaacatagcgagatcctgtctacaaaaaaaaattttaatacaataaacaaattagctaggcatggtggtgtgcccctatagtcccacctactcgggaggccaaggctggaggattgcttgaggccaggagtttgagaccagtctgggcaacatagcaaggctccatctctataaaaaataaagtttttaaaaaattagccaggcatggtgacatgtgcctgtatcccagctactcaggaggctaaggtgggaggatcacttgaggcaaggagatcaaggctgcagtgagcctgtgattgtaccactacactccagcctggagcctgggtgacagagtgaaaccctaactcaaaaaaaaaaaaaaaagttggggagagaatgaaacgtgaagttcccagatgggcagagaggcaggaggaataggccggagggatgctgaggagtgaccaacttgcaaacaactctggagaacccaagaatgttagccgatccccaggctgcccggctcttagtcaccttgagttacgaccggcacttgtgcatcatcgctagttcaaggcctggagctactacccctctcccgcaggacctgagccaatggctacgctcaaagtttcagcccatccatgagtggccaatggtgagcagagagacaaaggcacggcagcccctctcatctagccctgcagcatggtgaggccgggaattccctcccacttctaatttcaagtcaccctggggtccatgctcaatagggacatgctcaatcaggcagtcagtttctggtgaccaagcatcccttcccctgggccttggggactcaggcaatggccgagcgccacagcccccacttccccttaagtgtgatagatggactgagttttcctggcagttgaaacactttgcattgatttgtgtattagtttgtatattgttttgagagaccaatttcaagagaagctgggcctgttgtccatcaaagccccacggtgctttatcttcattctgagctggctgctcgtcagacgcagggcaggctgctgccaagagagcccgctgccgaggacctccgtctatcactgcctgggggacacgctgccttgggattgttcaaactccagggaaaggacagttatccacacccacccactgtgctccttggagaagatctgagctcttctggttggaattcttgggtctttgggattctcaacatttccagagatgaggaggctataggaatacttacaaccattttacagcttagggaaacagagtcaagtgccgtaaaatggacacacacaaaacactctcgggagctgggtccctaagttacacagagaacctggcttccctggtcttagcagatctcacagccccttcaccccggcctgtgacacacacagccctccagaccttcctccacctgcaccactaggtttatgctagaaggttcccagtgtgcccacttctaagcagtctttgctgagggggatgaagaaaaggggacctgccaagaggccactgaggtggaggagtcctcggagactaaagcagcagaagtttggagaacctcttcaaaagagacaggagaagcaaggctgcgtgcgagtcaggaagaacaggcatggtttaaatcttttttcttggagagtaaacattgtcacatttctgcctctgctgcttcagaggatgcgcctctctggacagcccttcaggcatcagcctgttggcagccgcgcgtcctggaatacggggtcgctggacataaatccatctgtactggccggggctgacagcgactgtcagtccccaggacagggtcaccacctttctctcccttcttctctctcctcttcccactgtttcaaggacagcagagtcttatggatttttcttctcctgtcttgaatgtgcaaaggtccaggggaccacagcaatgccaccttctggtgtcaagagggaggtggaggcaggcactgaataaggtcccaggcgctccttgccctggaattttgattcttcaaagggcatcagaatgcggtgaccagcagcacacagcaaccagtctctcagcggggctttaggcatggtcacttgggcttgcccagggaacctcatcccggaggatcttccaggaagcctgaggtctcctactaatggaactgtgactggctcacccagagggggtcaggttgggaccttggagtgggcactagatgaagcaaatgggattgactctaataaaaacatggaag

SEQ ID NO: 2640 - DNA, 163928 bp, Homo sapiens
ctgtgctatgaatatttatttttagttaaagtggattcaaatttccagagtaattttaggaagaattcccaggtacatttaggaagcaacaaagcagaggctggactctctgatctgatattgctttgtgacttgagcactgaagatacacacacagcatctgttcctgagaagcaatgttcgccccaggtgggtctccctccactccaatccactcctgggtgattcccccttgtggacctgtgccgaaggactagggaacaaaagcaaattaattttaaaacaggcttgagaaaaaaaaattaggaagattaaattaatctacatgacaattcccaataagaatggtttttgtactatatactcctattgcctcttcatgggaatgtgcacccagtacctattcagagaggctggtatggattagtctgtgcacagacacatggatgcatgtcccgcaacaggctaatagcagggccagccagagttccgcttaaccaacatccatacagcgctccacccccttaggtgtgaacagtttaacctagcaaaaacatccagggaagacgcaatcaccagcgagaggagcaatcacacctcaagtggaagtttatgatgttttggttcacaatgaacattagtctctcccactaatgtcaggcagtaattcaccactgaacagcagccataaaaatgatcgcttagtgaaaggaaagcaagaggcagagaaagcaagagagggaaaagattccagcagaaatattcaagcaaagaaatctcgtgcttctgagacaacactgagctgattgtcccaactcaagccaaagatttaggtttgcttggccctaaagccagtcaagatggcatttgccttatgatttttacctatagtggaaatgttaacagtctgtaggttattgctaagttcctagacacctgcttatgactgtagtatttataggtcatatttcttaacacacatacccttaaagctcaccacaggaagaggctgccaataccatctgcaacacacacacatcagaaaacatcaaagacatctaaattggcactttcctcacctcctttccccccgcttcatgtgacgtgtgcactaaaggagtgaaattacggtcgtcaaagacaaggttgcaaatgattgggactcatgcctttcaagcaaaataaaaagtaattttgagagcagcccacggatagctcggtctagctcctggacccctgaaacccacagcaaacacccttactcttagcatccccccaagctctctcctgcccacctacccccatttccagtctcttgtcataccgtaaagaactctgaaaggtccttgatacacacaggagattattacagggctcagagaaaccaactctgtaattatggctacagtatgatttccattattctcacgccctggcctcagtcacttgcaaaacttccagcaaaatcctcctgcagctccacaacttgtcacggctgggcctctgcccaaaaggtgactgtggtcctgataacctctgggaaaagcaagtcagaattattacaaggaaaggggagtggtgcttagtgagtgagtgggggtggggaattctattgttcaagaaaaaataaataaatgggccacttttgctttttattatttcaaacaacagactcggcagcccagccttcctttcccaactcagactgttcccctgggccagctgtgctgagtctgcaggcacgggagccgggcttgagcaaaaccattaaaaggctgccactccaagcctgcagagcagaaagtttggccgccccagtggcctggctttccccgggaggaccgaaggctcattccccccaactgacccttgcgctcttacctttcaaatgtttatgcctcaccagccccaccactgctctggaaattagatagaatatcccaggtggctgaaacagaactgttcttatatcaacctaccaaagtaaaagatgggaatgccggccgcggtttatgaagccccagcctcttggtggggtattgcctgtgtcacctgtcactgcctgcctgaccgactgctggactctgtccttacctgcctcaggagggttgtctctgagcgccttgctggcccaggctcctgggggtgtcctgatcccaaactcatggtgctgcacttgacctccctgtcggggaacagatttggacaggcttccacaggcaagagagtaccagtcaccaaatgcctcaacccacccttggacaaacagcacaaaaatgcaagttgactatcttgggtttacaatgcagccatggtcaggaaacaccttcctttttccaagagaaaataactgttttgttatgtgcactgaactctcaatgttcatttcattgataacattcactgcccaaccagctcagacaatcacacacacacacaaatcctcatccagggtctactccatcctgccagctagtaaatggtcctctggcagctggtaggaaattcagcgggtaagactcttttagggcaaggcaggaagttacttctacattgcactgagattgagctcaccggagaaaagagttaaagcatcccccatactgcttgctgacttatttactcttaatggtgctcattcacccattgcagcaggtgaagcaggtctcagtgcatgaattgtacacagtaatgcccccggtatttagaattcacttttccagcagaccaaatttgccaaatcctactgaagaatcgagccatctgattcacctgcccaaaagctcatgtacttctctcctcagtgtggactgacgcgtgtcagacacaatttcagagtttggctatctggtttcctagcccaccaaagctggaagctgcagaatgagggaggaggaaaggtgctgaagtcaaccaggattcctggcagcaactggaagtgatgagtggccaagtgcatgagaggaagacccgggaaggcagcaaaaatcagacacaggagctgtgtggggataacatgcccatgtctcacagcgtcttccctgggcatccacaaaactcagttcaatatgtgaacaaaaatcacgaggagtctgaggcagcaaggaaagattccattgcgcttaccattttcttcacagaacggaggtatgaaatacaattctttgcagggaattatgaaatacaattcttaaaaatgtgtacacaatgattttgctgttttttagttgtgacactgaaggcggtccactcaaattaggcagttacttcctcctgggcagcacctgctgtgtggtacatcatggacaccattcttgcagagtaccatggtgtttccccagtgctcattgttttctttcccagtcattacccatagaattactccacacacaagttcccaagtcacaaacacactctggggtgcccgcctcttgtcctccacatgctcccattccagacacaccacctgtccgcagagatgccaacagaaatgattgctgggctgttacattgttggatggtaaaataggcatagtcctctaaatatgcccagaacatttcctcttgaccatccagagctagcagccagaaatacagcaaagggaaatggagggattaaggcttagtctcaatctttactcaatctgaatcacacaatgtccagagaaccccaaaagaagccaaaataaagcaagcaagagctccacatggaatcatcaatatttcctgggaaaggactaaaatgcaattattggccaacaggaaacaggacctcctgcctaccaccttagaaggacttttaacccaatcaagaagggcatgcactatagggccagttccaactcatgagatgagaagcctgaacacaaaacatccctgggcggatgactgctcccaacacagctgatgagccaagatcgcccaggactccagaacctgccagcttccggaagatgcaggggaaaggtcaggtccccagatcataccatctgacctcaccagagcaattttcatgttcccattgcacccgtggttttctcagcccacaacttggctctgggccccatttgcaactttaataggtctgcactttcctccatctgttccctgaatgcattccagatgatgcagcagccagaagggctggagcaaggggaacaggcatgtcccttccccctgcccaccttccccaattgctcagacctaataaagcctttgccttaagggcacaagcccaaattgaacacagcatacaccatttagaacaacactgcaaggctggtctgacacctctcatgtgcacaccagctctagggaggaggtgaatccacacactcaccccacaacctcagcacagaggcagagaaaggacaagatgatcatcatgacctcaacagcagcgtatctccttagctcaaatctgtatcacctgcccacacgcccaagttagcaaaaagatgtaagataacatccagcccaggagggacagactgtcttcacagtaaccaaaagtactgcacctcattcctaccttcttcagcttgccacttttggtgcccacaaaggccagagagtggttcttgtagacatatgcgatgacagacgtcatgcggtccctgtcctccgtgaagacgggaattccacgcaccatgtcggacactcccaggggagcattcatgtccaggccacagaagttatcgtcaatggttaagagctgcaaattttaaaaagagaaaaattagaagggagcgtcaaggaaattggcagagatattaagtcaggaaactatggaggtagaagaatccttagagatgaaacatctggtaacaatccctcttttttacatgaaaaacgtcactccagagaaactaggtgacctgtgaagagtcacctgagtgggcaggtgcagggacatggcagaaaacacaggtccgcaggtctcctttctccataatctgtgtgtctctgcccctcatccaacccctcccagcgccatcttgggagctttgtccatcattattatcatcatcatcctcacgtggaaaagcctcacgtggaaaagccctgggtcagcccagatgagcaggggctccaggccgctctgctcaggcacaagagggatgtggtctccgtatctatacacaaagaggaatgtggtcttcgtatctatacagaagagggatgtggtctccatatctggagcagacacacacatgaggactcaaaagtgtagactagggaactgaaaacattagcatgtaagtagcactatcacaacagaggcatgtgcaggcaatcagctggggaaaggagcaatgggggaaggaatgtgctgattcaactcaatgtgccacagctggtgctttatgagctccgacctcaggctccctgtgtcttttagagcattgtgaagaagggcagccctggccctgccatgcctacaccagcacttcccaaagtgccatccatggaaacccaggtccccgatatgctctacagataaaagggctctgcaggcaaatttctaggaagccttttaacaccatctaagagattcataacgattagttacatgaaaggtctgaaaagtatttttaagaaaaagtatgtttaaccttatctcagcctctcctaaacattttattcactgaaccttttcttccttttttttttttttttttttgagacagggtctcactctgtcacccaggctggagtgcagtgacatgataatggctcactgcagccttgacttaccaggctcaagcgatcctccaacctcagcctcccaagtagctgggaccacaagcatgtgccaccatgcctggctaaatttttgtattttttgtagagacagtatttcatcatgttacccaggctggtgtcaaacccctgagctcaagcaaccaccaccctcagcctcccgaagtgctagcattacgggtgtgagcccttgcacccagctgctaaaccattttgactgcaacacctactagtgttccttaaagagaatattctccagatatcctgtgagatactgaccctgactcgcttgctcctgactccaggaagtataatttcagaagtcaggaagctttggggccagttcccccactgtatttccagtggaatctctcttttttataccaggccatcaggtcccccttgaaacagagggtctcagctgggctctggggtgctggggagtggtgaagaccctggtagtagctggtgaaaagccctcggcactccccacaagcagcttgggtctcacacacacacccctctggggtgaattttccaccgtgtcttggaagggctatgtggtctcagaagagttactccgttttcctgtgcttttattttctgctctataaagatgacggaaacaatccccgctctttgatgggctaccataaagcctattgcactcgtgcctgtaaatgtctttggactttgcagagaaaggggtgaaataaaatacaaggtgtcacttttttaaaggcttcaatccagccaaaggaaagggcatctggagaacagcaggcaggctcttgccagggagtgtgtgaaaccaggccacaggcgttcacctggccccagcaggctcctccactccctcccagaagaggtgcgggcaggcactgtccctccagagaaggtgacctgctcagcatctgaagcctctctgatggctccccttcttcctacagagtagggacagtcagagcgaaaacggggagagcgtgggcaagcctgagcaggccacgtgtagagcagacatccactccaggcctttgatagcctctggcctctcttgcgtggcctggtccaccagcccaggccaaacacagctctctccccttcccttaaaagaaaaaaaaaaagaaaaattattgaccaggcatggtgactcatgcctgtaatcccgccagaggcaggcagatcatctgaggtcaggagttcgagaccaacactgtctctactaaaaaaacaaacaaaaaattataggagtcaaatttacaagggagtgttcaagatttagtctgatctttaccatttttccctaaataaggagatggggaaggagacaggaggcagagggttaaagggaggagtagaagaaaggaaggacaaatccaggcaaaggggagaagatgccctgtgcctgctggatatgaccatggcaacctgccaggccttccaagggcagcctggggtgctaggggtcctcgtggcccttgaatgttcctgcttctggttcacaaggagttcgcatccccaaatttctcaggcctaaactgtgctgcagggacctctggcgtcgcaaactctgtacatcacccattatgatccattttctgagtagatgtggctgaatgattgttcacactgcacagggtggggacactgaggcagggacaaagggagtccttgtttcacagttccccaccacctctgccacaaacataggcctcattagcctgaggaggcttcaggcctctcagctcccaaaattgcatttctgaggggtcaggattactgaatacgattcttccccttggctgggcacgacagaaggacatcaacagccacgtacaaaaagagagtatacatttggctggttacatcattcactaaccagaaagtcagggacctgtgactctcttcctctgcagaacctcttgaagcaagaagcccaggcaagatctgggacaatgacagatttctccctaagtttccccgtggcttggcttctctctctctgaatggggccccaagtgataaaggtgccattgagtcctttgaccaagcaccgtccaggtcttcatgattgctgaggtccccagctgtggcaggaggtggccctgctctttgtttccttgaatctggggtgatgggggagggatttttaagattgaaacagtggaaaaatcacaggacttgggttcaaatggcagctcagctgcttcccaattgcacaacttgctcctactgttctgtaacctgactttccttggctatagagcgggtaagcttattggagcgatggcacctggtgagctgggaagcacttcaatgtaagatatttcatgttgattttttgtgtatagaaatcctgcctggaacaggggtagaatggctgcagggtgtggccctagcatgcctcttgaccacagcatgcactgcaaacacagtatgcattgctgggtctgagctgaaaccaccagctaattacagtacctgaagcagggggagggagggtcccccagggcctgtagacctgggaggtggacatgtagagaacagatgccagggctgcctgggcccgggaaggtgaggctaattggtgaaagccttcaacaggtgagggttgatgtggcttcctgagcacctgggtgatgggggaagagaatgtttgctccagccctggctgagccttcccctgggccccattaacagtgagattagagccacagccagaggagccaggtctggactctgctattatcaggagcccagccatgccctaggcctggggctggcctcctgtcactccacaaatacacaaaatgtttggccatggttatgataacccttgtttattagagagcaactctactctcacaaggaaaggaaataagcacccattaaatgagaatttatatggagcccatttggacaaccctgtggacagacctagaagccctgagagggccacactctctgggtccctatccagaggactctggatcttttttcactggctcaaatgtcctcatagaatgcatggggtacaaattaagatggctgatccactgtgctccaaggactatgagctcaaggacaggggccacgttttatgcatctttgtacccctagcttagtgcctggcttataataggctaatacaatggatggatagatggatggatggataggtggatggatggatggatgggtggatgggtggatgggtggatgggtggatggatggatggatggatggatggatggatggatggatggatggttcgttggacagatagataaataaaagcctgagcttcacagtggctaacagtactgaaccagaaccaaagtgcttaggtttgaatcccaactctgccacttaatcctgtgtgaccttgagaaagtcacttaacctccctgtgccttaatttgttacctgtagaatggggattattacaatagtacatactttgttgtactgtggtgaggattaaataatttaaaacatatagaacaatgtttggcacttagttctatgggagtgttcactcttgttgtttgttgtcattagatgggtcagatgacctctgcggttctcagcatctttgaggaaattcatggtatctatctcagaggtatcatgaaaattaaaggggctaatgttgtgaagatgaaatagcaaaggtagttcttcccaaatatcttccagaatccgatagacatttggtcacaaagctgactgaaggagcaggggaatggtctcagatccaggagactgagcgctattcattagaaatgcaaattcttgagctccaccccagacatattggattaaaaagtcttgggtgggggctcagacatcttcatcttcacacctctccaggtgattccaaccccctcttgctaaggtttgagaagcactggcctggatcaccatggagggcccttcctagctgagggcactacagaacacagcatgtgcctagcatcccgactcgggagcaggaccctgagctggacctggatgcagagagccctcacagcagcctccccaggggcctgccacgcagtgtggtggtggtggaggtggtgtggggagctggagctgacactccgaattacaatctaatagcttatggcgcttccctcgtgcaccgcagcaaaggttaccgtgcaattacgtgtcgccacatacaaatgacagagcagttacggttactttaccaattacagggaaattgctcccactctgcagagagattggcactctgaaaagctctatcatctccatgaaaaggggattttaaatgcagacggtttccttcctccagcagttccccaggctcaggggcagagctgcaaagccactgccactgcccaaggaccccagaagtgcctggtagtctctgtggagactccctgggaagggctggaggaggaggtagacctggggaacagtggggggatctccccaagaactctagacatcacccccaaccctaggcctcaatgacacactcttaaggaaccaactatcacccactctgacagccacatcaatccatcttgaaggcagcaggtgatgaggcggggtgggcccctgatccccaaatcctcccctgaccccagcctgcacagcccctggtgtgagtcctgattgcacctcctctgccaagcaaagctgttttagccccggccctggcttgccccacctttgcagaaacctcacattgagtccttattacagaaaggtcagaaccaagccagagctcaatggcccaaatgcagtgctaatgaggtgaaggtcagcaggtccatccccctgtgggccaattagcttagctctgggacacagtctcttccatagccacaggctgccctcttactgcaggcatccactgtttacaaacatcctaagctgatcctgaagaggcagaccaggtgaccagcagggatgtgccatgcagccaactcctccagccacctatgtacctgccctgctgctctggggcagcagcagccatctgagccccaggatggaagacaaaatcagatctggtcttcccattgctctgtgggcaactcctgtggtccaggagagagaggatttctcccatctgggagaaaaccagctctcctgcccttcctgaatggaaaagtatcatctagcctcatactcctccacagctgggaagtccccactcctgtccgttgcatagggtaagaagacatcagagattttcccaagctcacccatggtggggccaactggatctttagaccaaccttttcccaccaaacctttggttccttgggctattggaactccctgcgttcagcaagggaaataggcactagatgaagacaaggctatttacttttcctcacttactaatttgcttaagagcatttatgaaaaacctactaagccccaagcactaggtgagcccctaagaatagaaagatgaaaaagtctcagttcctgccccaaagaactgcctctttcccagtgtggggatggacagacctgggccatgactagacaaagccatctgggccctgcttcagttatgtgcctgggggagtccagagaatggaccaccaactgccttggggagcaggcatgactttgaggaagaggcgaggtctgggctcacgtccaagttctctggcttatgaaacagtattctgcccctctttcacacatcatatttcagatgcggaaaataactcaggatcataaaatccaacagccccattttacagaaggggccactggggcctggagagtgaggtgcctcccctagttacctatcaagttgctgagaaaataggtaccaaaaccccaaattcctggtgacagaaaaaacaaaacaaaacaaaacaaaaaagcctgattttttttttagatggagtcctgctctgttaccagggtggaatgcagtggcacaatcttggctcactgcaacctccacccgccaggttcaagcaattctcctgcctcagcctcttgagtagctgggattacaggcacctgccactacacccagctaatttttttatttttagtagagacggggtttcactatgttggccaggctggtcttgaactcctgcccttgtgatccgtccaccttggcctcccaaaatgctgagattataggcatgagctaccacacctggctaaaaaactgatcttaagcacgggtttcctctggggttgttagagggtggtcccaaagacaatctattccaggatcagaggaaggcaggggactgctggggaagagactatgtgtccagtccctttcccagcaccagggatgagtgctctgccatctccagaaactggaagcaaccaactctcccctcccaaggaggcccctgaccactcacttaagctgggcttcttcctttcctgggtctgtgcatcccaaaggaaagtgagaaatgacgttttgaaaagaaattcaagttaggagaaaaagggaagggaagcccatgagctgcctattgatacagaaaagaaaaggtctttatattcttcatgttgagcagccctaaatttcttcccattaattacacttatgcacacttgtgcacgcacgcacacacacacacacacacacatacacatatcctggttgctgaccatagcacacctccactggaaatggggaatcagtgaattacacatgtgggatttctttttaaagggagatattgatcagataaactgtaatagctcatgtctaaatgcaggctccagttgtaaagctctgcagtacagggagataatgatcacccacttattgggaaccgtatctcaaatatgacggctgacccctaaggtgttcataaatacacaaaatgcatccaccccttgagatgacatcgtgtttactccacaatacctcctcaggggtagaggtaagtggagagtgtccacagggaggtagaaatatctctgggagtctctagtaggcttaggtttagctcctcagaaagcctattattctataagatatttccatgtgcttgagtgatgattctgtaacaaagaaatcaaaaagacctgactatccaatcctctgattgctttcctgtaatgcctaaactttctcttttatgactcctagccctccccagaaggtctgccttcagacacgtgacattgagacacaggacccacgctggccctatgagattgaagtctcttgaaagcaagccagagaagtcctataataggtgaaagttgacccctgcaccctggttgtgagcacaggccatggaaacaatgctggagtgagggctcatacactcagttactaatgcttcatctcagaatgattctttcgggtgtctttttcaatgagattgtagggaaaacgaatgtgtaacagaaagagggagagccagcaagccacagtcacaacaacccagttagacaaacacatcattgcaggggcttagagaaaagtgtattggggttggaaaaacaacccaacaaattatagtagttcccctgatccttggcttcactttccatggtttcagttaccgcagcttcagatcaaccactgcccaaaaatagaagagtagagcacaataagggatttttgagagacagaggagacaatgttcacataatttttattatagtatactgtcataactgttctattttatgattattattactgttaatcttttactgtgcctaactgataaattaaagtttattataggtatgtatgtatattagtccatttgctgataaagacatactggagacttggaagaaaaagtttgatggacttacatttccacgtggctggggaggcctcacaatcatggcagaaggcaaggaggaggaagacaggtcttacacggatggcagcaggcaaaaagagagagtgtgtgcagggaaacacccccttataatatcctcagatctcataagacttattcactatcacgaaaacagcacaggaaagtcctgcccccatgattcaattacctcccaccaggtccctcccacaacatgtgggacttcaagatgagatctggatggggacatagccaaaccatgagagtatgcatgggaaaaaacacggtatatatggggtttgggactatctgtggtttcaggcatccactgggggacttggaaagcatctcccaaggataagtggggactatcatatggccccagttctcaagaaccaagagctttgcttctgggcatctcaaaaaggaggagagcagaccagaaaacaggatagaaagtcattgtgttttaggaggtggggctggggattttgatgcaaatattcattaaatgaatgcatttaactacctatggaatgatgaaagccatttgctaaaagcaacacttcttttaatactcattttgaagtttctatgtgtgttttgggaccatctgtggcccaagcccaccagatatctaagtggtctttcactcatcatgaaaacaagctatccttctaatagggaactaatgtcactaaattgagcagttttccctggagaagggcattaagccaagcacacattctgcaggccaggctgtaaccaatagcgagctttagcagtgcaccccttctaggggttgctgagcatagcagccaaagacaagcttcagctcagaatcctaggggttgaacccatgaccttctcctcattagcttagctgccaagagcctcgtgttcctccctctgagaagcagacagggccatgccctgggaatagtctggacaggccagagctctaggccagcctaccaagagaattgaaattctgcagatggcattatccctgggggctggtttagcaaccaacaccagacccatgggaaatcccagggaagtttctcagcattgcgaatggtaacaaccaaaacctactggggtgccacctctctccttttgtactttagctccagagaaccccagtggctacctgtcaggggcagataaatcccatgccaccagtccatcaatcccaaatcccactgtccctcctggagtctatggcaggcagactcagcagccacaagggctgtcattgaagtgagaaataccatgatgattaagtttgtgtgttttctggtgggtgctgggaagcagtggccctgctccccaggctgagttatggggtaggtcattccctcattagtggaaataaattttattagccccactctcacggcaatgtatcttcctctcttgctcctcgggtctaggtgtgggtctgggtaatgttgcctgcgtgtgggataaatcagccgaacaaatcccattatattttggaacactgacggagacacagtaatggcacagagaccagggaagggagtgggctgcttctctcccactgaccccgtttcctgcccatagggccacacacactagggaaaacatgtaaattgagaggccagatggagaagagctctctcagttgtctctttctccttctctccactgactttcttgataaaagaaacaagcctggtgtggtgatgtgcagtccttcccttataccttacaaaaactaagggacatgtgaaggtaacagcagcaagcactggcccaaaatgtgtcttgtcacccaaatgcattatcttatcattcataacctgtgctatatagaaaggaaggcaattggagggaggccgaggtgggtggatcacctgtcaggagtttgaaaccagcttggccagcgtgatgaaaccctgtctgtactaaaaatacaaaaattagctggtcgtggtggcgcatgcctgtaatcccagctactcaggaggctgaggcaggagaatcgcttgaacccgggaagcatgggttgcagtgagccaagatcgcgccattgcactccaccctgggcaacaagagtgaaacactgtctcaaaagaagaaggagaaggagaagaagaaggagggggaggggaaggggaaggggaaataataataataaaggcagctggagcacatcctagggcctgagataccaaacaccacacctgcattaagcacagcccaaatctctcaaaagcaggtattggtgaaggaaaaaaaattctaagcatgaaatcactgcaatattattacgcccctttctgtccccttgggtggttattataactaaaggaggagacacaggatgatgctatgaagatgtttgagtgtcctatgaatataaggggctgtgtgtctatcgttattaacatctgtatatttctctttccttaggagcttccggactctttattaaaaggatacttttttatcatctccttcttgaagataaaatgtgtgattcaaagcaaaagggaaactgcttgcccagtgatatctcacaagctgggactggctgagacccaaagatcctgactcctagaccagtaacccggccaagacgccaccctgtgaggacgaaaggaattgaagggaaggcccagaagtccagatctggattgttaagtagggctggtctatgtgcccattgaacaagaggtctggcttcccattttggcagggttatctcacactgcatgaggcgtgtgtgtgtgagagagagaaatctcattgtacttgctgctgagcagagtgtgtgggggtgagggagaacaagtcacagaaatagggagacagagaaaggctaagagaggaccgtgcaccaagagtgtgagtgagtgagcaagaggagagaaacagagaaagcaacagacagcaacgaggaggacagacatcaaggacagaaagaatgggtgtgtgcacatgggtgtgctatgggtgtgtacgccactgtgctcgggctcatgacatgcagtccatgtctcagtattgtgagagcacacatcctcaaacctgactttgtgctaagctctcctggcagcagtctgcgttaaaattcagcctgtgtgactcctgggtcccgcctcactccctgctgacccgatggcctccagggtgggcatcctgggagagtacatccagcctaggaagccagcctcaactttgctcctgccaaacccaacacatcgcccagggctcagctacctgtcacacaaagcaccatgcacactagtctgggatgggacttttactgcaaaccctgctggccaaaaagagggaggtgggcgggcctttcacctaaatacctgagacaggtgccatctccgagagagtgggaagacttgattctataaagattggggctgtgatatgtcaggcacccagtgctaaataagaaatctggagtacagggtcatgggccatgagaggtgggcactcagaccaatgtgttagatttttgatgtgtgcatttattgggacatgagtgtggcatgggccatggtgtgtatggcaagtgtagtggagatgagagaggaaggatggtgcggggaagaggaggagttccaggtctagagaggacaagagctgagcagaaaaagcaagcctcgtctaatgccataaacaacaggatacaaccccatcaagtctgagccctgtgcttcctgctgacagggaaaagaaaacaccccaagaagacctgcagaagccaggccccagagcctgggatgcctgcctggccattccggatgctcactttcgtggagtttcaggatctcaggcgccagaccaacctgagtaaccacccagactggaatgtgaggccagcccaagtccaagggggtgaccctgtctcctgctcaggactgccatgcctaggaaaccagtgagtcaaaggaacggcacgtggaaggggacctccatcgccacccagtcatgcacacagcagggcaggaaggggagctttgggttaaaaagaaacagctccatctcctgtgcctgtgtggcccttgtgggactacacagggctggtgggtaaactccagagtcaggtgggagctgggtctagcaatggttctcaacgagaggcttctggaaatgtgagaggttttctagtcttgtagtggctgggaacttccactggtgctcagcactgtagggccccggatcacaaacgccctacaatatcaggcagtccctgcaccaagaactgcccaccccagacactgctagcacactcttgtgaaacaccacgggaagagcaccaagctgagaattaggatacagaacagccttcagtttactaattacatgaccttgagtgaaacacttgagttttgtgttcctccattccctcaactgcagaggatgcctgcccttccattatcctacagtattgttgggagaagaaaagttgtgagaaagcccttgttaaccatcaggtaccatgcaaactccagtgtgttatttccagacagccgggaggtctctgccctctgctcccactactggggtttgacaggtgtcagttggtgatgctggataatagtttctgctccaaggacccaaattttctagttgagggacactcaggtcaaggcttgacagggagattgagaagctgatttctgcaccttctgcatgccacctttctccacaccgcctaatcagtactatggccgagactatctgactcccatacccatggctcaatcagttccaaagtcagggaagactgaagtggagtgaatgacagtcactcccatgaccacagccattgttcccatcacccaggccataatgacctgctggtgtgcatctctctcctccactgtgtgggctcctggagacagatgccattccacaatgcttggtatccaccaggagggagtgcattgccaagcccttccctagggctccatatatgtttcaccattcattagtttattaagaggtgctagttcgttagtgttggatgaggttgccccaggaaggtgaagaaaggagagaaggtatagataaccctatgcctggggaattctgggatgccaggtgcttggtcaaacccagcatcttctccagccagctgcccactccaagtcaggagtgtcaggtcccccccagagaaggacagacagccatcaccttctcctgcataaggtcctggcacatgacagaggccacaggtgtgggctccccagccttactgtctgtcacatgctctgcagacagggggcctcagggagcctggatggcagccttcaaaaggggctggggatagagatgcaccagtgataagccacagaaactgagaaatgaaatcactgccattccccacatgagtgctcattagcaaatcagtctcagcttgacctctagtcccctgagtcccaagacaattggggctctgacagaccctctaggaccccccctcatacccatgtcctcatgagatcctcagagttactttcagatactaacccacttgttctgggagacctctttccacccaggctggagaaagccaggacaggggtaaagcatggctcagagggtgaaggcggaagctgctgttcccaccctccactgacaccagaaagccccagctgcttccctagcctccacacttggtgcccactcaggaatgtacatttgtgacaggttcgtttatgtccacagcaacacattcccatgaggaggccactcctggccaaccagccctcatctccaatgggagcacagccggccttccctgattcacctgaagttgaggtacagctgagctctctgggggctgcaggtcagcaggttctaccccaacggcccaagacttttccctctgtgcggtcctcaggctctggcctgcccagtgctctgtggatgctccctggcacaaggggccttgtagtaggggttcttcttcccattccttcctatcccccaaatgaacacagccaaagcaggtgctgggaccttgtgaaggaggcaggtggcccaggagttttgcggatcccggctctgagttctggaggtgtgagttcagggggaagaatgtgggtctcaggatgtggaaagggctagaaaagcctgaagagccccatgggaggagcattctaatttagagagctggtacagcctggagcacagttgacattcattgctactcaaatcccttcttcaagcttttagagttgtaactatgataaaacccacaggggaccccttaccctacaaaatacaagtcctaaaagccaacctcctgggccttgccctgccctctgtcatcttcctacaacagaaacaccacaggacagaggtcatctgggactgagttctcaattcacagggctcaagggagtgtcagactccgtgacaagagagatctccagagttcatcttgttcatcctccacctctaggcaggaagggaacaagaaaaccaacccaacagccttgtaaatgagttgaggaagagctgggtttgcaaatggtgccatcggggcaacacagagcctggcctggccgatgtcgcacgaaacacgtgtggtctgagccgactccaaaggaatcgtaacaggagggtgggagcaaaggaactcgggtatctgccaaatcaaaggaaactgatactgtgcattaaacaccagcctggcctttttcagactggctggagagacagccccaggcctgtgcagagtttctggcctcctcctttctactctcggccctgaacttgcctgtaacttgaaagggctaattaaagccaaaagaaaaatcaaaagcttgttatcttgctccattactccccgtcccggcattagcctgtcttgcaaagctgttttccctctattctctccaaggctaccacacggtgttaggacctgcagctctgcagacttccatgatgaacttggctttttgtattgtggcaggaagcaacggcagcacgaacacttgcccatgggcagccagacggacgcctgcagctgatttttctcccaagagcatcgcccaaaaagtcagggttttaagaaagttttctacaggaaactgtcagagattgccaactcctctggtctcaaaagaacttgttgttgtttagtaagtgcacagtataaacttgccgtcttctaacataggcctgcatatgtgtgcatgctcgtggggaatttattacatgtatgcatgtatgggtgtcctgcaggcaagggggattctcttcaattggtggctctgttactcactcctaagatgtgtgaccttgggcaattcattcagcttgctgagtcttgagatactcaatgcaaaatgaatttttaggccaaggctctctaaaggccttctcaacaccaacattctaatacatctcaccacagacccatgtttgagtgtctaatagacatgtccagaacagcctctgtcattagctgccttcgtttggaagcagtccatacccccgtaagttcacagacctgtctcatggactctcttaagtggctccactactgccccaaacaaagggctccaggggcattcccaaaggttgtcacctgctaggaagactcagtagataaagtggagtcccctccattctccagtctggctctgatttgtcaactttttgctgccctgcttggtccatagcacctctcctatttcctttgtgacatcagggaactcctggattttcaagacctccaagaagagacgacatctcttagtttcagctggcccagtgcctggaagacttgacagtggaaaacagcttaagcctaatgccagggcaccatctttctcctccctcttccctatctccaacccaaatcccaaagaccagagtgatggcctctccacactctggctggggagggtgccagtccccactgagatctgcctggcacatagttatactttatgaaaggaaatttacacttttttaaacaaccaaaatacatttcctaatatggaactccaccaaagtttaaggagtcaagaatcacatcagtatggatgcgtacttctgtccaatggatacattttcctttcttcttctccccaaattaaaattagagaattgatgttctcagactaggttcataatctttaaaatgcacagttataaaaggaaaaggacaagaacactgaagatgctgatagctgagccttccaagtcacccaaagaatgatagtgaaaaagcaggaccattgtgaagaggaacagagtcaagccacaagaagggggatgcttttcatggtggggcacacgtgagctaggctgtgacaggcaggagtctgtgtcccctgcttcacctggggtaacccagcaaggccatacccaccagccatgcgaagacccctaagccaacccttctcctgctctccctctggctccccacagctctcccatcatcccatgctgctctccggctgcttcctgactttctcacatgtctcttccaaggcactgtgcacacagaagatgctcaataaacacaatttgtcccttcccatcccttttctaagttagctttgctttctctatgtgttcactgcactcttacctgactgtgctctcattttagcatttcctaaagacatacaaagggctaaaaacacacctctcctgaaattccatatctatcccaaatgtaggatgactcctcacattctcctctccttctaccatatggtttttattctaagctcccaggaaagttatttgcaggcttggtgagtacaaagggcatgtacgtgtcttgcactacagcacactgtgatctagactccagccatgcccggtccctacgacatccatttgacacaattcctacctatttccagcactccccgtcataactagtgagccaatatgaggcagagaaaagtacactgatgggaatttatgtttcagctcccactctgactcttatacattcaatgtcatagttgcagaatatttggtgacactctgggtccaatgagactcagagatgggatgggatatactcacttcatctgcaaaaggggaaggatgatacacatcccatgggggctacaggctggggttctcatcctacactcccaaccatcccagcgcgcagccctccctgtactcaccgcactgctgcaggggatgtccttcaccttgagccaggccaggtccagcgtgccctcgccccggtaacaagactgcagccgctccttaatgcggtcatttatctgcttcaagatgaagatgcacagggccgactcatccagggatttcattttccgcttctggcccttggagaagacggtgaagagcaggtcatcatctggatggactccaagggtcctgccaagcacggcccccgctttggacaggtaggcagcctgcagcaggcggtactccaccccactgcgctcacagccaatgggcacctctacataggagttgaaggctgtgtcctccttgcaaagcctcacgagcttggatgtatacacctgctccttggtggtggagcctggtggagacaccatctcaggttggagggtcaaaaagtagacaaagttgccactgctaaaaccatagacatagtagatatcaaagtcagggatgatggtgaaggtgtccgaagggatcttaatcatcgaggccacgaactcatcatggaagacgtacgcgaacatgccatccgcctcagagttcttggtcagtttccggctggagatggtgggaaaatactcgggcttcccatccactgccgtggcaatgaacagcttgtcatccaggttgctgtaggagacgatcactccaaagactgagccgctctcgttgacacctgacagatagtgctccttcttatgataaggctcccccagcttgaagaggtcctccagcctcagcagcttgcagatgccttggtacaggctcccacaggcaatcagcctgttctccttgtagtctatgaggagcatcttgttgacattgttggtggtggtcaggggctcattgcaggtctggacgatgcggggtgggtaacacttggggttgtcctcgtccggccctgtctcatgcgtcaccaagaccttcaggtcgctggagagcttgtaaatccgattgacggcccccaagtaaatgtgtcctgtcctctcatccaccaccaggtgattgaaaccctcggcgggctctcctcggaatgtgacaaatgaccgctgcttctgggacagcggggctggctgccgggtgagcaaagtggaggagcccatgcccaccatgaggaggtgggagagaaggcaggtccagttccagggcatggctttcatggcagaggcgggtcccagtggcacagcagcactcaggcacagtcgtcccctcagagggccaggactcagcaatgcagtctcccctactggagaaagggaagacaatgagctggataacaatgccagtggcttcatttcaccccacagcttgtctgcctggactttcaaaatgttctgcacacactgagcagaactgcactggggggtgctggaggctgactgagtcaacccccaccacgggcatgtgacacagtcagagccgggtggcagcagccccaggaggacacatcagtaacgataatggtggtgatgataatgacatgataatagcagtgatgatgatgatgatcatgattaacagccattatctactgagtgcctgaatttgtgtcagacactgtccagcactgtcacccgggtcaggtgccaccagcaggcagcatccgcaaagactggctggaggagaagagggagggagggagggagggagggaggaagggcaggaggcggggctgcctgcactggctgcaagctttgtccggtgttccccacagcaggcctctgcacacagtttctccgtctccaggctctgtgaaccacctcctgctggaccccatctggccgtagaggtggtaacagagacctcactattactatccacccatactacattgccccttaaagagccacacttttatgaatagcccctttattaaccttttctcaaaggaccaaatttgtatgtgctgtctattacctgctgggaccctgattggtagacctccgaagtacatcctattgtagccacattttatagctaaggaaagcaagcttagggaagtcatgtaacttgcatagctataagtggtagaggtagctccaaatatgagtagtgtaaatgtgcacaggttcgcaatcttaactgctaaaccatctcagttcaccccaaccttgcacagttggggctgtaccgtggtccctgtcccatgcagcagaagaattaaggttgatcccttctcggggctgtccattacagccactacctccagttctctgtgtctgtacctactactgcaggagaaactttcctctgtgcctcctctgctggatgaagaggccaaattaaaaacccacatcctcaatctcgtcacactgcagctgcaaccaggtcctctgggttcactgcccaaccctgagccctaatgttattttaacaaggcagatcttggcttcctcccctagcagggcctcctctgagaggttttcattaaagggagagaaaaaatgctttaagaagcagtcaagcaaataaataaacaaataaatacaaaactccccgaggaacaagatcactccccatcctgagggtctctttctattcaaggtgcttcctgcatgtgttcccattggacagctttatgtttcttccagttcgagagaattcagggcaggaattgccaacatcctatctgggggcatctcagctctgtggaatttttctcattcacccccaaacacctcaaaagtagagaatgagaagaggtagatcactaagcaatggaaaattccccagcagggagcaaacgctaggtcagatggaaaccaagagaagaaggaagaaaaccaaataaagactttgcattgtcagccagcatcctaatgaaaagcacaggccttctccagtcaatatcagaggaggaagactggttagtggaacacaccacaaccaagagcagtgctgaaagccaagggccttcattcattcacccatgtggcaaatgtttgctcagaacacacacaaaatgtgcaagacactgtggggcccaaggagcagatcctcaacgaatgcgtagtcaaatcaggccgataccaccagaacctgaactgatacgcacgacaaaaagtcacatggcatacaagagagtgctttgaaagttcctaggaggaggaagacttctaacttagggtgagagagggcaaggagcaggctgcaggaggccttggggagggcatggaatttgggctgagctgtgaacttcaagaagacagtcagagcacgaagggaaagaccttctaggggaggggtctacatagcagaagcatgggcatatcacatgagggtgtgtacaaggaagagtacgtctggagaacatagttcatgaatgaatcaggtggaagatgaggctgaaaagagagagcttcagccttgccaggatgtcactgggaagttgagactgaaatgcacagtgttgaagacagaaatgaaattgtagaggaaaagagcaaaggcccccagagaggagcctctccctttccatttagccttagcctttgcagaaggagagtttggagctgagggtctgtgaactccacagggcagggctgggtctgtcttgctcgtcaacacattcacagctgcacatatagaggaggctcaacaactgtttcttgactggcagaaagaggggctggaagcatagacgaataccaatatctgtggagtatttactgcaccccagagcccatgcaaatactttcacatagcttggctcacataatcctcaccactgttccctgggatcagaattgtcttattcctatttcaggtgaggaaactttagctctgcaaggacactggttaagatgtagcagaactgggtttgaagtccaggtttcaatcaatgcaaaatccatacttttctagaaatgcacatttccagagcccagaagatagagcacttagaagcccttgttaactcatgtaagccccaaacagaaatcctgggatatcacctaccagtatcatgagaaaaacaaagtcctctctgaccttcaggggctaagctggtagataacaccgatcaggtgagttctgtggtttacctctgaaagtattaatgactgtaaagcagcagctgcacagagcctctgcctagcacagttaagtgcttaggaaatgatagttgctgtcgttgttatcgttagcaagattaaaataggattagaaagattaggattatgataatgagatggttcctggtggtacatctcaagatgagtgatgaagagtcaagatggttcaccttgaattgcttgtgcaaattcaaatatcaaagaagaatctataagtttttgatctaaaagagataatccagcttagtgattcccaatccctgattttagagacaaggaagttgaaatccaagaggtcagatgaaattgcaagaggtcacacattgagttgaagacagtgtaagactgggtctcacactgtccatcccatgctctttccaccaccccggcctctcttctgactttatgtgaattcactccagcagctgcttccagcctttgtctgaaagagactgctctttgggcaccatatgctctgccggctaacagggccctcaaaacgtctctgccaacaaccaaattccagcagggctgataatcccccttccagacaggcaggtgcaggtcggggctccgccaccaacttttctgaggagagaacttcgcacagtctctgtatcacaacctgccgtatgctggggaatgtgtgcctaccccacgacctgccttactgtacatacacatggatccatggccaatcagcagctctctagtctgcaagaggtgagatgaagaatcctataattacgaatttactgagcagaaaggtgccatggctcattctgcatcttctattaggcactgaaaggagacacagttatgcatctcaaacacttatcaccctcatctggggatggtgagattactacacccagagaggaggggggcccacagaaacaataacatgtactgggaataaccagcctttcattttacacactaagaaagggactgattaggaaacaaataagagagaaatggaagagaaaaggggaaaataaggatgtgagctccagcttgcctcaccaaagaccccaccaggaaccaccacagaggtgacaccccgccgagcttgggacccacagatatgcagagccaccagccccctgtctccctgagctgtctaaggctgctccaatctggcaaagcaagagtttccaggggggtttcccttccaggatgtcaattcttgtaagcggtaaccccaacctaggaaacccccaccccaatatcagagcctacccaccatttcgctctcaagtcaccatttagctagtttcaaaaccaagtattagaaattacattcagcccaactctgattcttaaaggcaagtaatgggaccaaataaccttcacgattgccccaaaggattcatcgaactacgtagagtgggtaagaaggcaggagaactgaaagaccccgtaacccaactcaaacatgctacagttttcccttctttgaaatcagattttaattttgagtagtctcaggggagatgggactcatttatagaagctgatcatcattttgattaaagaaattggggttgtctttgttttaggcagcaagtttcaaagaactgaaactaattttcatgaaatagcaccatcctctcagattcctgagtggtagagaggaaagttattatagagtcgtttaaaatagcaattaccctgtgaaattactttagagtttacaaagtgttttcatggatattaccttgttctgaatttcttgttcatgacaaccctgttaggtagatgaggtatttataagtatgccttctttaaagataaggaaaccaaggcatgaacaggtacagctcttggctaaggtcacacatagtcacgttgggcattggagagctgagctcttcaggcctcactcagttattcacaatatattccctggccccttggacagagtcctggtcctcagaccttttattatggggtaataggattctcagaaaatgtgccctaagatggcatttcaaaattcacgtcacaacacaccatgaattaggtgagtcacaggtgttttttgttttagtttttgttttgttttgttttgttttgtttttgagatggagtcaccatctgtcacccaggctagagtgcagtggcacaatctaggctcactgcaacttccacctcccaggggttcaagtgattctcctgcctcagcctcccaagtagctaggattacaggtgcccaccaccatgcctggctaatttttgtacttttagtagagatggggtttcaccatgttgggtcaggctagtcttgaagtcctgacttcaagtgatctgcctgcctcagcctcccaaagtgctgggattatgggcatgagccactgtacctggccaggtactcttcttaatgaaataaaatagaagggaaaatactagtatgtcacatagaaaagataagcactgtttggtgagactttttttttttttgagacagagtctcactctgttgcccaggctagagtgcagtggtgtgatctcagctcactgcaagctctgcctcctgggttcatgccattctcctacctcagcctccccagtagctaggactacaggcgcccgccaccatgcttggctaattttttgtatttttagtagagacggggtttcaccatgttagccaggatggtctcgatctcctgacctcatgatccgcccgcctcggcctcccaaagtgctgggattacaggcatgagccactgtgcctggccggtgagacttttgttttacccactatatagcaaactacatattgaatgtgatgtaaatatgtgtgatgtaactgggtccctgggatggttaattttatttgtcaacttggctgggccacggtgcccagatagttggtcaaacattattctggaagtttctgggagggtgtcttgggataagattaacatttaaatcagtctgctttgagtaaagcagactgccctctataatgtgggtgggcctcatgtaatcagttgaaggtcatgaatagaacaaaagactggcctcctctgagcaagagggaactccaccagcagatggcctttggacttgggtacaatattggctcttctctaagtctcccatctacaagcctaccctacaggttttgaacttggtgcctccaaaattgtgtgagccaattccttaaatcaatctctgtgtctctatgcacacacacacacacacacacacacatcctcttggttctgttttctttgaagaagcccaactaatatagtcatggtcaaaaaaatttgaaacacactttcagagacggtgcatacctgttgtttttgctgtcattcatttatcctctgggcatctgtgcctttgcccaaacacttctgctggaattgactccacctctggttcaaagcctgagccactcagcacagaacgggggtcgggagggcatagtgattggatcaggaatgagaaactggttaaatcaggtctccgacaagcaacaggctttggatagggatactaggggagaaagttctagctcttccaccagatgtaaccttggagaggcaagggcctaagaaccgctagtgccatcttgtaatcacaggggtgagagcaggggacaggagcctggaagaatgaagccaaagtactgagaagagcagaactaagccaaaggatagagagtactgggtcccaggcctggcgacatcctataaatgtctcaattgtgtccactgaagccagctctatgcctgtactttccggttacgcaagtcaaaaaaaatttttccccttttgcagaagccagtttgggttcggttttctggcacttgctgatgtaaggatcctaacctatacacagaaaaatcccaaagagtacagtgtctcccaccacaacctctctaatacactatttttccatgggatcaagtgagcaagccaaacagatctgtgccttccactgcccacagagataaactatggttttacagatagcgaggcacaatcccaggtgatgttcgaacgtgtgtgcacgtgtatgtaccaactttcagaatcaaacacaacacttccctatctgctgagcatttgccttaggagctgcaccagcagagctcttgggaagtcttcaccaattcatgcttccgggccctgagttagactcattgttcaaatgaaaccttctctgatcaagccactggtctaagatgcccctactatatattagtgcaggaaccagtgccaccagagtctcacattttacaaactctgttatatttgtccattgatgctgtctcctagcataaaaatatgagctccttgaggacaaggattatatattgcccctcttttctccagttccaagctcagagcctgaaacacagtaggtgtataatagatgtttggaaacacgtgaatgaatgaatgaatgaatgctccatagcagagtatatgagatggcagtgggtatcatgtacagctgaagtacaaagtaaatcttggtgcttcaagtaaatctttgagccagtcaattcaaacagggaccaacctaaaaaactggttgtaccctgttctaaaccagggtttataaatacttaaaatactccattttgtccttttatttatttatttatttatttatttatttatttatttatttgtatttaaaggtaaagctcttttttaatttttattaggacatgagttcaaatgcatcagagaaactacgtctttcgtatatgatttacatggagaccaaccggtccaccagctggaatatcataaaaagctgtcttgtgttagcaaattggactttgagaaccaccatcctatgcagcaaaggaaatcagtatggacctggttgaacagaagaagctgagcctgaaaataaaattgcagcatggaaaacagacaacaacagaaaacagccacaatgcaggagatgccagttgctagaagtcagcatgcactcctgtattcagccaacgactattgatggagcacataccacatgatgagttctgggctgggtgcaaaggatagatacattccagagcaaaaaacagtgtccctgccaggagtggtgactcatgcctgtaatcctagcactttggaaggccgaggcaggtggatcacttgaggtcaggagtttgagaccagcctagccaatatagtgaaaccctgtctctactaaaaaacaattagctgggcatggtggcacatgcctgtagtcccagctactcgggaggctgaggcaggagaatcacttgagctcaggaggcagaggttgcagcggtgagccgagattgtgccactgcactccaacctgggtgacagagcaagactctacctcaaacaaacaaacaaacaaaaccagtgtccctgctctccaggggctgagggtcttctagaggcccctctagctgtcccactggcaagctctgcagatcctccccttcccagcctctattagaaacccagaacttcctacaacactgtacaacaggtcatttaatctcaattgtgcaggtggattgggaagaggaagctaacttttcacaaataacatgcgcttccctatgcgtgaggctgctggtatgaagtcagtgagaggtggccatcagcgatggatgacatttcccagcctctccatttccacatggtatccaggtgtgactgtgtgaatagcaaggtcatggtgacatttccatgccaaagcagggaagaaataagtgtgttttctctacggtttctttcaccacccagctggataaagaggaccctgaggccctataggatggtggagcctcaagatgaaagattcgtgcacccaccaggaacatcagacaagaaagaaacctttactgtgataatactgaaactgtggatttgtgtgtgacaacagttaacctcaccctaactcacaggcagaaacacagcaagctcactgcatctcagagctgggattcaaacgtaatgctggggggctccaggcctctgttctttgtggtgcatcaggctctggccctaggaagagttctctttagatgtcagcagccccctcccttgtttccaaagccagattgcaagtgggtaagcccagagatagaggagatggccaagctaacatatacaggatagagaaatcttcctgctcaatggccatttccaagtttggggctcagggaggtaagtgtgtgtgcagctgagggcagtgagggagttggggagcagcaacaggcctcatttccatttcatctaagaaacttcaaacacttattgatccatgcaaacaaaatggacacatgctatttgtagatttctactccaatttgtaatccgtgcattcaacatagcgtcttcagtaaggtcagtattttttcatgtctgtattttttttactttaaactcttggtttctagaagtgggagccatgaattattttacaactttccctggagaattctatttacacccatctagggcccaatcatgcagctcgctacagtctggggcccatgacagacaactgaccccatgtacttggccacctcactgcagctccattcgtcccggccttcactgtccccttgccccttgttgctagctatctcagaaatgagtgtcacattcatcaaaggaaagagccagagggtagggttgacacagcaaaacccatcactaccactagggggaaaagtcaagtcaaagcaactgtcttcccaagagaaggtcactgctggctttgggcagtctcagtgtgggtggggcctggtggggtcagctcagccacaacacagccttagtccagaaagcagcagtccagcaggggccatgggagccctccttccggtgtgcttccctctgcctctgcttctcttctgagagatgggaactgtgaaattgatgactggtgggagggctggagaaaagtataaaagatggggaagagggagcgatggagggccaggcactgatgtagagtcttggcgccaccaggcaaccagcccggtcccagggaaatccagcaccaagctcagctacgcggggctcccttcatccttacttcctagtttattaaaaggggatgaggagaagtgattaccatggacagagcctttggacccagcctggaagaagcctctgcaggaggctgagcctgtgagcctctccattcagagatcatgtcccagccggacctctgagatgtttatacatggtttccacgccctccttcctttccctcccccaggcctccttgtccttggcctggagggtgttccctcagggtacaaaaccacgtctccctggccaagtctgccgttcccagtagagtcgagcaggagctccagccgaggcccaggcagccccatgtgaaactctccattaccacgtggagatcgccttgagattccaggcactgtgccttgggacagtcactaggcaatggctttctttactccaagtgtggcagcaaggctttaaaaacacagcactctcaataggatcctggcttggggaggatagaatcctaaacttctttccagcatctcacttaaagaaacaggccagccaggaatttggagtcagatgccccagctggagttggtgtcaagacctgctctgcaaaatggcacaggctggcacctatgtggccactgtctcctacccagtccatgaggaacactctatccagggtctgtccaggggtactggctcctggtcttcaaaggggacccaatggcctctgagtgcacagaaatggggggacaccatgggaagttgctaagctgtagcaaagggagacttgctgtcacgtctgctgccccaagacctgagtggaccttgggaaccacagaaaaggggcttgggggtcaccacaggctggggatagtcacctctccagtaatccctgtctcgtgcatgtggcctgaggcttgtccagctgacattttcaccaggagaggaggctcactgcatccctgcctgccactctaacctacactccctgtagcctctctagctgctctggcctggccccagtaggcaaagccacattcagtggtcttcacccaaatgagctccttgctctcctttcatggtaaagggaagaagtgggatgtttttggctcacagccagtcatgcatcagccagtgtcacccataaaagcctcctctcagaattgccatggccaaggatactattggcatcaggtcattctaaccagacacgtcctgctaagtgacagcctttctttcttgttgcctcagtttccccatctgtaaaatggcgtttctggaaataggatggggaagagagatcacccagtttcttcttgtgctaaatccagaagtgagagtgaaatgttgtaggcttcacagaacacaggctatcattgaggttgggaagtttccacaaacagcctttgtggaggtgcagggcagagccacgtgatgtgatgattacaacacccaggggtggtgttcactgggtgacaaaaagctggtgctgaagtttctctccaaagactctttgcatctttgcttaagttgcctttttagctgcctgaatctagattgtggagagcctcaggaatgcctgccagggttgaattccacagtctgccctcagagaactcaggatactcatctgttaagtggatgtaagtcacactctttggagtctattttctcccttagataaaaaggaccaagcacattcttaacagctcaggtgttggtccatttcactgagcctgacaagcaagttgatctttctgggaaaggcctttgcttcttccggcctctgaggacctgggtccgcagcaggaggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttctggccccacagagtcttcactcgaggaagcccataatcccaccaaacattggcactgtgggggagcaggctatttggggctcactcagccaaatggcagggcttctgttgtcaccaacatctagtgggagtgcctcactccaggccccttttgtccctctaccccctctcttctttctcaattccccgaaaaatcaggaagtgaacagttgtctcccttgctggtctatattcatgtaattagtgctatttaattccacgatgagccaaagctcataaaatacaaaacatatttcagctgtgtgctgaaaatcttggcagaaatctccactgcagccggaagctgaacggagatatatttgctccttgaaaaaaaaaaaaaaaaaaaaaaaattcagaatgacggcaacaaagttttggggccaggcactactacctgagaatatgtaagggggtagcagaatagaggattttaggacataaagtttggaaataatctctatcaccatgacaacactaaatttaagaaatatttagtatagatcaagtaacaagtgtaatatatagtgtacatgccagaagaacatgtcatacatcataaggaggttgttttggtcccactcattccttactcccaagaattaacacgtgctttaaggatttgggtcccagtctccgagtcatcctgcctttcccattgggcacacacctgcaagtcaaatggccaagaagatgtgcagtttctggcaatgattccaaattaactaacacatcctcatctcccagctctttttcccctgacccctggactgtgatgaaacctcaccctatctctgtgtttgtgccagcaacacctgggcaaggaacaggaagtctcatccccttcctccccaacttcacaaaaccgggcacagaagggtgaagcaccggggactccatcctctcaggtgcccatgactgtaaagtagatgtgtcctcaacaagccgacctctacctctgaaatcaacaccaggtcctaacttgccagggctgctgacataacagattccctcccctggcacccctatgacttggtcatgccctcttcctttttcaggtgacaggaatacagaaaggagcatgttggtagagggcccagggcagggcctggcagaggggagattcatgttggatgctactgacatccccctttcaggacctgctcagaagctgtgtccatggggaaagagaggccatgaggtggactggggtgtgataaagggtcagatccactgcaagacccaggaggcctttcagtagactcagcagctcttctgaatccactctgtggatcagttccacggacacagacacagcatgctccatgcagaggggacaacacctgccagctcccactgccctcctactcttatgccacccaaaactccatcataaacacaaccatcaccacctctcattggtggaatgctttgccttctctaagctccttcataggcaataagccactcatggctccaaacatatatgaccaccccaacccaacccattaggattattgctgaggcatgactttggatgtcagagaatctcattaactttcccaaagtcatgcctttcctctctctatgcctcagatcttcagttgatccaatactttcctaataaactccaaagctggctgggtgtgttgactcacgcctgtaatcccagcactttaggatgccaaggcaggcagactgctgcttgagcccaggagttcgagattagcctgggcaatttggtgaagccccatttctacaaaaaatacaaaaattagccaggcatggtggcacatacctgcatttccagctactcaggaggctaaggcaggaagatcacttgtgcctaggaggcagaggttgcagcaagctgagattgtgccactgcactccagcctgggtggcagaggaagactctggctcaaaataaataaataaacaaaccccaaagccactcaccagagtcatcactggggattgtatagcaaaagtgggaagggaaatttgtctagaaggcccatgataaatgcacagatgttaactgggaagagagaaaagccttctgacttgttctggcctgtcaccttgataggccttgaaaacttgtgcacaatggagctcaaggaggtggcaccattgggcaagctctcgggggccaagggcttgtcagaagaaactaaccagcaggcagggaagatggcccatgtcttcatgcattcgttcaccaacacttattcagctccctagactctacaccgggaacctacattctgggggtgcagcaatgagtaagacaacaaggtttttggtctcacagagtttacatttaatagggaggatacacaataaacaagaaaaataactattttcagatagtgttaagacctaaaagaaaaaagaagcaaagtcatttgctacaagataactgttgcaagcgtgacctcagagagaccaaccctggcttctctagttggaatagccatggtttgtatctctgaggtgacacttgcagggggactgaatggccagggggagccagccatgcaaagatttgggagaggagctttctaggccaaaggaaatgtaaatgcaaagacactgaagcagacttggcaaggaaaaggcagaaggccgacgggctggaaggcccagaagagcacggaaggatgggtgatggggtgggagagaagagagacagcagatgccggagggtatattccaaatggcaggaaaagccatgaaaaacttctaagcaagggaatgacatggtcagggtctatggctagcaagctcagtctggctgctgtgtagagaatggtttttgggtggaagaggagttcactgaggagtgacagcagcctgactcaggtgacagtgtcagaaagcgagactggttgctccagcaggggttgctggtgatgtggaaacaaggggggcggaagagagggacttagtcacacctccttgatttttggattgaggatctgggtgggtgctggtaccatttaactgatatggggaaatcagggcagtggagcagagaaggcaagagttctttttaggatgtcaaaggtgaggttgtctagagggcccacctggcccaggttgatgctcaagagaacaatcaagggaggtgactcacagagaaccacactgtgtgttctgcggaaggcatctcatgtaaatgctcctaggaggatgctaatgtcatccttattctctggaagacaagctgattctcaataactacaacgaagtgaggctaagatatcaacctaaccctgcaaaaagccccatagagatgggggccttgtaactgtgacggcccctgggtagatgcagagattgtaccaagggtccttggctggaagaacgggatgtcaatgaaagaattttacttaggaacctagaatttgatgcttatttttttgtgaaggaagaactaccacagcaaaacttgattttaccaaagggaaattactgatgcttatgcagtacaggctactttataaacttcacaaattcccaaccaaagttaataacattaaaggattgaaaatggaaaaggggaaacagcattgatcatatacttcttagcaaggagccctctcttctctcaagtcataaagagtgccctgggttccccattatataaaacagtgaagggctaaaggccagcctgaaggaaattaggctgaaatcaaaataactcacactaagagcaagacttttttttgttgttgttgagatggagtctcactctgtcacccaggctggagtgcagtggcatgatctcggctcactacaacctctgcctcccgggttcatgccattctcctgcctcagcctcctgagtagctcggtgcccatcaccacgcccagctaattttttatatttttagtagagacggggtttcactgtgttagccaggatggtatcgatctcctgacctcgtgatccacccgcctcggcctcccaaagtcctgggattacaggcatgagccattgtgcctggcaagacttttttcaaaaaaaacatattaacatgtttaaaactcgtgataaaatatacattacataaaagttacaatcttcacaacttttaagcgtacagttcagtgacattaagtatacccatgtcatggtgcaaccatcactgccatccagagccatttcatctgcccaaactgaaaccctgtacccatcaaataccaactctccatcccctcaccccctgcccctgacaacctccattctacattctatgtctatgaatttaactatcctaggtatctcatatgagtgggatcatttagtatttttcctttgtgtctagctgctttcacctagcttaatgtcctcaaggttcattcatgtggtaacatgtagacaacatggtgtctttttgttttgtttttgagagactcggtctcgctgtcaccgaggctggcatgcagtggcataatcacggctcactgcagcctctaacacttggactcaaacaatcctcccacctcagccttctgggtagctgggacagcatgcacaggctgctacaccaggctaatttttaaaatttttgtagagttgattctcagtatattgcccaggctggtctcaaattcctggactccaacaatcctcccacctcagtctcacaaaatgctgggattacaggcatgaaagatggtttttaataaagatccattttgtggggggcaccagaaacttctgggttttaagtaactctggtttacagttgccagttcatggacacaggtgagaaagggaagacctagagaaaacttgtgaacaaatgcctgtcaagcctttttgggtgaaaacatgtccctttcaccaacctgcatctccagacccacaggattataataatatagcactgagaagaacaccagtccctcccaaggctctgccctgaaagggtcccctattaagcaagtatgagcaacactgcatcaccctcctggggagccatgatgcatgtcagctcactaaaagtcctcagaggtggtgctttgataagcaaacccatggaaggtttgtgaaacagggtttctcaaacttgtttgaccaaggaagtttttcttgcttaaaccctattatgacctctgggaacactgttccatggtacacaccttgggaaatgctggcatgttggtttccattcctcaaggcactttcacatctattttctcactgagtctttataaaaaccctgtcaagtaaattgagaaacttagagcaatttgcttcacttattgaaaagaaaacccaagctctcaagatttagtactggaaggaaaatctctaggtgaggagaagcaacgggtgcgagtggtatagactgcactccttgatattcccttcccaccaaaggctcatgcatggaacacattgcatcctccatcaccatggccccatggagacatagcagccctcccgttaatctcctggcagatgcctgcacgcctgtgacaactgccttctcctgatcctcttagcacagatgagagaggtcacaattttctcagattataagaaatctgacaggaaaacaaatgtagagaaaggaggaaggataaaatgagtctatcggaacaaagtgtaggtttcagtttcatcccctcctagctcattcccagactcaaaggccccgccaacccacacacccaaattgctgatttgacttctaaggtgccctgcctgaatggttcacttccttgctgcctgtagtgcatgtactcctggcgcccctgttggggctgctgttttatttggggataatgactcttctgtcctgccctatggggtaaggctatgcttgtgagggttggacatggcttctcaagaaggaggtgaacatttatggtggcagtcatccaggtggctctcaaataggtcactaggactgatggcacaccttcacaggtaggacagggccctcccatccctctttggtgcatagtcttcatgcctaaactttaaggggtcttgagggtctggctagtggtcaaagacagaccctgccccacggtggcacaatgggtgttaaacagggccactctacaagagacactgatgaagcaaaataaaccataacttggaaaccccattgacttgttatagtaactgtctctatttatttcacttttatcacccccaggccccgggttaaatcctgttaaatgtccagccttatgttagccatgctcttagaagttaatggacagttgtaaatccaaacttaggatgtagattattgggaagatgcattccgttctctggacccaatgtggccaaagctgcagttactggcagaagaaactgaaatctttagacaagagctgaggctgcaggacctcagcacctcctcaagtagacgttcttcctccattgccaagtctagagtctgagttttattttgctcagcaaggtaagagttaccttactgagaaaatcttgccatccacctctcaggagctactctcccagatacccaactgccttcaaaacttgtaggcattttaggcaggaattaccatccccattgagcagatgaggaaagtgaagtttaaagaggctaaatgcctttctccacgtcgtagagattttcccaggaaactacagtgagtaagggcagcacaatgtgtcacagtgtgaaacagactcaaaaaaaaaaaaaaaaaaaaaaagaattggaaagaaatgaagcaacctctagtgaacggactaacaagattcagtccaaagtgaaaaatcaatgacgcaaaggctcagcctgcaaaaatcgatgaggcaacggaccaataacctgtattcccagctgaattgacacccgactgcattacagtcatatttgtatttgcccagacctattccccatgccacctgccagcatactgcccacatgccagactcaacctccacgcacgtgcccacctgatccaatctgaagagcatcttccaacagccctgagaggtaactgatagagcctgcacacagaggcacgagaacagagcccctggaacaaggagataaggtgaccttctgagagttaatttagtaacaatcaagacatctgcatggaagcaccagatatctgcagaaaccaccttacaagggcaaggtgtccccaggtctccactgaaaaagcagggaagtgaagcccaatcagggtgacaaggtttcttccccaggacaagaatataacttaagaaggctataatctaaacagcttgaataaagaaggtattaaccaactcgggatggtcggctcggagaacagagtaagcagcatgagtgcttggtttttaatctcatgccagccagggagggagagttgtggttgactcaccaggaaggtgaactcccaggaggcgcagcagttggacacgaggcttctccatggtgcggactacattgttctcaagaacacccagcctcctagtcccgatccatgctcccccaaggagcagccaacccaccaatgtgtctttcttactggaatattcccaactgtattcaggagttcaccctccacacatggccgcaccccagaagcaggcagccatgattggaataagccaatgattcccagcatcaaccaacagctgtgattggattaagccagtcatgctggtctccttctccctgccagtgatgagtttaggaacagccatgccacccaagcctgatgaatgggactgaatgagaagcctgccaggggcttcaggaatataatttttttgctctttaaaagagactcatgtgagggagcacctctcttccttacttgtccacctgtttacaatgcctggaactgtggcagacttcttgtgcccatgagagaggcaccactgatgtgcctgcaatggctgaacagagagaagggaagtgccaggagtaggatgatgcaggggagctgctgaatgaccagttttagagccgcccaacttgggtcttcttgtgtgaggccaccattcacttatggttcacactattactgggtcctaccagaaggcgaaagcatctcactgactcacccagtaatccctcaggctacagctgtgctcgctgatgatactttgctgccatgaagactatgaagggtgtctaggacagcaacagccattctttcattagctggataagagcagactccagcaatgaataagatggcattttatcttaaatatcaatatccttgggactagaatgagttagtcctgagaatctgttcatctctgggtacacacaccagcaaagccagccccagtccataataaccccaccctggaaggccctacctggcagccactggctgcctcccattgcaggttggtgtcaccttgtttaacagcaatcaaagggaataacagaaatagcagaaaacacctgctaccttctcatccccactctacctcatatctcctcaaatcctccctactctgcatacttattttcatgtctttagatgagctatatctttcttacccacctcgtggcattttggaaagaataaaattaaatcaatatcaaaaatacaaggtgttacagaaatcatggaatttgggacatgaaggctgtgttgaaaatcttttcaacttactatgcattggattcactgggaaagtttttttaaaaacacagatttcagcaccccacccccagtaactctggtctaaagggtctagggcagacatcaatattttttaaaagcttcccaaataggtattcttttttttttttttttgagacggagtcttgctccgtcgcccaggctggagtgcagtggtgcgatctcggctcactgcaagctccacctcctgggtccatgtcattctcctgcctcagcctcccaagtagctgggactacaggtgcctgccaccatgcccggctaattttttgtatttttagtagagacggggtttcaccatgttagccaggatggtctcgatctccagacctcgtgatccgcctgcctcggcctcccaaagtgctgggattacaggcgtgagccaccgcgcctggcccccctaatggatattcttatatgcagccagagtggatgagaaccactgataggcaaaccctgtcacgtgcagatgaggaagcagtcccagggttcaaaatcacgcatctgctggaaagaaagccagggcccttggggtctgatctcttgagccccagactgggtatcttttcatcatgcttctgtgtcaactccagggtatttagatcattattattaatagacagagagaggaagcacaggaggaagactcaccaagggccatgaggaaacttctagggatgatggatatgctcattaccttgattatagtgatggcttcacaggtcaaaacttattcaactgtctaaacatgcagtttatggaatatcaattatatctcaacaaaactgtatttaaaaatagacccaaaaggtaacaaacataaagagacaacatatttgcaaatcaactatctgataagagtctaatatccagaatatataaagaatttctacaactcaacaacaaacagataaaccagtttgaaaatgagcaaatgacttaaagagatgtttctccaaagaagatatataaatggtcaatctgcatttcattagccattagggaaatgcaaatcaaaactacaacaaaatacaatttcacatccactagaatggctataatcaagaaaacagaaagtaacaagtattggtgaagatgtggaaaaatgggaactcttggatactgctggtgaaagtgtaaaatggtttattcagctactgtggaaaactatttgatggttcctcaaaaagctaaacatagaattaccacatgatccagcaattccactcctaagtatattccaaaacagaaattcagacagatatttgtacaacaatgttcattgcagacaacgttcaagagttaaaagatagaaacaacccaagtgtccatcaacagatgaaccaagaaacaaaatgtgatatatccttacaatggaatattattcggccatataaagaatgaagttttgatatgtctaaatgaatgaaccttaaaaatattatgctaagtgaaataagccagacataaaaggacaaatattgtaagaatctacttatctgaatctcaagaataggcaaattcctacacagaaagtagaacagcggttacccagagctgggaggagaagagaatggggagttattaatggcaacagagtttcagttggggaagatgacaaagttctgcagatggatgacaactttagttacacaacatcatgagtgtaattaatgccactgaattttacgcttaaaatggttaaaatggaaaattttatgttttatgtactctaccaccacaagaatttttaaatacagacacactgtagtcctctgccatccaactctcacaattactgtctgtatttgtaaaacatgttacagattaattaataacaaggaaaaggcttatgaaactataatgcactaagaactctacatgaattacctattctatttctcttaatagtctataaggtagatattattatgatctttattttatagacaagaaaactgagtcacagagagcaggaaatctgtcccagaccacaaagttagtatgtaatagaatagtgtttttcatctggtaacttcctagaaatgcaaattctcagacttcactccagacctaaggaagctgtgtttagacaagactgccaggtgattctgaggcatggtcaagttttagaaccgctgtaatagagccaaaatcgagttcagttaagaacctgaactttcgagtgctgtgacaagcagcagtcattcttaacaaagagcagtggttctctcacttaacgatgcatcagaatcacctgagtgcattcttgcctggagtgattctcacctggagcccatcttgagtaggctgatttggtgggtcttgggaagggcttggtaatttgcattcttaacaagtttccaggtaacactcatagcccagggaggacactttgagaatcactaatatacagaatctcattattatccacattttacagatgcggtaactcaaaatccgacattgtaaatcctagaaccacaaaaggggttagttattggctgggcctagagcctcagtccaaagtttttttcactacagcataaagccatcaccccagtgttccagatgcttccaggtgtcaacttggcacaacctcccttaaagccaacacaggttgaagacataaaagacgtttttacccattccaacaaactggcattagagtgatctaaaaaactaactggcacttgtgccaaagaaacgcagtaagaagacagaaaaaggaagggacaataataactagagcctagtttgggggtcaggactctgtcacagtggaatctaaaacctgaccatgcttcagaatcacttggtggccttttataaacacaggttccacaggtctggagtgggacatgagagtttgcatttctagaaagtttccaggtacaaatgcgttgatgcagttgggaagaactagaatatgggtcacttcctctttattcttatgaaatcagttgcctcttatgtaagtgaaagaaaattttctttcctgccttgtttgaaaaaatatgacatcataccatcctttatgcacaatgcattatccttcatatgttttattaccatcacctgtaatgttctatacatctccagattctcctctttccaaaccatttgtcgtctctgatcatgctactctgctactcgagaatcttcgatggctccctattgcctacacagtgagggacagacttagcattgtattcaaagacctccatcatctgacttcatggtttccactctaatagaactactctctattgcccatgcatgtcctgtgctttcctgttgtcatgccttcacccagttgttccctttacctaagattcctttttcctccttccttccccatctctacacttacaaatgtgacctgagactaactatttattccctctaggcctcagttttcttaagcataaaacagagatgacagtaggatcttccttgtaggttgtgatgaggaataagtagagcaatcagtggaactggttgccaccaccacaaatccctcctaacttccaaaccgaagggatttctgtccttcctttaatttccagaataatagaacctgtatacacattatcattatcatgttctactttgcacttgccataatgtttatacctgtattccctttgcagctaaggaaaccccattaaggtgaagatatgcttcttattttcagttgcatgcacagtactcagcacagtataaacacccactcaaagtaggaggaacaaatgatcaggactgttttaccttaaattgcttcctagagctgcccttgcagtgctctgaggtcccatcataggtagccaaatccttgggtggaacataaactcaggaactggagaggtgcaaggcccccaacatgaaaagaattaacttgtctccagacatcacctgttcaaagggttccctggaatccacagaggccagccttagcccaattttccaacccaagcaccttctaataattcaaggattcccatccacatcaggactcccctgtgcttacttaaaacaaaaaaccttggctccacaagaaaaccatttttctctatttgatgctctgggcctctgttctccttttgctctgctagtctaagaaactgcagctgccctgcccacctcggggagctctgatcagtggaagccgggcttcttgagcacacagcctgcaggaccagagagctctgctctcccttctgtgcctgctgccagcacccagcccttcctcccttcaccgcccatcttggagccatcacctatcccacactaacccacctccttgaacaaggccacctcatcctctcatcttagaaccaagaactctggtttgggaccacttcccacagaaccagacccctgtggggttgctctaaaggacagaataaggatattactattattattattattattattactattattatgttaacaagtcaccaggcaacaaaggcaatgagattcaaagacattccttggtggctgagtgaaggctgaagaaagggaaataaaatggttgctttatgagaactcccaaggccagcaaagaggaagaaaagaaaaaaggccagtgaagaagaagccgcagcttgagtgtgtgtagtagtaaagaggagaggggaacaggaattcacactgaaacagaaagccggtcagcttcaacaaggagaggatacaagactacttggctggaacagggatacctggtgagaaatccaatcagcaattccagatcttccctgactctgctccaagtctccccaagtcaccagccccagggccaccgcccctactaactacttccaccattagaccccctcccctctgtgagagggcccatgaaacagcagcaacttccaagtgagaggagccaagtgagagacctgaggttccttccaccccagccctccctaccctggcgtccacatatctaagcctgatgcagagaccgagaatctggctccaggggccctgtccacgggtgcctgcccgtgagtgttgtgtgtgcatagattctgtagtggcggaatggggtgaggaggcacaaagagcctctagcctgagagcagccgggagctggagcaaataggatggacactgggttggctggcactcaaagccttttattttagtagtctccaaaagaagggctatggaaagaaaatactagaacttctatttaaatctatttgtacctcaaaagactgaaacataacagctctactaatatttgatatgaagaatgggcgccattactgggcgtgttgaggggcatggatcttacaggtgcctgagagcagatggcaccatgatgctgaggctgacacggcgcccccattccttaacctgccacagtatttagcaagatatgacagtatacctgagccaattcaggaaacttacgatttactgtgttatttcacttcaataatccagtgttttaaaaactaggcaagtggctttaaggccttcctatcaggagaatatggatagaaaataacacataaataatgcaggcactggtaatcaataagaaaatgaagatgtgatccttccacacctagtatagatcttcatcatccatattacaagctgcaggaccaacttatcagaccagaaatcaacccgtctccaaataaaaaagaaatcaaaactatgaagactattttgatatctggatttatgttcaccatcattaatgatgaacctcccaatgagcgctgatttacttacagacaatgcccaatggatgggggcacatgccaaaaacatcagagaccaaacgtcattccccaactttgttgagggttctcctggcttgcagaggcagaggaggggctgtggtctggttggtgggtttccatgggagaacagcaagagggggccacactcaggaacctcaagacccagcccttggtaacggccttttgtggctgaggccaatgagcgtatctcccctcctaccctcttcctcatatcagctgcagagttggggctccagaggaaaggaaaggggtcccttggtattcaggaccctgattcatctcatttacctcgatggcagccgccccatagcccacacctcactgtcccaccaattcactaagaaagccaaaaggaaagtgtgaccccgagagaatagaacccaggtccttttgttcccaggctcatgcattataccttggccaagatcccctctgcaggccacacaggcaggatcttttcccgatgattgaaaaatcaaggcatcttcccctgcaccaataggagctaattacagagaacttgccacaggccaggcacgtggctgaacacttgacccccatcatctccattaatccccaccacaaccctacaaggtaggtcttattacctattagacagagggaaaaactggggtttacagagagtagatcattttaaaggctgcagcccagactcaaagccaggctccagaatctctgctcccacctctctcctgcttcccacagcaattgggcatgccaaacttggagaaaaacttaccttcgtcttatgaccttggacgagttactctctgaacctcggaccctcgtgcataaaatggggttataataggacatactgcattgggcttttgtgaagattaaatgagttaataagtgtaaatgcttcaaacagtgctgcacacatagtagctgctgtattggtgtttgcggttattattgccatcatgactgtgttacattgttctccctagtaagttcagtttttcttcccgtcgttccctataagtgactaatttttatccttttatcctagtcttgatccttgcaacagaccaagggagaagttgtgcattacagaggacaaagactaaattcccctccctaagcctacctccacctctgcatgcaccccactgacacatagaggtctcaacaaatagaacgacgacctcagtggtgcagaaggaaggagaaggaggcttctgaacaaggcttccttcagcccctgcagggcccccatgtggcaccgccaagcttctcctctgagcaaacctgccagatataggctgatctaccagggctccagacacctggagattaattagaaggccagtccttgggcaaatcagcccagaggaccagccacaaggagctgcagagagaggctggtaggctgtaatcctagagccagccacggagctatgcctggtccagcagctatggcagtggcagcaactcatacaccacccctaagcgaggaaatgctgccctaaacgtatggctgacttttacaagtcgaaggtcccaactccaggaagttagggcagaaagagacagtcatgaggaaagtatttctgaagaaaagcagattattttgagcacgaactgctgagtccccactctgtgtcagcctctgcttcttgccaaggagtgttgctaagctgatcttcctcccaggagcattaggctgatttaaaagatggcaaggaagcaagcaactagagaagtccgggaagccttgaagcgacaggttacgtataaactgcacttgggggctgctgcctggaggagcgagctttctttctggattcttccaaagggcagaagcagggcctgcaagtggaggtcagaagacagagatcttgatcctgtctgagaccacgccgtccacagggccagcctggcaatgggtcaagctaccccagacatatccaggcagcagccaggtgtccttttcgtgtgcaccagactcccctctaaggcaggaggttggagcaagcaatgcctaaaatgagctcttggctgtgtctggcacctaccaagcacgacaaatgaaaactttggtggaattaacaatctaatgataagatttggtggttcttttttggcctgacacaatgaaagtagcctcttaggaagaagccttaatcctctaagtccatacattgccctgaaggggccattttcagcacccaagttcctatttcaaaaaagttaagatgtgctttaagggctttagctaggattctctagttagagacaaacaccagaagcagaactgcagggtgtctcgggactgaggcacatgtgcctgaccagacccggaagagggtgggaggcatctactcaacatgctctactgtgctgcatggaagtgggagtgaggaaggccagacaggaagagagaagtgaagccaggccctctgagagtgaggtgtcaaattcacaatgacagcaaagcctctggtaagaatgggagctgggaaattcttaaaaaaagaaagtctttatctagatcaagcccttcctcaagccatgaccttctgttgtcaatttcatggagaagtgcacgggcagtgggggccaccacaacccgcacgctcagcctggacacacagcctgggatcatttatcaaaccagcagaggggaaaatcccccagcacagagcaactcctctgcaaaatgtagagcttcgctgatcctgcccgaccccaaacctgctcacatttcaagtcctccaagaaaaggatcagacaatcgctgtcctctcttgcttccccttctccagtcctcccaatgctgccacccacatggaggagaaatgtgtaccaggcttgcagacacagggtggcagtggagcccttgcctgcttccacgagcacctgcaccaccttcctctcatgagcccagagacatgtcagtgtccacacagcagcccagcaagagaggaaaggagtcctggtgctcccgaagcggagacactcgggccccatgaagttatatgatcagcacaaatgcaccggcaaggtcttaggcagaggcagtctgaagcctggagcatcaccagcttcacaggaagggaatacctgcttccaggcaaggtgaatggaactgaagtgtccccaccgtcaggaattcagacagagcaagcaccaagattgtaagtgagcattactgcaaaagcattaaagttgggggctatacctaaggctgccctggactccaggcctggctctgttatttgctcattgtgtaaacctttgaaatttctgaatctctcaaacttactttatctataaaatggatttcaaaaatagaatccatccctcacaactataaggtgtttagcatctgcccctgcacatgataagcagtgggtatcatattatggctggaagcaccttcaggccaggagagccaggatgctgtaggctgctgccgcaccccttgtccattatctcccggcttcccacactttgattccagctgctgccatcatgaccaaccagaggcagaccttgttcccctcctaacatcctgccctaagcacgagggaaagaaaatccctttccttggctcctctttgaccaagttgacattgtgaaaagcagagaatgaaaatctgatagtcacagaaaacacaaacacagtagaaataattaaagctcctgaatacaggtttcagatcctgtaataactcacatcttctatgactttttaacatcccagcccctgcctgtttccctgtgactgctgccaccctctcaccctccttgctcttctctctccctgctacaaggccccaggacctattgtgcctacttaggatcctgcctctccatcccagggctgtgggacacagggagtctcaagagattgacagtggagtacaacccaagtgagactctgtccctgccacaaagaccgtgccctgtccaaggccacgtagagccatacaatatcccttgatgagtgtgctgtgtgtacatggggagagggacagaccctccacctgtcttcccagagctcacaatacattccaaattaccggcagttacgaattggagggctccagtcagtggttctcaagttgcaattggtccccagagcagcaacacctgggaacttatcagaaatgtaaatctcaggcctgcttcagacctacaaaatcagaaactctgtagctgggttccagcaatctgatttttccaagccctccaggaagctctgaagcacactgaagtttgaaaagccactgacctgttatagtccggctagctgcacaaccttgagtaatacacttaagtctttccatctgtaaggtgggaccaaaaccagtttcatcatgtgttaagtgggaatgatgatggaacctatttcacagggttgttggttacaaagattaaataagaccctgcatagaatgtgcttagcaaattgtaagcactcataaatatttgctaatattgatcttcctaaaaacctaagagatgagttcttccacgatcactaggcaactatcaaggatctcagtgaaggcttagagagtttttgaaaggaatcgttcaaggtcactcagctatcaaagatatcttaatagccattccccagagaacagagcagtgttaactgaaggcaaggtgttaacaatgcctttccttctctctgacttgcaaaaggtctcctctggggccatttcccttccccgtgggcatctagaaatgtatggaggctttgtggttgactgagtgctcttggcttttaggatccagagggtcagggatgctcctcttgcactgtgtaagatggctctgcataatgaagaagcatcctacttacaatgccagtgacatctccactgagaaacactgatcaacccagagtttcggagctatccagagcatgcagcatgtctctgcctagagaatacgctaaacaatcacaacaattgctgtggagggctggacgtctcatgggacacgtctcctgctcaagtcctactgtggatgttgcgagggccagctctcactctagacatttcattgtcttatttaacatgcaattgcttcaaatctcatttaacatgcaattgcttcaattgccctagctccaatcaccccttcccaaacctgggctagatctccagctccgtgggcccaggcaaacattttccaacacggtgttagtaggaattccccaaatttccccaaagttcatacaggaaatggatgttggctcaagagagcagaaggtgtagtgtggaccgttctttttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggtgtttcaccttgttagccaggatggtctcgatctcctgacctcatgatccacccgcctcggcctcccaaagtgctgggattacaggcgtgagccaccgcgcccggcctggaccgttcttaaaaactttgtgctatttattatttgttactcagaaagggagacggaggtaaggatgagaggagaatgttggtactgttcagaaacttaacaatcctggctgtcaaaaatgccaggagtgaatgtaatcagtagaatcaataaagatttatttcaaaggattcccaaggaaaaagtgccagacagagagccagaggggagaaaagtaacagcagcacacaaaagcatgcacgattcacaggtttcccgaagcactggatgaaatgtggcttggatgaagttggccatttcccctaacttaacacctctcttcccatacatagcccctttccctagagactcctacctagtgctttcaccagcttccccctccccataagagtagcaactgactgtgctaaaatgttccttgccccacaaaccattaagctgtcaagctgagttggtgaacaaacccagagagagccggtgctgctggaatgctaacggtgaaaaccgcaattattctttctgctctggacaattcctgcttcaactttactggccccaggtcatattttgtgatctttggatgctgatggaagagagacggcttgatagagaaaataaccagggagattatgtcttgatagagatggaagtaactagtagaggttttttcgttgttttccttttgacatccacataggtgtcatataatggcttctggttataaagccccctatccaaaggaaaaacaacttctccataaataccttgcccacgtcagtgaaatagctgtgttacacacttgagcaccattttcgaggacactttaaatagagcatgggttgctgctttcaatttaacgtgtgaacaggagctgctaaggcaggcagagatgataagttgtggggatgggctcagtttccattggtgcatctgctcagattctaacagatccgcaggcatttaaggcatctcagggacaagccaggtaagccacgtgagagactcactcaacaaatgaatgaacacctactatgcatgagtaaaaccagatgcgaatcacttcctctagatgaaatgggctttacatacaaattataacagttccaggaaaatctaatatatgtttagaagaagaggtgctttaaaaaaaatgaaataggtggtacatgacaggtaaaatactagacaagttcagaggagaggtgggtggtctctgtgttttcttgtgtaacaacctctactgagttttatgagaattaaaagaaataatacatgactggtgcccaggacagtgcctggaactaagtaagcacttgataatgatagcagtagtcaaacaagtaggattaatatggttgacattaagtttttactgataattttaattataaatccagttggaggtaaagacaggaggattatcagataaagcttggtaaataatgggtaacatctggacagatgaagatgagggcgtgggggaatagtataggccaaggtacagatgcaagaaaattaaagacttgctcaggaaataacaaatactacaatgtgtcttcaattttctatgtttgtactgtgacaggtctgaatgtagatttcttatttaacctgcttagagtttacagaccttcttgaatctctgtattgatattttctccttgttttagaaaattcatagccattacctcttcaaataatacttcttcattttttttctttctttgtagaaatccaattagatagataagactattctcactgtatcctcgatgtctcttacctaagttttctgtatttattatacttcattttggatgatttcatttgcccactgccctacttcattaattatctcttcagctatttctaaattatttaaaatacatccattgaattcttaatttcagttgctgtattttttcagttccaggatttctttttggttcttgtttgaaatctactatgtcatttttatagtttctagtttgctgccaaaacttgtaatcttgtcttatttctacttgaaaaatagtaagcatggttattttaaatccatggtctgataattgcactggaaattatccaggaaacctgtgagtctattatttctgctggttctcggtcatgttgacttatttccttgtgtgtcagcttatctttgattacatgctggacattgtattcaaagatttatttgtagaaataatacaatgactaggataaggtatcttcctccagatagtattgtttgcttctaccaggtaactgacttgcaacatagtgtaacattaatcccatttcagaaattgtcatttttcttagctactcaagggattcaaagcctgacttcacaacttgcaaaggctggtttacttgtagttccaacccaaaatgttcccatgcttaataggccctggactccagcttgtgtcctgtaatgccctgatgctgtcaaatgcattgcttagaccctcggctgcctctttagaagccagcaaaagtctaatccctctgattagttaacctcttgatttccagcttcttccaaaatttggccctatcaatatttaccaccttactagctttcatatgtcttcaagcatgcttttgaaaatatcttctccactttctgaatttttatcagtaggaaggtcagtcaattgaattagctagtctgcctttactagaagcaaaaacctcccagctggtatttgatttgactggaacattggatttacttttgggaggaaataaaagataaacccaaacaataggccagttccaaaacatggataaacttgaatgctaggctaaaaaggaaggatctttaataagcgatggggagccattgaagattctcaagcaaaggagttctccttgggagctatacttgaggaagatgaattggacacttacgtgccaaactgattagaggggcatgagaccaaaatcaggaaggagagttgactccttttatcaaactttcagagaagaaggcaaactatctgagctagggctatggtggtggcaacactaggaagacagagacagatgggaagtacagggttatttcatgagtgaggcacaccaactagaagatggtaacagaaatcagaatatggaaagaaaaccagatgaaggacagagggagaaaagtaaaatgatatgatttgcccattaactgagagtgggattgaaagagaaagaagaatcaaagatgatattgaggttttgaacatgggtagctcagacaagggaaagagattatgagggctaagccacaacccacccatcctctttttagtcatgagacagctcaaagaaaagatctgtttcaagtaagtgacagtggccactctccaacccaaaaccctcccagaggagagatgatttcatatgagaatagagaacctacccatggtgtcactacaatcaggcaggtgggacaacctcttggagagtcagagagcaacccattttgtgatattagagattctctaagtgaaattggctgacagcacaattcccgttttggggaaggagaaagctcccagagccacttgttagtaacagaggtcctggagcattggattacaagccaggaagttccatagaaaagaaggagcacacagaaatagacttaagtgtgcagagggtgaggggggcacaccctgtcactatgtgacaggtgatccatgggggcttctaggattctcactattggttctactgagtgatgaaaaggtgcccattagggttaacttcccaggtttttaggtagggtccgaatggagtggaaatgtaaacctttaaataattatggctttcttggcctagatgtctgtcatgcactacagatattttttcctcccttccatgtgtatgagtgaatatcaaaagtaggtacctgtaaaaaataaaaatagaaaactttcactttcattgcaaagatcttggagatgaaataaaataaaagtaaaatgtaacttgggaaagggctatataaatttcacaaataaatgactgaggttgacattgatctgaactggacctgtgctacaatagaggggactagtacagccacaccaggcaaagctctccacacaacctgtttgcttttcattttcttattgtctacaccaaatcaataagatctgcaaaaagcaaatgtagcaaatgtattttttttctccctattctgtaccaggactcctctccggcttcagacctggaatttaacaggatgaccacccctcccccagtgtcctctgtgctcctattgtctgccccaagaaagctcctactaattctctcaaaaggaccttacctcctgcagttacttcacatgctcctgtgggcagctttaatttatcccagtggaagtcaagatgtaggtttgtgtagaggcctgggaaacctatcaaaggagaatgaggttgaacaaaaacatcccagggatagactctcagctccctgtgggttgggccatgtttgccactcacactgaacccccagcacctggcacaatacctagctcataaaaaaacacactataaatacttgttgaattgttgaactgagagagctgggatgagaaaaacaagccaggcatcactttcttgtcaaataatccttgtacatttgccacccaaaggcagggcaatgggttgacccaaggtttttctttcatgaaacagccccaaagagaatcctccctataaatgtgctcattttttctctccaaatgcctttattccagaagaaagcaaaacagtgagtggatgactttcatttgttttttgcaggaaaagaaaaaaaaaatgaggattaagaaaatttggaactaaggtgttaagaagtgtaatagggtagaggaggctaagaaaaaccagtgttgctgtagtagggagaggtttgactgactgactgacaccatccaccacaaagtcatcaggcacctgcgggcctggaccctgcaggaggtggctgggtgtattcctgctgactgataggataactatgcacattcaaggctaagaagaggaccagcagttgccaaccaacccccaaaactgaccagtgctgagtagtcagtcacctttgataaccacaatcatcattagtgagtccaacaggggactggctttaacaccaacccaaatgctcagaagggtgcatttgactagcttgacctacatctggttcccctctgtgatgttttggccatcacccaagtacttgggatctttgtctctagctagagcttcaggaatagtagctcacctactcctaaaactaatcttcagaatgaaaaacaatggcagcactgcagaaaaagggctaggatgtggaaatgcaggaatagatgcttccaggaccacaaaaaatgcagcatctaagaaaggacaagtattagggatccctttcatatggtcttgatcttccctcctgctttgacagttttagtgggttaaatatgctaccctgttgggaggtaggaactgagagactaaaaatcccaatgcaccagtaaaatttttttaagtccagagaaagtagaactctggtgaaagccatttgtaagcatatctccagaatctaatatatctgtgtggccaaaaacagtgggcactgttaattcacaaccagacactcactgagactcaggaacagaagggggcaggtgctggtaatcccttgagtgctaagcttttttaataatacactggagagcagaggggagaagaaacagcattaatggaaatgattgaaacaaatgccccactagtggacagtgatcttgttttgggcttacaaaactgattgattatcagatccaccttaagcctcccttttgagaaggttctccatccccacccttgctcctaacacccttgtcgattctggttacatcagtctggaacaagggcagggactttgtaactttcaaaagttcctcaggtgaatctgaggacaaacaaggcttaggaatcatgggtccaacccatgagattcacaaaatgaaaatatgcaagtcaaatgccaaactggcccatctggtttcactattccaggaaagggagcccaaaaggatgctaatttgttacaagtggcctgaaaaatacatctatgttttaaatacttcctctcttgaaatagtaaactgaattacagcaagctagctccatggtgatattttccctgattccagttcacagagagaatttaaagtgaaaaatccttttcaaaaggaagatacaataggctgtgctcttcaatgatgcttgctctgggcccagtactgatgctgaccacttcacacacgtcatctcacgtaatctgtaaggaaggcatcatcacccccatcttacaaatgaagtcactgtctcagggagatttaagtacatttgcccaaactacaaactggtgggatgtgaattgaactttaatctgatttcggagtctttaccttgaagtctatacagtatgttgctttcttaaacccccccacacctacatctctgcttcagtttctaggtctttgtatgtcacttaacaagcatcccctccatgccaatgtggttgcacccatttcttcgctagggtgctcctgaatgcatgcaggcatgggtaagtgtatagtgagtagtaggagtcaagacaagaggctgggagctgtctggggctcctcctgggatctcctggtggggtgcagaactattccagggattccaactctggcctactgtacagaagaatcaagggacagacattccaacagccaggcaaaccagaaccacagagaaaacagggaggcagtcaaagccatcaggaccccacaaatatacccaccaggagaatcaaatcagggtctgcggaggcaacaagagagtttgttggtggcctagatttttactctttggaccactctgtatttcagcttcacgcagcagcttgcaaaagagccctggggatggcaagaaagcagaaagcacctctctttgtagccacaactacagatcccaagaccactatgaccaaattaggacagaaagccttcagtgacgcacacacaggccctggggagtctgaacacgagtagatctaatgctgttgaacaaaacgtgaaaccgaagaaaacacccagccacacagagccctttgaattggtggcttcactccagggctgcaagtggggagagagtgaaaagagacaaagcctggctttggaaagtctcaaaagagtttctaggaatgccacgtcccaaatcctgtggggtttgtgaggggtttggagagtcctgcttgttgaaaagcacttagttgtcatagtagaaagtggagttctagactcccctagccctcattacaaatcaatgagtagagtttaattctaattgtgagatgactgagaaaggatttttatgataagcagatgaggctagggcaatttcaagtgcaagtaaggtctttatttattggctttttaaaaaatgtcccaccattttgtatgtatttgggggttttgcttgtggagagagcccaggagtgggacatggaggtagacaacactgataacagtgagagacgctgccaggcagtctgagttctctgttcctagccctgggccaagagaaatgtgctctgacccaaggttaggcatgttctcacccaagaccaagaccaaggattctcctaaacattccaataaatacccaacgtagcttttaaaccttaatctgttatttcctagtttgcagagtaaaatataccctgtcagaagtgtttgaaccagagtgactccatcttgaataggggatgggtaaaatgaggctgagtcctactgggctacattcccagaaggttaggcattcttagtcacaggatgagatatgggttggcacaagatacaggtcataaagaccttgctgataaaacaggatgtggtgaagaagctggccaaaactcaccaaaaccaagacggtgatgaaagtgacctcgggtcgtccccactgctcattatatgctaattataatacagtatcatggtaaaagacactcaggccagcaccatgacagtttacaaatgccatggcaacatccacaagtttccctatatggtctaaaaaatggaggaaccctcagttctgggaaatctctgccccttttctggaaatctcatgaataatccacccctcgtttagcatataatccagaaacaactgtaagtatactccatcaagcagctcatcctgctgctctgcctatggagtagccatttttttactcctttactttcttaataaacttgcgtttgctttactttatggacttgccctgaattcttttcttgtgtgaggtccaagaaaactctgttggggtctggatcaggatgcttttctggtaaggcccctatcatcatcccacctaagaaaacaggaatcccagggaacctaatttcccctcgtacaaaatatttattaactactcacacccttgaggtgtcttggtaggaactgaaccacttagttcagacattggaagtgattccaaacttggctactcatgagaatcacctagggaacttaaaaaaaatcctgggtcccaaccctggtgatgctgacacatttgggccctcccaagatttttgaaagctggaaccatcaatgcaggaaaaaccttaaaagtgagtggaccctaaaatcttcctgggggcagatttccgtgcttctgggagggtcatttccctgagtcattaccctccttagtgttctggaaaatggcaaagtacatcaaatgcagggaggattcctcagcagtcatgacaattgctatttgggttaagttactgctacatctttaatattcccttggggtgagttgtttgtttgtttgtttgtttggggagcagcatgggggctaggatttttttcttaaaatgactttagaatgctcagcttatttttgtggatgggcagacaagttataattcaaaccacagtttgaacattaggtagagagaggtagagttatagtttgaaaattaggcagaagaagacagcacaggtgggtgagatcctcactttacaagaaggtggaggctgagcccaggatccagttgcagtttggagcaccaacccagactttggggttggaaccttgttctgctgtggctgttctgtgggttctataaggctagggctataccccacctgctgcccaagggtaaggtttaccctgaaggaagtgaacgttccctaggaagacaatgaaggctggaatgtgggtcttcattgcaactcagagtacccctgacccccacagcatggtggtgagcctgcccttcctctagggagcaggatgcccaggagtggggcatgaggcacccacaagtgaggacaggtctaagcctggagatgcctacagtggctaccttttgaagaagtgttaagttactctctgtgtttcctttattacccttgatccatcaaaaaaagttgtattcagacatacagcctgatctctttgtgctggaaggaatctggggaaggacctcttccaggctaggattaacagggagaatagcaatgagagggaggggtcagcatttcttcagctgcaggaggcaattagtagacacttaaagaggatctgagcacagctcagctaatttaaaaaatcagcataatttgagttttaaccaaaatatgactttattttgtatttgcaaggcaccaaggtctgctatacacaattaacctcccctgtcctcccctccctcaaggcttctgtctgacagactcagcgggaggaggaaaggaagagtccagctcctctgctgctgatgaccctaatagtcctcctaccccactgggctgcaatgaccacatctgcacctatagtccctcatccaatttgggacttattgcagtgcagaccttaatcctggtctctccctgacctcctggccactcacacacccagtatatctccatgctgtcccatagacacttcaaacccagctcctcaaaaacaagccccacctcttccttctcctgcattctctccctttgctagagcacaagcacccactcggtcctccgtgcccctcagctgcctcatctaattctcaccaagacccacttctgggcctctgccttcccttccacttagtacctcaggcccagtcctcatcatttctcccttggaccacagcagcagcctcctgacaattccccaacactcaaagtgcagtcctggcatgccgaacttggagacagcgagcttaggtgcacacccaggtccccagagcactcagcagctttcttcacacattttctcttcccttctctcttgaccagatacagaagagccagtgggaaattgagaagcccttaacaggatggtggagccacaacatggaaggaacctgggctcctgaatgactgtatggagcaaaatccccccacatactaacccatattgaactgtggtggtttgttacagaattaaccagccatgattaatagtgagcaactcaagaacaaaaagaacaaacctataatagaaaagcaatgcttttccattcacaaacctttcattacaaaatgccggtcgtgtcctacagccagagtagtgagtatacctcgctggaggctgcaagggccagccagtccccatacacaatcagagctctctgcaaaagacgtaataccaccagccctgtactgtactctctcaattgccctctagtttccccaccccaatattgcagtgtctatgatcactgaaggaaaatgaaatatgattctaggtgtcacctttcaaagggtgttagtgactgtcagctaaagtgatttaagccccggaaaaacctctgtgtccttttaacatccaaaactaatcctcttcacaccagacatcgatgttaaataaacagagatttccattaacctacacctctgtacatctatttttaaaaagcggtgtcactctcctttaaatgaacatactaattagtgtattaataaatagctgaatggaatcaatgagacatgtaatcaaggtctgaccaggagtcagggccaggttgaagggggtggggggaaggagaggagggaaaagaatcttattagcaggtttgctgaggagggacatgtaaaatcaatgctgcacatgcagccaagatgcagccgaagttgacagtagatggaaagctaagtgcttgctccgcctccttcctttgacaggaaagctcccggtgagagttaatgtgatgagcaaggaagacattaattggggcaggaaaagccattcagagatggtgtccaggatcacagctggcagagttacccagaacctcagtgctaaagccctgactcctagaccttgttttaaaacactaagaaagaacacacttacgagagttgatttagttctcagcaaacacttggtcaaaaagaagtcacagggggagttatttgtttggggctctttgttactcttaccccccttcaaaaattctggttcacaagcagtagctggaagtacctttgccccaagatgctaggcactgggaaatgaagggcctggattctctacaggcagccctgggggtgggaatggggcagcccgcttcttcatcagctcccaatttcctgtagcacaccccatagctagaaggctctggaaggtgagaataaaaagtccttctgcaagtgtgaggtttccagctgaagtggtatctgattacccgagccgctgctcactggatctcaaattagcactgatactccattttcttcatctggagacacaccccctttgggccacaaaacactggacagaagaaaagtggactttcatttccctaaagattaatatcaggagaaatgcctttctgtataaaatcaattaggtgcctgagaccctcaccccaaagccagctcagtgatgctagttgaagtagaagttgtgttaggataaaagaaactcaaaaaaaaaaatttgccttggggccagtactgcccattacaagccctcttaggggtgattctgccaggaggcaggggattggcttgttagcagttagaatgcttggctcaggattctggggtgctatgggctcccatgccatgaaactgaagttcttcctaattctggttgctggaaaagccagtatctctgggtggacctcacaggcagaaaacctgctgctctgaatgcctagctctggcacggcatccacacatggatgatctagaagccttgcagatgcgtcctgagatatgtttctgccagccccaggcatggcctgcaacctgctcaccctgaggtcagcatttcctggaatgacagggaggacacacataaaggaagtgtggggacatggcaggaggcagctctcagcagcccttaggctattttccacattactgcgaatggtattttgcccccaggaggttcataacagtcagaaggatctccaggttccccagacccatcagaaaagccaaggggtgatggtcatcagcccagggggagagcttcctgacagggtacatgaaaattaagtgcaaaagaggggccagagacagctgtcccccagctcaatctgaagcacaggcacctagagaatggccacacataggaccttcccatctggtttgagaggtcctagcaaagcacccctgcaccagtccatatcttactccctccattgacgtgctaaaagtctgccactggaacatggtttctttgggtcaagcatcatgctttctctttcaacaacctacaccttagtgtacctcctccatcacctctgtttttctgtggcccaaggataaacagaagagagtggagagggtgcaaacagcagggtccccactgatctacatggctatttgctgagaattagggagtgctgtcctctctggttgaccagaacttggtaaacagaaggcatcttgggggaagaaaagggcaactcttcctgagcaaagagatacaccaagccttggccaataaaacatgagcagaatttcagcccttatttgctcccagctcacaggtatacacactacagtgtatatcaccaaaagccctgtctaaagaaagaaagagagaaatagagaggagatacccaagtacttggggcaaaattcaactatttctcaattttgcccaaggatacccatttggagatagatatagatatagatacatgactattttcaaaccaaaaatatcaggacacacactcaagcaatggcacagaatatctgaaacacaggctgttctagtgaacacagggcctgtggtcactgtagaagggctgaagagtagaggatggcagtgacaaggaccctggggggacagtgtgacaatgaggtgccccttttcctttaggggacagagaagcaatggcaaatctccccatggtgtgctatgtggtggaaagaccacctccacaagaccagagccggactctctgctcacagatgtcccatcaccttcaaaatacactgacacactccgtttccagagtctccaagcttttgttccctctccacaggggcaaatcacctttctccacagtcaaccagtggttctttcctctctcagcccgagtgttgctgggaataatgcaatgtttccagcttaatcgtttgtcatcatgcagagatttcactgatttcaaagctaaggtgcctggaagaatcgagcacgctctgaaccagggtgcctcagggcagagggttctcactggctggctggctttacacaggagaatcccagaggcccttactcaccagtttaaggctatctttccaggaaaccagggcctggggctgaagacagctgagatgggcagtgttcataaatatcacctattggaggcaagtgaggacatccaagtatgcaaacaccatgtacactgaacacacctctctggtctctgatggaccacttcagctttctgacttcgttgcaggcaaacattagcagatgccccatcctgcaatgcttggcataattatcaggtaggctccaggcaataattactcactaatggttagccactgctttgagccaagagtctcctatctgctctccctacaccaaattcagagtcttgggtggtaaacctgaaggaaaaaaaaaaacaaaaaaaaaacagtaaccatcaccatggcctggcaaaaaaaccacattatctaagatatcactccaggtcctataaaaataacgtatgtttacatgtggatggctgatctgagcacagattgaatatataaacgtggctgttaattctagactctgagaaaattctgagtcttccaaaaataaaggaatccctacaaatatttttaaatctttttttaagaggtcatactctgacagagagccagaattaatgcaatgggaccagccacctgctcttcttcccttcccatttgcttatagaacctcaaggcagtagacttgttgaagcccagtgttagaaacagatgtgactatttataaaccaagaaaactgaagtgttttaatccaacacagggtggcaagaagcagaactgacaagctttaggaatctgaagaacaggcaacaattttcaataatattacctctccacttattgagcatttaatatgtgtcaagcagtgtgcaagctatttcccacgtattatgtcacttaattgttagagcagtcccttattttactcttttaatgataaggacactgaacctcagagaagacaggtaacatgctgacgccacacagctgagtagccaaggcttgatgatgtctgtaaattactttaaaatgcatcagcttaaacagagtggtataatgtaagttagttccaatccttacccaaggatggttagtcgacatctgaagtattgtaactaaccagggctggtgacttagcctttgaaagccttgcatcagagtctacactgtttgttaaaaaacataagagatgttggaaacaatttatcagcaggaaattaagcagtgtcgaatatgcataattggttagaaatgccatccaggcatctctgccctttgggcacaagaatctggcaagcctagagccctctgtggctccattcttggcctaggggtcctactagggtctatttcatctctcaaaggatgctgtcctctaatcccactagaaggtgagctgaaacctgcaaccacattgccacatctgcctcaaataaatcttccttgaaataaacttgtaagagttactaagtcagtgcctcccaaactttctcacttcctgacacttgcagaaagtgataatatttttaccacaccctggggccagagagggagcttctgctgctgcatgcccctcgtgccctctggctgtccacctgcagggttgaggtgacccgctatatcagcaaaccttgatacccttccccggcacactagttgaggcagacagcaggatccacactgagcttcaaaaacaggctgtatggctatttatgtgcctggttactaacaaatattggtaggtagggtagaattgagtctgcaacttgcttttgtaggaaggttgtggaggagaaggcccatagctctcacctgcctataatcactggaaatgagtccccacataatctgcccattgggcatggccaagttggcattaagttgggttgcagtgccagacctgtctgcctccaaagtctatcctgggtcctgggtgctcccctgcttctggagcctaaagaaagtgaatcaatggttatttgtcaaacccaaaagggaagctcttcagaaaatgccatgtcaaagggttccgtccttggcgctgtgctgtttcatacttttatccgtaagttgaatgaagactgagagtcacatttatcaaatttgcaacggacagattccaggacttgtgaaggtcaaatgagataatatgagagaagtcatttaatagtagagtaagactcaacccattgatgaggatgaaacaaagtttaagactatcttagcagcctgaaacagggtcaaaactggaaccccaaaaagaaattgaatgtgacaaacataaattcaaattttaggcttcaaaaaatattaatgaataaagtaccaggtggcagaagtttgtgtaagacacacatataatgagggtgggagaagcttagagacccactggttacgaaccagcagtgggatgggggctgcccagaaaccctgccacatgaatgaattttgacattgggctttgctatccacacctcctgcagatggtgacctgcacctgtgatcagtcacaaaattagatgtggagtcagacctacctgcaccatgagaagcaatgagctctccatcaatgtgcaaagcagttaaaagagaaggaaccctctatcacgtgctactgaagttgagttgttcccatcccctgcaaaggctcccaacttgccagcacagccaggatgtttggctcagagaaaagaggtggcaggagagtttatcaaaacctacaacttaagattttcttcacagaagatggaggaaatggcggcagggggggacgtaaagataggcaatcaattaccaaggagcccttgaataaaaatctctttatttccttgaattttcctttaatttatcttttttttaaaaaaaaaaaagttttcacctttgcaaaacctttggactttttgaccaaagacaacaggaagtcagccaagtttaatggagttttcattttgaaaaagatgttatctgcagctcctctgtgcctaccaagcaatatggtacgtctgtggtctagagaccaactcattaggtgctctgtttaccatcagctggtgaaaaatgataattgtatggaagaataatcaccaagacatggacatcactgcctgcagacttcgccaggaagctacttcccacttcctgtagatccgcagctgtttcaggatgtgtaatgccctctactgtcctaccattcaaatacttctcttttcaagctcagaaaaccaagtttaaggtagggagagagagagagagagagagacaatcaaacaaccttatgttgggtccagagggaactgcaaatgtgtctaagacaatgcctgctttcaagaagcttgcaattaagtgggaatatgagatgtaaatactgaaaatacaagccaataaatcatatattaccaggaaattcttggcaggctgagttttcagaaagtctctacgtgtactactgtctgcacacaaaaatgcccagacctggcatgtggctaagtctacttgtaaaatttgttacctggttaaatgctgttccatgcctaccaatatttttaagttttcaaatataagttttaggtgaaaatgccattctttcaaaacagtatgtgctggagaaatgacattttttcaaagcaaattttctatatttggtcatgtgatattctgtaagcttttttataaaggctctttagaacattccaaaaatgagcatcatcaaattaaaacaagagaacttctattacattgccacaaatcctagatgtaaataaaataccatttcactcaataatgattgccagaaatataaatacagtttagaaaaattatttaattagtttatttttaagtatttgccaagaaggcttcggtcttgctagtattaagtcctgggagaaggaacaaaggagagtgaaatgagctacagcaacttcatgcaattgggcctgggtttagcaaagctcactctctctcctccacacccccaacaatcggcctggggccaatgacagccaagattctttgtccaatttgacatcatgcacatggccagtaccccgcctctttcgcctttgcctgctttcttagatcttctcatccgagcataaagccagcagcccctttgaggacatctgataccccaggtcagtaagtagtctctaaaatgaaacataagaaggtggtacaagaaaaggggaaagtgtagggattccctacctttgttgcaggctctgagacagccttggagagggctcagctcaccaatcccaaaggccttacccgcagtggacaggggcatggtgaggggatgtaacaaggacacccccggtggcgtcaactgctctattccagtcctgaccacagatcactgtggttaggttactttccttcttagagccccaggccttgacctctgcctcctagtaaggaaacaatgtgccaccagataaacttggagaaactgctgaattccctgagaccaaaagtgcagctccgtaaatgtattacatgccgagaacagttgataaaatgtacaagggctgggaaaagaggcatgaggaggaatgaacagaaatcctgccacctctatggggtttttgaaaggttagagctcaaaaacacttaccctgccccctgtttctccccacaagacagcccaaagcacaagacaattttattagcagctctgagatacccagaagcaatccagagaagagggtagatccatcgtttcacttgatgttgtactgcaattttgcagctaaagacattctttgggcctgaactcccggggtccctcagtcttgaataactggtataaatgatgcccgggctagtcagaggccctgcactgtctggggcctctccccatccccaagtctcactaccttccgcagcagcacagagggttgaaagtgtctgggaagacttgaaggagttgagcatatctctctctctagcactctgctcaaaccaatggcctgttctctgcagttcctatgacatgaacactgtaatggaacacaggagcccatgtctacatctcctacaacaaatgaagaccactaaattataaagctctcctgcagaatgcaaagcatctgtcactaatatgctaacccattcattttttccccatgtattggaaagagagagaacagatactgcttgggttttactaagccctagactgtgtctgctattttaaaaataccttcatcatagatgtgtgaagcaaagatatgagaaacagggggtagaacctggagaggggctgccccacctaaaggcattcccatgataaaaatttttccttggcacttgacacgcctggaccaagccaaccctatctagtcgccaggtcctacctgcaggctttgattgtgcagactttgtcctacctcccagaatgtgggattagaccaacaggacattattcctaatgggcaaggtcaatattttaatcaccaatctcttagctcatggtggagttcatttccctagaccacactgttttgagcatgcgctcattgaagttggaggcacgcaccgaggaagggaacaagcagaacagaggcccaggtgcgctctgttccaagcttgctctatagcactctgggtgctactcaacctcccgggattgttctttttccactggaaagtagtgggactctcctaagggaaggtgaatacctgggatgctttcagaacaatttcaagtacattgtccaagacagtatgtttacgccgaaacatgaaccacttgaaaaatgcaagaatctctaggtggatcttcttgcttctttgtcaagtttctgccagatcccaaaaggaactcctaagtctgcaactgggtccagaagtaaacagcactaggtaagcatgaagttgaagctgccggggacacaagagccttgtatccgccggcctcctggtcacttccgcctgcaaatccacatatgccccaattcaccttgttcagaaaagaatgcagcactcctgccccaccactcccccgacagcctgcctcagtccagatttctccagctccactaatggcatcatctcccaccagctgcccaggcaagacacctgcaggacaaccccactgcccgttccttgctgcccaccaccttcaccgccatatccaccatcatctgtcagcgctaattcctacgatgcacttctcagatcagcccctttctctcctttgccaccccctttgatcagccccggctcaggatgctttgatttactgcaatagcctgcttccagttgttctccacgtggcccccgctgaaccttgctacagtacaaatctggtcttgttgattctcttccttggagatcgccaaggcctgactgctgcctgatggataaatcccttagctggatactgacactggtcctggtgcagcctctgccgtgttgccccttgccccacttcccacctctgccttgaactcctgcagaccccaagggctgtgctctcacctctctgtgctgcttcctccacgtgggacctctgcttatgagttcacaaagccaatctgagggatccttcaaaacatcctctaaaactcaactggatgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgtcttcctattcccagagcaccctcttcatgccccagtctcactctctgacacattgcatgtaaattctctattcccacgtatgttgtggccacactaagctgtgaactccctgctgacagaagtaggtctttcatctccacacaaattctcacatagtgcctagcacacagtaggcactcaataaatattgcttgaattgactgattgcttgatcaattgattaaatatttcataacatcatatcaacctctcttactaaaatatgcaaatatatgtgcatggcgcttggtgaaatgtaggcatcgaggaatcttacgaatccttttctttttctgcagtccccaattgaacctactactaccaggatggagatccccccggggacccaggcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggtgtgatgtgaggcctaagctcagttttcattctctttgtcttgattttctttcaccttgtgtgtaaatagactctttcttctgatgctcacccaaccctttaatatgcaaggccacattcatcctcacctcctgggctgcagacgcgaaacagcaagggcttattcctggctttaaagaggagaaactgaggcctagcccagagaggggacttgctgaaagacattcagtatacctaggattagaagctcggtctctgtattccctggccagtatataatacctcttcaattgctctgaaaatgaaaacctcaggattattttgcaggaggaaacaaaaataggcctggaaaaaccacagccacatttctgacaagctccattcagagggcaccataacttacataaatgatttcctattacaccgcaattgtcactgcaacacgacagtcttgcagcttccttgaagtgttctctttgttgttttttgtaaagatcctccagaaagaagaatcaaatatggtccaagcagggaaacaaagcacatgacatccgcagacccagattccccttccgcatgattctttctgaggaccaaagagaatgccatgaatagtcccccgtgggcctgagccctctcccacctgtcttcctcccaaagctctgctatatccttgcaaataggattcctttttttgaaaaaagaaaaaaaaatgaaagccaatggtttatgaagaagaaatgaagtggcaatttcccagcatggctgggaatcaatacaagctgttgtcagggttttcctttcaaagggtggctgccacacttctccaaagtcaagagcgacagagctccagtgcttgacttacaactgcttcatcatagcaagatatttttaatttaaaactcactgcagttgggttcgaactcagctgggacttgatttactgctaattcatttctctgattcctataattctaagctcagtcaccaaacagtttaatgctgatagaatcaccagtgcaatgctttatgaatgggcgtcaggggaattttgttagtgtgtgttagcaactgttattcactctggaaaggagcaccgtgcctgcaccaagcatgggggggctctataattgggcacgtgaattaccagtatccccaagtgattcaaacccaaataccactgagagggtacccccttttaccccaacccacatacacactcccacactctccctctctctctcacacacacacacatacaatcattacctatgtgagatgaatgccaggcagtgaaaacgctttccatgggaaatgcctaacttcactctccaggtcactacccagtggtggaaaccatggatttacagtctaattagaaatcctcagccttttcttggatggcaaagttttctcttcccaagagaaaatttgtttcaaccgtccaaagtttagggagatgtgtcttaataactcaagcttcctttgttaatttgataaagaacatttatctttgtcagttatattgaagcctcttattcaagcagttggagaaaaaaaaattgagaaggtgaatgtcattactcacatattttgcaaacatccatcttgatctgttatgtgcaaccaaaaagtgccacttgtgggaaacatgtccacaaacctgtcagagtggcattcacactttttgaatttgtttctttatgaaatatacacctgaaggcagatcacaaggccactgtcgctaaagttttgtgagaattcgcagtcatttctgggagtctcaaaagcaaatgacaaggacaagaggcaggcggtgcctctgaaagttggggtcacaagtccctacaagtccctattttatcagtacagtgaattcattcttctggttttttcacctctgaagtaaaccaaaacttgaaagcttccagttgaaggtcaccatctcccaaaatgcctttctatggaaccgtctttccaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccccccgccgcaatctatcagtgccaaaacccatagtgagttttacacagagagaaataatttaattccatgtgcatccatgtgcaagaccactgcacctacctgtccccaaccactatgacccaggatgctggagggtaactgaggggctcagcctgtacccatctggattcatctgaatcctctggaatagccagtcagtctgacttgatgtgatccctactctgtccctgctgcagagtaagaacccaccatattagtctggttcaccctagccttgatatttttaaggtcattcttctccaccttatcctactccatttattccttctatttttacagcaaatatttatcaattgcttccagtaagataggctctgggttgggcaatgagtatacaagaagtaagaaatgatccctctcaacctaaaacataaagaaatacatgattcccactgttttcattgccactgccagtagcagcttcttcaccattattaaaaagcatgaattgagttactgatgaaacaaaaaactgcttgaagcaggggctgaccctaccttctgggagctgcaactctcaggcagaaaccctaatgcaggcccacgtctctaggtcagtgatttgctcacatcaatcagtggttaggggcaagtgcatttagggaggaagatagggtcagtatctaatggacaagagagcagggaaagaggtcacaagcacagcatgaccattagtcctctccccagcctgaccctaaagggccttcaaagcacaagagtagtaaaaaacgttgatgaggggcaggactagctagaagcaatgacttacaggaaatattttatgcagaaatgtcccctgttgcattatatttcagtgctttcattatttcttaaaactgggagggtggcagaggtcattacgacctccccctgcttcccagcagccgtgccatccctgaaatagtcacacaccactatgcggaaggctggctgttgcttagtaagccccaaaacattagaaaagtcttcagaaatcggattggcacccattcttaatgtggtttctatttggggtttaaatgggataatagtgtagtcgactagtgttgacacagactcgtgaattctggggctcctaattggagtaccctgccctgtcttgccatctgactctgttctgaagaactttatgttctttgcatggaaaccattatcccagactcccaatttatgtatctgcccaaatctgctgagtcccacctgacatcacgccaccccaccccaattctgaactgcagccattttcctgttgaatccttgttatcattgccactgccaggagcagcttcttcaccattattaaaaagcaggaattgagctcttgattaaacaagacactgctggaagcagaggctgaccctaccctctaggagccgcaactctcaggcagatgccctaccgcagacccacgtctctaagtcagtgagttgctcacatcaatcagtggttaggggcaagcatatgtatttagggaggaaaacagagtcagtatctaatggacaagaggcccccagtgacgctttctgctgttcctctggccctaaagttcttgctgtcttttcttccttcagagtcaaaggctgggctcctgcaggggtaaccctgacataccttctgcagggagagccaaggaagccccagccccagggcctgacccacagaggctctagcttgacctggtattcccaaccccaaagtgaggggagttgactcatgcctcgtggggtgacttgtgaccagtgagctacagcagaccagaaggacctgtggattaactgctggctgtgcctcaccaccacagactattctgagacatactgttcacaccaggcttccctggatacctcctgagtgactgagccaccagctgcttttcactgggaaggcagggccagcttggtaatacactatttgttctccttccttccctacctctcctcctttgcttcatttttgcttccccgggatctcacccctcaataaagtcataacacatagcttcttccttgagctctactttctagggaacccaggctgtgactggagtgaaggacagacaggcaggggcacaaggcccaggccctccatagttttgacaagaatagtcctgcttgcatctgttctgtgcactggaattccatataaaatttcactggagcaaagattttcactgtatacatgttaaaatatgtttaatcaccgatctagactaacctcctcattttataaacaataaactgaaacataaaatgatttttcccaaaatgctttagttagagttatctacatctatttgtatccaaagcctagctttttccacaacagtggtttttaagcaaggggacatattggaatcatctaggaacctaagaaaatggacacgtgcctaagtagctgtctctttccttggaaagacaagggacaggataggctctgaagaaggctgagcaaatgctgaggccagaggtggactctgtacctatctggcacaattctgcttgagaatctattgctcacacaatcaccagaatccagtacttggtttacgtaatgcaaaggttcagtggaaattttcactgtagaagccacccctttattcacatttgacagtagtcatagcaaagtgcttgtcttagtccagtgtttctcagtggattccaggtccactacacagtttatatacttttgtgatttcacaatccatgtgagtgtattaaaggctctgagaagtcctgcagcaaggagtatctttagctttgctttacacccagggttttgcaaacttacttgactgcggaaacttttttgcatgtaatgcctattgactcccccgcagaatatactttgggaaactctagtctattttaagtattactttcaggaaagcaggcctgagatggagaggaagaaaacgaactccaactgactctagcaacattagctgacattccaggcaggctgcttcagttgcacatcctgacgtctgctactgtctcctctctcactctctaaccccgccacaagaacggaagcaatccaccagctatgccttgcttacttctttcctcttggcctctgggtcaaagccaaggaatgattggttcaccttctagtttgagcctccacactaccaaaagggaaatccagctgtgctcattcgagaagagttcagtgagtatgtcagataaggaactgatcttgagcgaagaccaggaaagcctttcaactgccatggttttcctgtcctaaatttccagcgacctcttcctccactgcttctctcctcatacttcataatgaaaatactctaccctgtaagacctcgggaattgattcagcgaggctgtgttcagcgcattgactgcggagactatcctcttagctagtgatctgttttgtgttggagtgacaaaacatcccaaaatccaatttgctgttgcgaatcctggttcatggaggaaacaccatagagggggaggggaagatccaagcttagaaggaaaagagaggatgcctgagatctctccaacacctgttggtttcagtttgcacaggactttacctcccaatgttttatccactcattcctactgctgcctcagaggggaggtgatgaaattccacgtgcaccccttctagccacctcaagttggacagaacttttactcacctcacagtgtagagaagtcaaagaaataatgcatggaataaaagtttgtcttttggagaaaaagaaaaaaaaaaaggcaagtaaccaaagtgcctcacttgtggctttttcctaaaatgttcagaccagagggactgaggttagccctggctttggagtgggacagaacccaaccaggcccatgggctccttcagggattcacacccacacctttttgcatcaggatgtaattcctaatgccttgccttagcctgcaccatctcaggtctgaattattttcttcatgcaaatggggacctatcaaaattcctctaagtgctacaggatggctatcccctgacatggtccgttggcaccaacatgcgatgagtctctgctgcaaccaccataggatccaggcacccagcaccgcatgatgtccctaggcactgatttcttccctgcttctggatcctgaagtcagaaactctaggagtaataaatgaatgaatgaacaagtgtcaagtacctaccgtgagtggtgtaatggtaagaatctttgcccaagagtgaaaaaaccatccatcccttagcaacctggcgccttggacatctcacctaaactctcttctcagccttagcttctatgctatcaaaatgggaataaacaatacctaccttgcacagctattttaaagatgaaatgaggaagtgttgtttccacaatactagcaatttgaagcagtcaccagggagaattagactcctatcagaattggagcctcatagagtctaaagtaaagatgggaacttcactcattcattcatttactcattttttcctgggagaaaatgggaattgccaaatgaggtgacagtcaccctcaggacctgagcattctgctagaatgatccatgcaattttataacctaccaacagccaaggagaagactcatcccccttgatgaatggggaaatcgaggctcagtgaataaatacatttgcctggcatcacagaggtagtgcaagagactagggaccagatattctaaacttcctcccaagcactcacccataaacctcccaagggggcagcagtacagtgagcacatatattctaaggaggaaaccagcacagtgatgaggagaaaggtcagattgctcacaagtgagacttggctccatcactaagtggctgtgtgatctgggacaaagtctttaacctcctgcatctcagtttcctcctggaggaaatagggaccgtaatagcctatctgggttgttatgaggcaaactacttaaatggtatctaaaccaaatgagtgctcaataaatattggccaccatcatcattaattatcatcttccattccattgtttttacaagaactgaagccagtactaacatcctcacagcctcttcctttgggaggctgatgccacaggaccggacaagtgtgtgggggcatacacagactcacatagggactcaggaaactcttcttccaggctgctccatgccatgcagggaagcagcctcctccttcaggaacaaggcctgggctcttgttccaggggaatcaggacccctgcctgcctttcgttttaaaatccatctcttaccactcagcagcagagcccccttcagtctccctgtgggctccaccttcctaccgcaacttgaatggtacagcctgggcagtgaggacaacatgaaagaagaaagaaaaagtctgtgcagctagaggggatcaggtgggagtctggggagggagcagtggagcttgcagcttttaaagagacagtgtcctgtccacagggccctgtgtggaccaagcatagctcgatagagcctataggccaattaccctaatcatgtgcatctcccaaacagccatttattagtgagacgtctttttaaaatgccgcttttaaatataaataacacttaatcatccagctgtcgttaaattcatgttatattgatttcttggagtgccgcaaatttgagggcgaatgggctggcggatgtgcgcacaaagccaagaggtagattagcaagtggtgggggcagagaagtgggggttggaggaaaaggaagggaggtgtcaagggagggaaatgaacctactcaatagcccagggtctgagccagtttcacattgggtagcactggacacaaataagaagagaggagacgctggcacatctgttgcatagtctaatgagagccaagatcatggtcgtgttttctgtattgctgccgcccccttgtaacccaccacagagccgctccaacaggtctctgatgtgcattgtctgcgtatgccttctctaggtgaggatggggagaagcagctaagaaatgccccctagctggctaggaggagagagatccacagcgatttctctgcatcaaagcctgatgataactatgaatcaagagtggttaatgacccagcccctttagctctctcccacttcgggactgctgccatcctagaaagcccccacttcattcccagcagccctcattgtgatgaaaaggatcccgaggccaagtgtatgtaggcagactctgccgtgcagatttccctgtctgcagggagtagcagcagcaggcgacaggaaggcacagagaaggagaaaggaaacaagttgactgccttggagtcctccagaaatgtctgcagtgtcccagtgggcatccaggaggaagtcctgggaggacagatgagagcccggggaggcgtgattgggtaagaaggagcagcttgtaggtgacccatgcctagtgctcacaggagagctgccttaagcaccgtctaccaggcagcgagggtctgctgaaaagaagcattcatggctggggtttttctagtgtgactcccttcccagtgagaaagacctcagagaacttaaaaggaagggcacagaagagtggcagagagggtgaatgacagcgtggcatgctccagggctgggcaagagagccaggaaaacgtaatgtatactccgctttacagagatgttaattaatgcctgccttgtcctagaaaccaaattggtacctaatgctaagtgcagaaagtgcagagattttctgaacccagatgtttagcttataaccagcataatgatactagctttgcattaaaatgatggatcctgaggctgcgaatacatgagaaaggaaagagggtagggaggaaagcagagaaaggagtggaggtctacagggaagacacagacatttcaggaagatcctgtaccctatccctttgcctcttccaggtcccatgagggactgtttacctgggaggcacccactgttgctggagctcattatttcttttgcaaaccatgtgctgctgtacgcgtaggtgggatctgcctgtccacgccctcaaggggcatgtggggagaaatgttccatttcttccacagcccggaagacagaggtggaccccattgtcacacatggcgggggcggggagctgaccacatttagccagactctgagaacgcatgtgtgtatatatattgggtgtgtgtgtgcacacgcccaccattcttaaaaagcaaataaggtttcttccccctactggggtctctccattgtgagagatttgctttattccatctatgcttttcaatcaatcaaagggcagctcacacagcacacagcgggaatacaatctccctcccggggtgtctgcgcttctccccagcctagccagagacctttgcaggagctgaaaaaagtttggaaatagcggagtcagggtgctgaaaaagccctttcattcagcccctatcttcaggatttacaaaaacaacccaaattctgagcctagcactgaggcctccttgttcaaaagaatgtttgctcctcttccatcatgttctgtaaggctcctaacatattttttccactggtgggtctgtgggatactctgaacacatgatcttggacagagggtacaagcttattcagttttgtgggaaaatgatatgatcatgttgcctagaaagctacctcaaagtgacagcaccagaaacacaggagcttgtacatatatattcaattccgaatttgatttggatctcatgttcttctccctatgacaactgagaccctaaattagttgctcttagaccccaagaagggaactatggaaaagcctcttagaaccccagccacttcctacctcctccagaaaaagttaaaatgagcagcctgtgaaattccagccagagagaacaagaatgaaaatgctttcgggaaataggaccttaaagcacgggcgtctggggagtgattctacaatcggagcaggcttgggctctgggggacgctggcagacccacgaatgccttgccttctccggtgggcagtgccgccacggtcgtgagggaggggagcctcctcttttggaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcggcggctctcgggggctgcggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcatacatgggtgaccggagcgcacggcgcgcgctcagagggaggcgctcagccgcctcggaatttgcagctctgggcgctggccgtcggagggaccctcaggtgctcagagctgacacaagcgcacactgactctgaggcatacacccattgctagtcagaacccctcccaacaccccaccaagtcacccccacatggcacccaaggaggccgaggacactgagggcacaaggcccgcacgagagaacatgagtggccagtgccccagagctggcttggtaacctgacttttccattcatgtttatactgagcggctctcctggctcctctcttctctgaaaccctagatcctagactacatccagaacagaccatgccaacatcagggtggtttctgaagcccaaagaaagaaatcaccatgtagctctggtttaggcagtgaagatggggagtgggtggcactacctcccaaacctctgcctagatccccctaggaatgggcccacccaccaagagaaaccgaagggattcccacacctgttaactcaactctgtgcatgccaccctcatcctcatacccgctcccaccatagtctgagggaagtggcaccttcagcagagtccagtaagcattccctgggataggcaaccagcaaggacgaccctctaaaggagcccatggctcttggcctcctctctcctgtcccttctttagttttcactgtcctcacacccagaaactcccgcccattactgtccctcccatcgaaacatctcagagcctccttattaggtggacatgactgataatggcttaaatgcctatacctccctataggggttatattctcacagaaatcgaagttgtgtgaattggggagcctttgaaaggagctgtgagatgacagcttaaacaagccccaaggtgagcggcacatataggtcaggcttggcccacccagagaggaccctgctgaaactttgctctcaccaatgagaagatgaaccaagccagaatgaggaggaaaccacatgtttgattctttggttaaaggatattccaggagacagcgtggagcccttttagtctctggttctctgctgagtcttgcatggcccagaaagcagcaaggagttatcttattaagcttacatgaatacattgatctgactccactcttcccagaaaccctgaatcccagactctagataaagcacacaatatcaggttagtttcagaagtccagagacacacataacaaaatcactcaatgctactgcctcttgaacatccttccagggtggaggaagcccagggccaaatgcctctctctgcaagactgggattagcacaaggccagccgggcactgaggatacaaaatccaaggaggccctgtcaccccaaggtccatgtaaggtttgcatcacctgatcctgacactgcttctaggtgtcccttttaaaattgctgcatgggtccatcacggcccatttccagaagtgacagcccggatagccccatgaaagtccctaatgggttacttaaggaatatcgttcaattaaaggcgcgggggagactcctttcaaacttctgttggccactcagctttcagggtatgtcataaaatgctgaaaggaaggggggaaggtgagaaaacaactctgtctcaattctcagtcattctagcatgtatttttaatacaatctgattgtctttttcctcctcatatcggttgtatttgtgtgtgtgtgcgtgtgtgtgtgtgtgtgcgtgtgtgtgtgaatatggcttgagttccaggcccatttcctgatggatggacgggaagtcaaagacctttttttttttttttttccagaggtggcaaataaaatgtgtttattattctttatctcctgcctagtgtgtggtgtcatttattttcattcaaagaaatgaatgccatgtggtgcctgaagagtaataacagagccaaatgacagggaagacacacagcaaaaagctggaccagccacgggcaggtgaggggcccagcgagctctcccgttgttaatggggccaggggccatatctcaaattgcctttccccggttgccttccactgaataacacggtaaaaggcataccaaagggggcagttatcatattatcggaaggaggagtagaaagggtcaaattagctgcagtagaggatttttttttttcagtgatgacccattggattgactcccttaagttaggagaatggaatggggtgggatgagtagggcctctacattggaagttagaaaacacatgtcctactcctggctctgtcattggccagctttacaatttggagcgggtcacgtcctctcaatgatacctcatctctcacctgacacattcgccccttagagttgcaatgacattcaaaggacataccatcttattaatgtgctttgaaactctaaggtaggtacaaaacacatgtagggaattagagtcgctttccagatgaatgtatctttttatttttttcaaatagaatgatacaatgagggtaggccttctgctatcttgtccccaccccaagaataaatacacaggcaaaagcagcatcttaccacagttcaaaatgtgtttctgcattaggtacaagatcttctggctctcacacctcctctaccccctctcccttggtgagggctaagggagacacaagtaggaccatctaggtgtcccctactgacaatggctctgtgagtcactccctctacctcttgcctggtcgtgaaactggttatgtcattgtctggacccatggccacaagagggagaagctaaatggcacattgcttcagagagtcctgttttctaaagaagctatgtctgtgggacttgggttggggtttattgctgggtttagacagaaaaagtattggttcatctcccacagctgaataaaaggaccagtttaataggaaagaggagaagaaactcttaagtttcccctcacttagctaccaccattttattagcctaggaacagtgctgctatttaagttgataaaagccagatttgctcgttaaataaatcaccagagcctggtggtgctagagagacattttctttcccccaagagctgcccccatggctgggtcttgtaccttgcactggatagaaaaaccacaggcaggcagtcagcagcttaaaaacctaaattgtggcgccacctgcaggacagcaggaatatcatcagtatcccacagctcagcagaggaggcaagaggagccttccgcagtgacacaggtgaggccagggtgccctctggcccctgctttctgcatgtgtcaccacatgtccacagcacactccagcagcctttaatctgcatcctccttgaatgctgccatttcgagggatgggcagcagctctcaagattctcagtccattcaaactaacttattcttccatctgtctcctaagggactaagtggacctctaagccaagggttctgtcttcaagactggaccatggaacagtaaaacagaaaggagaagtgactgcctttcaaggaagatgaggggaggaacatccttgtgtcaccacagggcctactagtaagttgaacttggtggctgggtattctcagtagacccaactgttccaggcttccctagcatgtgggtgcaaatcagcacagagatattaacatccgaatttcaactcccagccttttctgctcagataaaactttggccaccactgaaaaacccctccctgtctcctcccattatgtcagagaccgccactggtgggtgtgcttaggaacaagtctgaccatttcattcaccacaagtaccctcttggaaatccactgcccatgagccatttgatggaaggacatctctgcattgccagctctgtggttgccctctgcaagggcacctccacccggctgcactgctggacatggcaagctctgctgccgtgccatggctttccaagccacaccggggggttggtgtttaggtggggaggacacccctctcctcctacacacacacacacacactgtggatcttgatcctctgggcaccaaaataactcccatgcctcccatggtccaagtcttactccccttcctccccagaccctttcatccactgccccctctccagaatgcttccttctctttcaactaacaaaaacaacaaacaaacaaacaaacaaaacttgtctttttaaccgcagaaaccagaagttagaggatattgtgaggtaaggggagatggagggagggagggggtgtgacttaactccattggccagaaagaagagagtcccagatctggccagagccatgtcttgctacaacaagaaaggagaaatacctcagtgtaacccttcttggggttaagtcctgggaggcacaaggtcccgtagtatgcctgcattacaaggactggatacaattcacgtctcccacatggcacctctctcttggcactgcctagtacactggctaagtagtttaaatgagtcacttggcccctctgactggggtgcacataacagaaaaggcctcaagttgttttccttgtgatgaagatggattcgtgctgatgggttgaatgctcttgcctggtaacacatttacaagatggttgccaggtggtctgagtgtaagctgttctaagtgactgtggttgccagcctccaaaatggccccagtgactctcaaccagaggtattcatgccctcatacagtctgctcccatgctgaatcagagctgacttaagtgaccatgaagtgacagtgtccaaggctaggtcaaaaaaagacattttagctcccagcttggtctctttagtcccttggacctgccatgtgttgagaaactgagctacccaccaacaaccagtgccagcttgccagccccatgagtgagccaccctaggagcccatcctccagccccagttaagccttcagatgatttcagccttcagaagtttccaactgaggtcccagacatcatggagcagagataagatatggttttatgccagagatttgttatgcagtagcagataataaacacagtgatttgcagggaagatatcattcctctgaccttgacctcattaacctcttaagcttattatttgagcccacttggctgtagaataagaaggacaaagtggggcatgcttgatgcatgatagtctcatactgggcaggactgggcaccaatagatgtcctgccagtcactcccttcagagctccggggttaaacctcttagtacatctcagtgtgttacacagaaatgagaaaacccaatgaagaggcttgaaagcatccacaaacagaatactgaaatccagcactcacttaagatgggccatcgtcagttcagttccagagtattggccatcagagacattcaagagagaggcagaaagttgtgccgagtcctgttcactttcacgagctgtctggcacctgcctctgccagagagccttttggaggtgaggttgaatggggctccagggtgagtccttgcacccaccaagcaccaggcccagtggtgctgaaagtgttccctacatctgatcctaacccgtgctacaccacagggcaggagggaggcccaaggatgcttcctatagatggcaggtagagtaaaaagagactagaagcgagatgtgattgaaagctgatcgtccactttccctccacaccattctccttgaggacttctcgcatcaccttctctcctgtgccctcagcagcttccagagagctcagtggagcctgcaagctatcagcagggccaaggcatatacaaggattaggacgagagaagaagggaagaaagaggcaaagaagaagaatgaagggacaggagtgcctatgcaaagcagagaaagagccgcagacagttgccttagggattctgaggacagtgcttaggcccaaggtgacctctctccactttagtgtctgcctccaggactctgtggcctggctccattctccttctggccctattttcctggccaggccctatattcttcctctgtttttaaagggctttctcctaacgcacgcctgctgactgtaaccttcacaaatgtgagatgtcccttgtggagtccagagagagcagggaccctcgaagcctgaagtccacagaggtgtgtggtagcacatgagggttggggagggccaatcgtgccatatcttcccaactctgcaaccagcgatgccaggccagctgctggaaatcagccactgtggatgtatttgcactatgggaataggcacatgctacaaattgggacttttgattttgtggagagctggttgttaaacacctgccagcacacttctggcagggtcattgatgggcctggataagacaggtcagcccaggcctgcccagttctcaaatgattctgcatgggaacccatcagatacatgaactgcatcagcccagttcagggtcagagtaggagtttctttctgtccataccccaccttttaattaaaagaaaatattaatatggactctttctattaactgttctttccaagtcctgtaggtaaggagcctttactcgtggtttttgacactaaaatcaaattgttattctttcctgctaggtaaactgagccaagagatgctgacgtgacccatgggtgtgtaggaagcttgaagtgtacatctggtaacacctgtcatttactccctccacctcaaacttaagattagtgcactgggtttggcagaaattctattttcatttcctcaaagcactgcactaaaattaccatacatccataccacagaacatggtgcagatgtaaaacaaaatgaaaacaaaatgaagtaaatctatgtatgctgctctgaaaaacaacagcaaaatgcagaacagtgtattcgtgtatatctttgcatattttgaatatacaaaataggcttgtacatacataggacattttggaaggatacacaaaaaacttaacagcagaaacctgagtgagaaacagagcgatatgtattttcttaatttattgtatattcttttttctttttgacgttttaccacgtgcaagtactacgttctccatttttcaaaaagctagttgaaaatgaacaaaaaaaactgctgctaaaaacatctttgtcacaccgccagtcctctgctcactctctcttctcaaatccagccaaccactcctccaccccatctgtatcatattcgagcttgcctttgttctagtttcctactagatgcaccctgttgctcctcttttgtgggctgccgtgaaggtcacgcagcagcctgtctgcctaggcagacagctcggtggatctggtaaacgtcccagagaatgagacttcatctctcatttcctaaagaccagccagtatcctacttggccagagaacttctgtttggcactagattgattatagggatattccagggatgctccagcacctcctttctatgctaaagcaagcagctttagatcaagtcaaaggaaatatccttctacattggagtcagtaaactcatggaaactaacactcagacatggtacaggccaaaaataggatgatgccaggaaacatttagatagcaacaggtgaaagctccatagtgttattaatgttatcaggaactgtgtagggagagacaaagaaaagccagagacaggcaaatggcattccagttttgcaaaaggggaaaataatgtgagttctgaaaaacacaaacaaatgagcctggcccccaaagtgaccattggatcactaaaagatagatgtggtaattatttagaaaaggatgtgattgatcactaggagtaagtctggaatcactgtcttaatcatttggggctgctgttatgaaatgccactctctgggtggctttaacaacaaatatctatttcttatggttctggaggttggaagtctgagatgagggtgccagcatggtcaggtacttggtgatggctcctttcctgtttatgtcctcagatggctcttccttggttcattcaatcagacagagatctcaagtgactcttcctcttttttataaggactcgatccatcatgggtgggggctctaccctcatgacctcatctaaacctaattacctcccaaaggccccaacttggggggttagtgcttcaacatacgaattgagagtgggatgacacatttagtccatagcaatcacgaagaacaaacttggttaggctggtgttgctctctaactcaacaaggctgtgaggcttttatatcaaggaaacgtaagagagaatatctgaactgcatcaaggcatttaatagactctttaataaaatccttgtagaacaccaggcaatgtaggctggtgaattaattgactcaatggttaaaccccaaagatgttcattaatgcatcaaagacaacatgaaggacggttttcttagggtatatgtcagagctctgttctcagactaatcctattcaacacatttactaatgacttggataaagatagaggagacatggtcatcagatttgtctatgattgcaataaaagaaacatattaaatgtaagtatttgcaatcctgctccatcctaaagaaaaagaaacttttgctgaatgttgggcattttgggtgttgacgggcattttggtgttgtcttgaggtatcattctaaggaataaaaaaggtgagagagcttaacagatctgcatttgaaaatatatggcactcaggccgggcatggtggctcacgcctatgatcccagaactgtgggaggccgaggcaggcagatttcttgagctcaggagttcaagaccagcctgggcaacatgatgaagccccttctgtactaaaaatacaaaacaattagccgggcatcgtggtgggcacctgtagtcccagctactcaagaggctgaggcaggagaatcacttgaacctgggaggcggaggttgcagtgagccgagatggtgccactgcactccaacctgggtgatagagtgagactccatctctaacaaacaaataaaaaaaattaattagctgggtgtggtggcatgtgcctgtagtcctagctactcaggaggctgaggtgggaggattgtttgagcccaggcaggaggtcaaggctgcagtgagccatgattgcaccacagcactccatcctgggtgacagagtgagaccttgtctcaaaccaaaaacaaagtatgagctgaagttgacaataagctcaatatgaatcaatagtgaaatactgccaaagtcaatgggatcgtaagctgtattaaaagagaatggagtcccaaaggaagcagtcccgctcaactttgagataggcagactatacgtgcattattgtgtagagctcaaggccccacactttcagcactttatgataagtttgagcacattcaggagagagtggccgagcccagaagggaattaattggaaacaatcaaagtaactggtgatgttcagctttgagaagtaaggctcaagggaacataacagcttcaaatatttgaagggctgtcaaagagaagagctgctgcattccttctgtgtaacttcaagatgtgaaagtaggatcagagaatggaacttatcttatttagacatattttggcttgatgtgaggaatgtctttctaatagagttctctaaagaaaaaataaattgtcttgagtggtagtgagttctccatcacttcgtgtggtcaggcagaaaccaggggacactcaagtgaagactagagtttggattgaatgactctgatgtctctagaggtttgagacgtttgttgttctgtatttatcattgtatgccctatggtgccataagctttgcattgactcagtagatatttattaggtggaaccggaatgctttgggggtaattcctagggaagagaaccaatatcccacccaagaccattactaaggagggaagtcaaggatgaagccagaaacataaggccaagggtgggacgaagggaagaggcaggtacagaactcaattaaaccctgcctctccccactctgcactgtacacctcattcatcagatgcaccatcttctgcttggtgctggtccatatgaattcatcctccatgttccatttgtctactagatattcatataatccagggctctgaatttttatttatttttctctttggttttcaaatcttcttcccattccacactccccagagttcctggtctttcttcattctatgtccagactccttttgtctcccttttctctaggtggtctctccctttccttgggggaccctttccatttctctcttcctactcccttaaccctctgaaggcttcaacagttaataaggtcctgaaagctagaacagggatcttaatgtcccacagaggcctcaggcgatgaactcagtgtcaggtagtgtcatctcatcctatggactgtgaacctggaggctggacaggtttttgtcctatgcctaactacactgtggacattctgcaaactaaaaataattactgctttttcctcctctagtttgtcttaaatgacctgaacaatggcattcttatctctcccttgggagaaattattctgtcatcaatgcacctgtctgtgaaagaatgtgtgctgacttcttctgcaggagttccaaattttgtctaaatgtctctttgccattcccaattatgcttcctcctgtactgcaatcagtattatcaacactggcatcactttcttcgccagaaaataaaactaaagcacccatattttcctccctggtggctttatcaatatctttcaggcatgatcataatttccctccctaattcttcatgcatattcagacataaaaactacaggaagagagaacacaccttgaggaaggaaggaagggaagggaagggaagggaagggaagggaagggaagggaagggaggagggagggagggagggaggggagaggaagaaaaaaggaaaagaaaaaaagaaaaagaaagaaagagagaaagagagaaaaagaaagaaagagaaagagagaaaaagaaagaagaaagaaagaaagaaaaagaaagaaagaggaaggagggaaggaaggaaggaaacaagaaaggagggagaaagggaagaaaagggggaaagaggtagggaagggagagagaaagaaatagagagaggagtgatgatgacaataataaaggtatcttcaaaaaaccaaaagagatagtacagattttcatgggactataaagattttttattttagaaaacttcattgtaattgtagagcaaaatatgccaacaggatattttatgtaactcatatcatgtttagaatcatccattgaaaaaaacatttatggaatgcctaccatatgtcactatgctgcagatcaaagttgtttcagccatagtcactacccttagggggtttcaggtgagtaggggacaaaacggtaaacaaatagctgtagtagtctgttgttaatgccaagatataagtattctcccagtagtgtgggattgtgagggagagagtgtcgatttagaatgcaattcttcttgattctgatcataacactatattaaattataactatatatttttattaatattgtctctgctgttatgtttcaaaaataagactcagtaagaaataatgtttatatatgttcttctaagttaagattttaaattatagaaagttgatgatagcatattatttaactagcatgttgcacaggaagctctgattattctagcttttagtatccccatttataaacactcaaatatacccttgaggaagaaaaccaaggactcaggtgagtagacacctcatatctattcattctttcttttattcattttttataaaaatacactgtgagctcctagtttataccaagtactgctctaggtgctgcagataaagtggagatcaaagctcttgtgcaacatacattctggatgggggtgagatgtaatgagtgaaatgaactagcaatagaacttcttgcagtggtaattcacatgaagaaaactaaaacatggtgttgtgaagagtggagatacactgctaggaacaacttccttgaggtggtgacatctggactgggactggaaggaaaagaaggagccagcagacgagagaagatgaaacagaggagtggccagtgcaaaggctgtgaggtgggacgcagaagagagaaaatactcagttccaggtgggacacagaggagggaaaatacttggttccaaagaaccatgaaagggtcaatgtgggtagaactatgcaagggaaagaaatggaacatgcaaatacacacataacaattcaactgggaaagataacagaaaagagttaggaaaatctattgtagctctgaaaagacctctgggtcatctgacttcttatgctatatgaaccaagcctggttccataaaagtgaactaaggcacaggcacagaaggtaactgaggaaatgaactgaggaaggaaggtgccgattagaaatagagactaagtcagttaggaaggcctttgtctgaaagtaacaaaatgcctattgtattagtcagggttctccagcgggacagaactaattggatagatgtatatataaagaggagtttattaaggagtattgactcacacgatcacaaagtgaagtgccacaataggccatctgcaagttgaggagcaaggaagccaggctgagtcccaaaacctctgaagtagggaagccgacagtgcagcctccagtctgtggtgaaaggtctgagtccaaaagctgaagagcttggagtctgatgtttgagggcaggaagcatccagcacaggagaaagatgtaggccagaagactaagccagtctggtctttccacgttcttctgcctgctttatattctggctgtgctggcagctgattagctggtacccacgcagattgagggtgggttgtgcctctcctagtccaactgactcaaatgttaatcttctttggcaacaccctcacagacaaacccaggaacaatactttgtatcctttagtcctgtcaagttggcactcaatattaaccatcacactcatctagctgctcaagcagtaagacatttaatatctcaggagagcagtctggaggtaggtggctccgggcttggtgcagggactcagtgaagttatcaaggacccagtctctcttcctactttctttgcatctcctccccagtgctcccttctgacagcaagtgaaacttctcagagtgctcctgcatgtctgattggccagaattgggtcatgtggacactccaagctgcaagggaggctgggaaaaagagcatctggaaaggaggcatgggatcactaacactgatttggactaatcaagagtcaaggtgtcatcctctgcagatgcaatcaacatggagagccgtggaacaggggatggagggaagggtgggccacagaaacacagggcccatgttggggacaagagggaagaaaagcgaatgcactgtaattgattcagaagacacgggttactatcccagccctcatcaaatcactcaaacaatcttcaccatggttcttcatccatacgacggaagtgacaacacctatcttatctctcaagcaggctgtgaagagcacaaattgccagagtgaattatgagtgcctaatgtctgcccacgactccacaaggatgcagtacaaaagtattgtagcttctatttctatttatttttctcattcttttaaaatatatacagttgtgcatataatatacataatgcattacaacaatagactatatatatcttataaatacatacatgtgtatatgttggaaatgctcaaaaaatttactggtaagggtccagattttatttgtatgcttggaaacactttcttaaaaacataacacatataaaggacttagcacaggactaggagcgtttgggtcctcagcaaaggctgtctccatctccctttcagatgcattagtgttgccatttttaatggcaagggtcggcatctgccacagtccttcccaactccattctcagaatgctgcgtattatgtgctcttttggcacctcaaatccctctcccagaaaacaggattacaggcgctgcatcctacaagcagttcccgggagctattatcacatcgctaccacaacccccagcatcttctcctctttccacctgctgttcatcttccgtatgtgtcttggctggtgggaacttctgtgaaggggtgaacaagagcaaggagaggaggagaagcaaagccagccagagaggtgacccgccagctcatgaggtgaaagtcccctcaggaaagggagagttaaaactcaaggtctgggcattctctgtgcaattcatttctccctgggaaccctgcctcccattagcatggacaaatgagaattgcccatatctacattccatctgccctcatcttcctttgcagctactcaaagcactttagaaagagcctctctttcttcctcccagcatcacctctgcggtggacaagagacaaagatgggagtgcggtgcagggagagaaacagagtcatgaggtcacttagcggctcagctagaatgcacccaggagtcctgacacccgatcaaaatcactcttctcattaaaaggacaaagataaaacctccttcataaatctgaggcccgtctgcattatcctcagccatcagttatgcttgctgtgggccattgttcatttatttaatttaacctttttttttttttctgaaaagcttttgggtttgcctttaaaaacccacattaaattctcgtttaacgatttgacggggtcccctttagctccctttaaacgagctgccgataaaggaataaacttgctgaagaaataagaaataagcctccagaatgctgtagccctttcatgctgtggctgtccaggctgaagcccctctcaaatgaatagagataatgctaatggaattacacattgtgactagatcaggggctgccacagaaagataaataccaaagcaaggctaaggcagttaatcaaaaataaacccctacgtgcctttttttttccagaagcaaaaaaaatttaaaaaaaaaaacccgaagaccttgttttgccacatgcatttcttcattcaccttgatgttatttttccaaataatttggtttagaggaggtcccccacacacatatacatttcaaagcaaattaaattagttaagagtgatctacccaacctatgtttacagtgacacaaatgacagggtggcaagcctctcacaagataaaccagaggtggactaattcgtgaggatgatatagcgcttatctgttttgtttaggctcagttttaacaagataaaatcgctgggcctggtgttctgccagtggggaagctgtttacccacacaattgacgcgcagcgtgggctgttgtggaatctaaattagctcctctccctgcctaccccagctccaagctggttgggttagtcacaccctcagagaacaggtctcaggtctcacttaggaaaaaaaaaaatccacataatggtcatttgtcatctttagggtctcatgatttgtcctggctcatcctaaaatcaagatgaattttgtgacaccaccccaggtaagcagtgacaccctgggtgtgtccatcatggaaatggatgccatctgcctctcctaggcaaagatggaacttactaaaaggacatcagggactcgcaaaagtgagaaggcagggagtccaggaggatggctcaggagaaggccccatgaggccaccctacaggacaggtgggtgcaggcgtggctgcagcactggggcccaaatgtggcctccacgtcgtgccatcactcattccagggaccaagtcacaggcagcaggtctcactggctcagcctaaggcgtatatccacatgggctccctgaagacaggagaaagagggtctgccctttcagtccccagagagggaaacaagtgctgcctgccatggaagggccatacaataggggatttcccaaatgggagaccaggcactcacaaaaagaggttgaatgaaggcaccccaaaactggcaagcggttcctatgctagggctgagaaaagtgtgcctgggcatccttgttcagcccgagcatcaggtgggaagcagtttgcagtgatgaagggagctccgggtggtgaaccaagagacccagacccaggcatggggccatgaccaggcaaggctacctgagctaaggcaagtctatgcctctctactcactgttgtgggttgaattgtgtcccccgcaaaaatcatatgtgaaagtggtcaccaccaatatctcagaatgtaaccttttgggaattagggacattgtagatgtaattcgttaagatgaggtcatactggaggagcatgggagcctaatccaacatgaccggtgtctttataaaaaggggaaatttggacacagacacccgtacatggagaataccatgttctccatatggagttattctgtctcaagccaaggaactaccagaagctaagagaaaggcttgaaacaacctcccctggtgccttcagtgggagcacgaccctgcagacaccctgatctcagacttccagcctccagaactgtgaaacagtagatttctgctaagccactcggtttgtgatacttcattatggcaatcctaggaaactaatgggctcgttttctataaggtgagcaagttggacttgatttgcagctttcaaactgtttgagtcttgacttccacttgaacttccatttgaagtcccgcaacttcgtggcagcacactttgaaaaccatggtgtgatctccaaggtccctccagctctcactctctaaattaaagcccttttcagttttgacaaagaacggttccaaatttagggaaggctgtatggggggacattttcttctccagctgcgtggataggctgatcccttgatgggaccctgctggactccatcccacgtaattccagtctgcttcttcaggcactgagccctgggagaaggtggctacttcatgtgggagctagaaagtatggagatttctgggtctagtccagtggtgtttccattcagacatagatagataggtagatagatagatagatagatagatagatagatagatagatagatagatagataattgatagataatagatagatagatagatagatagatagatagatagatagatagacagacagacagacagacagacagatagatagagagctttgctaggcttagatcctgttagatcctagagactcggtcccactctagactctagtcaccatctcaagttccacagtgaacccaaccacttgaaagattctgtgacctaccacttccccatcttcccacagagacctccagcacccagcagtgatgtccaatgcctcacagaacaataaacaccactttgagatgtatatgatgcccttgttgtctatctttaaacagagaaagaaggagcatggtatccccaatattggaggggcaccaggcatcatggcagactcgattacacaggtatcagaagcctctgcatgggatgatgcctcatggagactggctgcctgactattcatccgtctcccatgctaaattgggagatccaggagaataaggaattctgtgcgcataagttttaaatccccagatacgggtggatcaccaatgagtgctccagagggaagacctgaataattaccttgttcttaaaacccatattattttaaaatctggaaaaggggtactttcacaacacccaggcactaagtcacaacagaggaaaacttgtccagatacactggcccaacctgattctcgttcagtcagtacattggtgacccacatgtagaggaagatcagatagaagttacaaagaagctgccattctttcttcccccaagtattgtgacaaagttgcttcaaatgtatataaactgtttaagattaataaaatgaacactaggtgccctccacctatacccaataattgttatcatcttgtcacatttgtagacatcatgaaatttcacttctggacccttcagcaaacctcttttgagaacgaaacattatcctacataccttcaataccattattgtgcataataaaattaataatattccattatattatctaacatcaagtccctactcaatttttccatcatcttaagaaatatattttatagggtttttttacaattaccaagatccaatcaaaattcacacattgtatttggttgtagtgtctgttgactctcttttaatccagtacagtcctccaacttttttctttcatgacactgactttttgatgaacccaagctgatagttttgtaagtgttgtatattcttgatttgtatgattgcttgtttctggtgttgactgacttgtccctctatcccctagaaatggctgccatcttgacctactaaacactctgagtgtgggctgagattaagagagaagcagggctggatgttcctgttccaagatcttccaggcctctctctccattgagtgaggtccacaccagcacctccactatgacagagccactgaatgcctggtcctgccaagccacagccccaggacgctggagaacagtgctggccctttctggactctgctgcctttgaaactatagtgagcacagctggaaacacacatacaatgccacaaaagattatgaagatttaaaggtttctcagtgatttatgtctttttaattaatggcttttatgctttaattaaaaagttacggaagttgtctttacttctgaaaaatgcatttatggttgactgcttgcatgaattaaatagcatcagacccctaggttggctccatgctagagtcctagagctcattttaggggtaggaagaaggaggtcagggagaaataccattaagaaggaaggctgtgacaactttcattactttttgatgatcatgcaataatttcccatgataaatcatctcattacatctacaaacttggaaacagaatctaaatgccatggtcctgaaaaaaaaaaaaacagcatggaacctggttttaaaatgattcacctcctcactgaagaagcagaataaaagtttatattttattactaattgattggttcttaggtcacactaactacattgggagtacgattgtgcagagctttgatttgggcttccatgcatagtctgctaaagtcagcagccacttctggacctagatgtgaccccagactggctgattgcctgagtcaccagcccggtgctatgggctttgctcaggatcaaggtgccttcctcaattccctctgcagaattatcatgcctttccttgcattcccattgaattcattttgataattcactttgaatttttccctatcattctctgaattacattatttctgttcatgccggtctcccccaatagtttgttgtcttctctataaggccacttctcatttccccagtccccactcagatagaagtcactacatcatcatttgtgtcactattctatcacaagcagaattgttccaaaatatctcaataattccaacctattttttaaatgaaatatgtctatgtccttttactaaattgtaagacctagtggccatatttaatcatctctttttttcttttctatttgactaggctttaggccagagaattgagtcaaccatattcctagttcatgacacattcaatcatgcatcgtctctctccttttattcattcattcattcattcattcattcattcatgtatttatttattccctttatttccctttcccaatcctgttaccttgaccactgactacaaatctgttaaggttaatgagggtcttttgtttgtatgcattcttgtaaaatatgtgtatatttcatgcatatagaattttaatttacatacatatataatgtcatatgcttcattctgttccttactcttttcactcaatattaagttctaagaatccatccatgttgcgctctctctctctctctctctatatatatatatacatccaatctgtaatttttaacttctcaatagcactccatcgtatgcttctaccacattttacatttgttactgcctgttgataggcacccagattgcacctgggtgcaatcccgttagggacctatggaatatatactcaggagtggaatttctgtgtcatatggttaacaaatatgtgtgactaacttgtgctatgttgcccttcagaatgtctacgacaaaatatatattctttttttttgtatttttttgagatggagtcttgctctgtcgcccaggctggagtacagtggtgtgatctcaactcactgcaacctcggcttcccggattcaagagattgttctgccttggcctccccagtagctgggactacaggtgctcaccaccatgcctggctaatttttgtattttcagtagagacagggggtttcattatgttggccaggctggtctcaaactcctgaactcatgattcgccagcctcggcctctcaaagtgctgggattacaggcgtgagccactgcgcctggccaaaatatatattcttattggcatgagattttccatattcctgcagcctcaacaaacattattcaacctccacatttttgtcagtctactacattaaagtaacattttaatttgcattttaaagagatttggattatttctgcatatacttgttagttgttaaggtttcctcttttataagttacctattcataacctttccctgtatttcatttggagttctcatcgtttgcttgttgatttgcaagaatttcctgtgaattctaaataacagtgctctgtcagttttagacacagtaaactatcttctcccaattgtcatcagctcattcactgtccatggtatccttcatctaatagaaatcctgaattttgatatgattatggtaaataaaatacttttctccttatattttgtgcttttaaaattccgtttaagaagttatcctttattctaggtctcaaaggaaatcttcttttaaccttatagtttagtccttcctacttaggcctttaatccgtctctaggtcacctttatatgtggcattaggtagggaactagtgtaatggttatctgtatggtaagtaaatttagccaaatctgttaattaaatagttcatctttccctcattaattcataattcatcttaactgtatatttgctccctatactgactctgttccattgatttttttggctgttcttgcctgaccaccccagtttttgctaccacgtgtttctaatatgtcttaaagtctggaagggtaggtccccctactcactcctcctatgatctttgctttgttggtgggtttttatccttctatgtaaatttcagagtagatgcattgagctctgtaaatcaactggaattttgattcaaaggtgcaacacacatattggttaattggagactaattgatatctttaaaatattaaaaatctatatttgagcatagcatgtgtctccatttactcagatcaacttctatgtactttattacatattaactttttctctggaaggacctcaggtgttcttaaattaattcctggttagttcttattactaatgagaataacactctatttttaaatattttatattttgttattgttgtagaaaaatgccattttgttttaggtagatctgatacccagaaatctttcatttattctagtagtttgtcttgtgttttctaggtaagtgatcatatcatttgcaaacaataacactttgatctcttcctttccagcatttagacttctcccccttttttttttctttttttatagtcaaacacagctatattgtctttcaatagcactgataacggccgtcttattctattctcagtcttaaggtaaatacgtccaaatttttttcaataaagataatgtttactttttcttttttggtgtatttttaccagtttaaggaatttccatagttcctaatttgctaagagttttgtcataaacagctgttgaactttatcatgtatttcttcatcaattgagataattgtatgaatattgccttttggcctattaatacgataagttatgttaatagatttttcttttgttaaaccatccttgctcacttggaataaatcctacttgataatgatgtgtttgaatacattgtttaatttggttagctaatattttaattaggatttttgtacttatcataagtgaaatatgcctatagttttcttttcttacattgctcttacctcattttgaaataaaaactatactaacttcaacttttattccttctcttttcttgaaaataatatgtaaaaggtaggatttcattgttctttgtaagtttgatagaatgaaccttaaaactatctgggcttagagtttggggagataagatgtctttggttatcacttcaatttctttaatatttttggtctaattatgatctttattttattttatcattttattttgggacagggtcttactctgtcaccccagctggagtgcagtggtgtgagcacggctcactgctgcctcaatctcttgggctcaagcaatcccccacctcagcctcccaagtagctaggaacacacgtgtgtgccactatgcccagccaattattttttattttttgtagagacaagatcttaccatgttgcccaagctggctttaaacttctgggctcaagggatccctggatcccctggcctcagcctcccaaagtgctgggattacaggcatgaaccatggcaccctgcctctcattttttccttgtaccaattttgactttttgtattttctaaaaatgtatccattacatctagcctataattattcataacactcttattattttacttcctgatttgtctatagttctttaaatttcatattttattatttgtatcttctctcttttatcttgattagtgtcttcagaagtctattttaccaataatatgaaaaaattcacttttggttatattaatctttactattatttttcttttgttgttagttgtattgatttctgcccttatatttattatttcatgtattcttgtttctttggtttaatcccatacttctgttttgactttctatctccagagcttagcatatacttagtacacagaaacttttttctatcaaatatttattgaataaatgaattgtaaacaccttgagatcagataatatgttttgtcaatcttcatagtcctcaaaatacctactataccacttagcacatgggagggttcagtaaatattgagggaatttttcctgaaggaatatttaatgtaaaaaaatacatatctatttaaagaaacctccagaggtcatataattgagccttctgagtcaaaagaaaaaaaaaaacagtaaacatttctgatagtgtggtagagcccgtgagagattccccccattgttttcttcttccttagtgacagaacccctaattctagctaggcacacaaccatctgaaataaagacaaagtgattaccttctggtcaatgggatacaagtgaaaatggtgggtacaacttaagaaagtataaagggaaaagatgtgtcttttttcctcccctttcttagtcttgctttcttgaatctgcatctcatggttagggttccagtagttaaaatggataaggaggtgaccttgggaatggaagtcttacatgacagaagaacaagataaagtgcctgggttccttgtacccggaagctttcatggtagcccaagatgatagcttttgaacttctttatgaaagaactcctctgttgtttaaggcacagtttggggtctttttctgtggtggcaagagggaggtttctgtcacatgtagctgaacatattaaatgattagaatagagggaatagattagtaattgattcagttggtacttgttgatccttttctgaaagatgtccttgcacacacaacaaagatctaagaaagaagttgatgttaaatccccatttcacacatgagaaaagcaatgtgggagctgagactatgatttatctctcattcttactcagatctcaatttgctggacaagtttgccttttctaaatcaatgaggcccagtcccaaaggtttttaccatagaagaatctaggtttactcatgtaaacactgaataattttcagttctagtgactgcctgggcaaaatccaagtaagcctcaaatttttcagactctggtatgatttttctcaggtttgactctctaggtagcgaggtaattagactccctgttcttttcaaggtcaaagaccactggacaaaaatatgagaactttgtccaccctttgtggctaatgagcttgactctcaaagggctatttcacctccttcatgagttgtcatttggagtccactctctcagtcatggctttgcagggaggtttggagctcagtccagagcaagctccccagatgacagctacatgctctataacctatacgaccaagagaccatgttgcctctgtctaccagctcctttatggccccgtggtctccttgttgttatggggagtttctcagagtgttctgctcaaaatcaacttcaaaatcacctgatttacattaaaaaatatttgcttttgtgaccaggagaaaagtttgcactcaagacccaaacaagcttcccagtctttctttccaagccccaaccctgatcctcacacacaaggaaggtttgagcttgcagaaaagacatttacccagccaccaaaatagttaccagggatgacaaggacctgcctcccatcttagcgagggaagagagtacaagagggatcagagacatgagaatcagccattgatacagatctgcactgtgaagagacacagacatggtgagaaggtcgtcagactctcattgtctcacctttcaatggattcttctctacccgtggaagagtcactgagaagtggaaagatctctctaatgccatcgggaagtgttagtacaattctatgaaccagaagaaacatggaaaaagaaagagaacttctcccccaccataaccaaaactttccattaagtatgccctatcaaccacttacaacccatcaatcaattaaaaaatgaaagaaataccaaaagtacccagaaaagagctgttagcctgcaaataaaagcatttaaaagtttccctattttccttcctttccatagtatgtttctattcttctcatagccagtttgctggtttcaattttccttgaagaagctcccacactaatgagattggttgtttaaatgtctccaagaagcaacatagactgctgggatctgtattctctttattgaaaaaaaaatatcaaatggactgcagagattaaggtggaattaattccaccccgggaagagaggagccgagctgcttcagtctcttggtttataaggtcaccagaatcccttgtcaggaactattcctccgtaaatcacttctgcccagctactcggcagccctgagttgcagataatccagacagtgattgtgtctggtctctaagcaaaagattcattgacctcccctaagaggattctggtaccagctttgcctgcaggaagaagtggacgagcccagcctctaatatgcaccagcttttttgaccacctgctggccaggattcagtctcacaggtaaacatcttgagtagagaagccactgctgaaagtacagattctgctatgggagggggcctgcattccccaggagccagctcatacagcatgcaaaagggcagggccaaccttaggacttgggagtcagatattggacttcaaccaagtatattagactcccagctgtgaggaccggtgtatatttatatttcttccttgagtatggttttgaattttaaaaactgtatcacactgatgagtgcatatttagctaccaattaattctggccttgagcaaatcacttaatttggggcggggtcctttgtttcaaatagatctaaattaaaaccttgcatccactatgtattgatggtgccttattgggaaagttaatgcatgttttgcaaggttgtggtgaggatttaaacgataacatgcctaaagtgcctagcagactatccaattgggttatttgcccagctgtgcccaccactgtccacacccctcttctgtgaagttccttgtgttgcaagggtgggtgctaaggtacctgactccactacccctctgtgttctggcggggggcacctaacacaagccaggccaatatgcatgcctttccccaagattctgcactggatgagtgctgagagaaatcagtctctctctggatagtggcccatgaactcccactagctcaggagctgatggggaccctgtgctctgccaaccagcctggaacaatgggaggagctagtcttcagatgaagagagagaagaggaacatagatatacggacaggaaacaggagacagggtagatatcattcaaggctctgcttctaattcatctctgcccctgggttccatgaaactcatacccttgcatcctcaaaataaggttctctgtctcgtgaaaagtagcttgtgctggtttcgttacatgaaatagaaaagagtcttaataatctggtaaacagttgtttttcaataaacagtaaacatcaacttatgtaatataagagaattggccaagagatgccacaggttctcctgccccaccccacccctgcccagccaactatctgacttgatataattacttactgggacatcttccctatctatatatcctacaactactttgaactaaacttatcattattcaataactcattcatttgataagccatttctctgtacagatgcagggaccgtgacatacctctattcccatgtgcagatggtgacatctctcagtcctgtcccctagatatgactccgcttgcaccggactctgaccctagccacagcctctccctgggactcaaccctcctggtcctgcacttccctcttgtcccagcccttgatggctcttcctttgttgactccagtcctagcagtgcacaccagcccaggctcagcatcaacctaaaaagcagtgcttttaaaaggcaagtgtcctcagcactcacaataaaattaacaaatgtgcaggccccatgctgagcactctgcaggaatcatctcatttaattctcacaacttacgagattggcactgttcttatccacattttattgatgaagagaatggagcatggggaagataagtcattttattcaaggtcacacagttaggaaacggcagagctaagatccaaatccatgcggcggtgtgccaaggccatgcactttgcctcgtagccccggtagatgagaccctttggactaggcattgcttttgttatttactgtactgatgaggctatgtctgagaaacagctgtaagaatttagagaggggatccagtgatagagtcaacagatctttgtccccaggatttggggacaaggcagaactagactttggtcctggagaacaggtgggtgacatgataagtggtggaaaggtcaagggcttggaagcatgatggtgcttggggggcctgttaggaagtgggtaggtggcattggtagatttgggccaattctggggacacagaaagccaggcagagttggaacttggtttggttattattaataggttaaattgtgtcaccaccacccccacccctcacatgcacaaaaaaatgttaagtcctcagccctagtacttgtgaatgtaatcttatttggaaatgaggctttgcagatgtaatcaaattgagcagagatcagactggatcagggtgaaccctaatccaatatggttagtgttcttatacaaagagggaaatttggacacagagagacccacaggaagaacatcatgtgaaaatagaggcagagactggagccatgcagatgcaggtcaagaaacaccaaaggccggctgtggttccagcactttgggaggctgaggcaggtggatcacttgaggccaggagttcgagacaagcctggccaacatggtgaaaccccgcctctactaaaaatacaaaaatcagctgagcacaatggcacacgcctgtaacctcagctacaagggaggctgaggcacgagaatcgcttgaacctgggaggcggaggttgcagtgagccgagatcatgccattgcactccagcctaggcgacacagcaagactctgtctcaaataaaagaaaagaagcacggagaattgacagccaccaccagaggccaggaagaggtaaggaaggattctcctgagagttccatagggagcatggccctgcagtcaccttgattttagaattccagccttcagagctgtgagagaataaatttctgttgttttaagccacctaggttgtggtactttgttatgtcagccccaggaaaatagtagtcatcatcagaaaaacctagttccttgagcaggttagggtaacaaaagggaaaccaaccaaggtcactgggtcacctttgaagtgtgtaagcacacgttctatacattctcatgccactcagttcagctgtatgcagttttctgcattcacctagtgtttctcgtaggctaaatcgcacataagtaaatgtgaaatctgtgttatgctcaaatcattccctaatccatcaattgcattggaacagatttgcatttccaaaacaagcattatagcagaactaactgaaccaccaaactcacacagagagttagcaatggggctgggcacagttttacacgtaactctctagattcacagggccacccctgactttaagcctgagaaaaattagggaggagggagcacctgatatatggcaaaaaatttcattcatcagaaagcagctcgagctctcatatatttagaattctctgccttcaacttcagtagaagcaaatcacgggaaacaagctgatatctggaatttagccaaacaaaatcaggaatgcatcccaaagtgagattcacacagtcccctgagccttccacacctatggtcaagcataataaaaactggcatttttggaatggggtttctgaatcatgatcctggatgctttctaaatcaccaaatcaaaagtagataatgttcaacattcaaacatctgaggaaggaaaatgaacagaagcctttgaaaaagtttaacgagactaaccaaaacaaagattttcaataatccacagttaaccaaaaaacccgcacccagagcattccagttcccagaggctgacctacacatacacccaagagacatgccttctgagcgtggtttcaaattctagagaaattgccaatatggctcaagttgtctaaggaaaagcagcctctctccttccttccaccttctccccctcctgcctcactgctcaccaaccctggatctccttttgcgtccctgagagcagacagggcctctggcacctagctaggagcagcccagagcacaacaaaagagcagctgcaaatccatactgagcagatgagaaatcaaggaaaaactttatagattgagagatggatagttctgaaacgtaataacaaggctaaagggattggagttttatctacctttgacagaagcaccttaatggggccccttatgaggggctatgagagcaatgatcactgtgtaaagaagatgttctctgagcctgtgcctttttgcagcctagaagtgccaatcaaatcactttcctcacgttaattaattaggcctcttgcattccccaaggaaattcagaacagaagcattatgttctggaaagaggaaagtgagcagcatcacatcatcattatcaccatcaccaccatcatcatcatcatcactatcaccatcactgccatcatcatcatccatatcaccatcaccaccatcactcccatcatcctcatcactatcaccatcaacaccatcaccaccatcatccttatcactatcaccatcaccaccatcaccgccatcatcctcatcactatcaccatcaccaccatcactgccatcatcctcatctctatcaccatcactgccatcatcctcatcactatcaccatcaacaccatcactgccatcatcctcatcactatcaccatcaccaccatcaccaccatcatcctcatcactatcaccatcaccaccatcactgccatcatcatcatcactatcaccatcaccaccatcaccgccatcattctcatcactatcaccatcaccaccatggccaccatgatcatcatcactatcaccatcaccatcatcctcattattccatggggataatgagaccccatgctgagagctgtaagaagccagctgggcacacactctccaggcagaagtgtgcagtaaaaggcagaatgaatagttcattcatttattcaccaacatattaattctatgcttgttgggaccgtactctgtattagcatgagggctacaggtagaatgaataacacagagtcactgcactcgaggaacactcagtccaatggcaaaggagaagtacactgcaagcattacagtgaaagtgctctcagagaaagctggcccaagattctaactgcccaagaaagtcataaggcattcaccctttgccctctgacacttaccctgtggccaattcatcaccaagtttgcccagtctctcctctcatggagacttcaatccgttccttctgccactgcttccattcaacccctcccagcatcccccacccccgcactcctgcgacagcctaaaaacttgtctccctgcctccactcttgcctctcgtggtccattctccctggtgcagccagatggatcttcccaaaactgcaaccctcagggattactcactccactgactaaaaactctccttgtctcaaggaccacattcaaactcagaaaaggcccttcagggtcagatgcagtcctgctctgccgtgcccaggtgggactgacactggtcaccctgtggtgctcactctgtctgggacagccaggaactgccacccctgaggccttgctcacatgttgtttctctacctggggggcccttcctaccctgtcactacctgctgaaatgcccctcatccctaaaggcccagctcagtgtccacatgagtgacatgccacagccccctccgtcccattcccagtgggattcatcacaccttgattatagcattttacacgttttgtcataattacatttctgtatctcccttccctcccagatttgcaattctttgagtgcagagccagtctcctcaatgtcagagcagtgcctgacattgagtagggccactcagtaatagatggtggaaagagtggtcagcgacaaactgtttccaaaatgtgtccatggctgcttggaagtatgtgagttgctccatcatgtggttgtaagtcctgcagagtaaaagcctcatccttctttcacatatggctaaccacaagagcatgtggtttgtgggcaatgtcctggagtgatggggaatttgccctggaccagccttccccttagtcccttccaccacccttcttgtggctatcgtcatatgtaggtgatgactgaatgggggttggtggccattaccaatgagctatcactgcagatggccaactacaacctgctcatttacttttatttactgaattagactaatagatattattatcctcactttataggtgaataaacagcctctctggtgttaagttgcccaagaccacacagctagtaagtaccagagctaagatttgaacctctggctgtctgactcccaggcctaagttcttcccgctacactgggctgccccccattggcagtgggagggggaagcctgtgggctgtagagcagtagctgggacaacattgactctgcgtcctgtagggccaacactccatgagcactggcttttatttaccttatatggtgaaaagagagatgcccattttttcccatttctccagactctaacagatgggtgctaatttggtaagtgcaaattatctggcttcagttctatccaccatctgcctgcttgaactagtgaaaccagggtgagttgtaattatgcccagctctcttcacaaggtccttcccttcctttagatgagtttatcctcttcctattttaagaaagagcttcacatagcagggcatttatggaacacttccaagaacccgagcagagagtgaaataatgaaggcaaagcaatcatgcagacaaaacccttacacaagatggcaggagccccagcctggccctgctcctcctggggaatttctgggaagatgggaaactagtcactacaatccctgggcctcaatttctccaccagagcactggcagtaggagcctctgagactgggaagtggagctatgctgtgtgcaaagggactgctctgctattgctgctgctgcactggcaggcatttggagggcatccctaagcttctcatcctcgtcctctgaaggaagctcttcagtcccctctcaaaggttcttcctagtccccccatccctgctaaaaataaaaggctgaatttcatcttattcagaccatagctagaatacaggtgcttaaagctccctctctctctgctgtctgcagcaacctgccctaacattcagcctctacaatgtcttcaagactaaaacgtgcatgcatgggaagagggtcatcaggctaagggaagccatttacccaacccaaagtgcatcatttaaaccccagatgtcattcattcttatctgaaggaatcctttccattcatttgcctaaggctcctcttctcctcccagtttctgcctcctggagagagcatcttaggagataaccacccatatagcacagcgaaggattccaccttgagtgccatgatactgcctcttggaggagcagaggtttgccacttgtaatgtggatgagcaggagggtgtctggcccgtggagcagttccttgtctgtccccacaaggaagggaagcttctctgtgtgcccaggcacccccatatctcttctcctccagtcactggtctccccaaccccaatcacacagtcaccccctttccccatctctgagactggcaagtgagccagtccccccggccagcagccaagtgaatttttaaaagtctctctttgacaaactaagagggagagttggctgtttcatttggtggttttctttagcaacactgaaatgtctaacatctaaatgtgtggtgtttgcgaacttaaatatgtcgcctctggacctgccattccttaagaaacatctgctccccagaagatcagaagtgagaaactgcaaagttgcattacttatctttccctaaagaaatgaaaggtgtttttctccccctcaaagtaacagctctttctccactccacatcaaaactccagcctttggcaaacatatcttaacgcttccaaatccacgctccgacacagaacttcagacttcaaaagtgacagcagtggggccaagcccggtgcacacttctcagtacccaactccttcacaacttctgaacgtctccaagaaagatcagagggcagcaaggctactgtgctgtgcccacgtcataacgtgcacccaaaggtgggggaatttattaaacaacctggggcatgatcctggaagatgggctacacacaaatctccccataggtagagtctggcctagaatttgaaaactgtatctaaggctgacaatttagcaagggagaccagtaccaaaagaggagtccagatacctgtagtgagagagaaccagtagaaagggccctggaccttcagccttctctgtgaccttgatgctctcagctaaaaagagatgcagctgcatattatgagcaactaaagtaacagaagttttaacaggcagggcacattctttcccctaaaaaaggctggaaggagggaaagagtccaggggctccatgaaatcactggagaccaaggctgctgactttgtgttctgccatcttcaaggtcaccttaaggctgcttcacagcttccattctcaaggtcatcagtaggtcaagattgctgttttgagctcctgctattacaccatcttctagggatcaggaaatcagaaaaacaaggcaaaatgtccccttgacagcaatgcatgccaagtcaactccattttagcaaacttcccaaaggatagcacatgtccgcttacatctcagtggccaggacttagtcacatggccacacctaactgcagaggacactgggaaatagcacctgttagctacatgcattgtgtgacctcgaaaaaaattgggcttcttttactaagaatggaaggaacaacagatgtgatgtagcacctggcagtctctgtcacagattcaactttctacctgtcaaaagaatgtgttcatcctggccaggcgcggtggctcatgactgtaatcccagcactttgggagactgaggtgggcagatcacttgaggtcaggagttcaagaccagcctggccaacatggtgaaacctccatctctactgaaaaaatacaaaaagcagctaggcgtggtggtgcacaactgtaatcccacctacttgggaagctgaggcaggagaatcacttgaactcaggaggcagaggttgcagtgagaggagattgcaccactgtactccagcctgggcaacagaaagagtctccatctcaaaaaaaaaaaaaaaaaaaaagtcctcatcctgactctttctccctctcagcactactgacattttgtgcaaataattctttattgggtgcagggagggcctgtcctgtgtattgttagatattttgcagcacccctgagcagttgtgacaacccaaactgtctctaggcatcgcccaatgtctcatggaagacaaaatcaaccatgggtgagaaccactgatttctatcaaaagggcatcaaaatgagattatacacatgatcttcgtaagaatatatatacatttactacattacacagtcacctagatgtaacactatgagaaaaaaaaaacggacttaatctttatgctttgttgaaaagatgttaagagaccagtgtagtccttgacgcttctgaagttccaaagagtaaactcggaagacagagaggaaactgacctactagcgattcctctcacgcacacaaaggttggactgcagagaaaatgccctttggtctcatgcagctttcctcctccctccctgggcttagcacaccttgcacttttccaactcgggatcttctcgcatcacattctcagcctgggcctcctctcctctgctctgtacatagctgcctcctcacgccaccagcttctactaaaaggtcactgccaccaattgaccatgaatctgaataaagccaccctcccccccgacatctcctctgaatcctccatatcacagttcataattccatgtgaatctatttactttttaattatcactgtccccattagattttggcttctgtgaaggcaggggccatgtctctttattcactgctgttcacccatattccaccagcacctggcacaggaaagtgccattaagtatctggtggctgagtggatatggcaatgggggtgagacagtgtgctcctgtggtgtgtcagtgagtgggcgacggggtgatggagaaaactggaacacagaccaggacaaacgcaaagtagcatgtgtgatattcttgcacagacttaatatttccaagtcagttatacgcatttgttggctatctatacctgaaataaaaaaataaacaaaacacggccacaaggacctacagtataacacagaagataaaatatattttaataattacatgtaaagtctgctaggagtgtatttttaaatccaggaaaaaaaagtaaaagaaaaaaatgttccacagttctgaaggtgggcaggttacttctgcctgtgggcgtggggcttcaaagggcaacattggaaggaggttttgcaggatgcataggagttgcataggtggaagatggggagaccttctggagggaggaacagcttgagtaaaggcagtaagtgagaaagcccaggactttgctgagaatgtgctttcacccagtgctatcctgtagaaatgtaatgtgagtcacatttttctagtagccacattagagaagtaaaaacgggtaaaattaactttttaaaattacattttatttatttaacccaatattaatattcaatattttggatatccaaaatgttattccaacagatcaacaatataaacgattattgaggtattttacactctttttttcagaacgctaaaaatccaatgtgtgattgacacactgcacatctcaattcagactagccacatttcaagtgctcggtagccacatgcggccagaggccctcatactggacaggtctagtgccatagcgggagtgggtttaagcaggcccaccctgaaagatagcaggatgcagcagacagcgggtgaacttggaacaagcgtatttaatattgttttcagcacgtaagttgatggaaataaagctcaaaggtggggaggcactgaaggctcagggagcagtgttggagcagaggtttataaatgtcagacccacagggagggtgcccaggcaaggctggcaggcaccagacgcaggccccagcaaccacagctgtgtgcagcgctctgatgcctggccacagctgacgggacagaggcacctggcccaatttgactaatgagaaatttccaagaaatttggtactagttcagtttattcaggtctcttgaatggaggagatgtaaatacttgggaaatgccggagacacctcccaccgcggaactgagccgcggagaaaagcaagctgcagagaaagaggaagcagatgtgcagagaggcggagatggaggagtggctgggaaggtcgcctgtgtcccgccggcttccaagttccagagccttccggagcctcttctgaaatcctgccccctggcttcccaagatgtcccttgcccttaaactgtaataaatctctctcccccgagccctcgccctctttcagaacactggtttctattccgtagaacaaaagatttagaaggtcttaagaaataccatcagcacaaggctttaggacacgccatggttttgcctccctacctagggacccggcacaggggcgggaagggaggaatctgggagagctgagattctagggctttggttaccggtggagcgggaggggggttcgggagatggctgaggttttgagcctgtggctgggaaagtgatgatgtccttcacagagaggggagtggtggcagagggagcagggccctaagggaaactgacgcctgtgcagcacgaaccccactcgcgtcctgtctgcctggactgccgccgtggggacttctgcagcccccgcccctggcggaggggacgggggctggggctgctcccaccaccgcaggcggcccgcagtgcccggcctcagcgtccctggggctctgggttgcaggctttggctgatggctgagggctctggacgcaacgaagagtcacttctggtgtccacttcgggatctgtctgacactttttctccttcctgcaccctgtagcacctgctccttataccttattccctgcttctgctcacctccctgctcttcttcccttctgcggcccattggagtgagcagggaagtgacgcttttcatgtcccaaagctgggagaccccatttgagccagaggaagaaaaactaacagactctgtccacatcagctttcagcaacgtgcacgtgggtgcacacacacactcatgcacatgcacacacacacacatgcattcattcgctccttctccccaccgctatccctccctctcccctctcctctctcccctctcccttctcccctctggagacttaacacactttttgacagataaaggatctctctctctctctctctctctctctctctctctctattccccaccgcctgctttcgccctatccccaaatcagccagacttagctagcaacacgcttcccttggagtggatccctcaaaaatttccagccacaccaggaaaagcaatggcagataacgcccaaactccctggtcatgctttctcttggctctccagtccaaggctgcattctctacctgacacacacatggtcaccatgcaccccacacacccactccatgttccatgcacagtttaaaaagcacgttgcctcttcgcagtgcttctgcatttgctggctgcaggcaagagaggagaaaatgtattcagcttcctctgtctaccttgcctgcctagcctgtctcagcctgttctctaagggcctttggggtattgatcctaaaagcttctgcaaagggaatcataatgggaatttcatagccaaggaaactgagtcacttgaggtcaagggctgcaggagccttgttttccaagagccctcagcacttacaacctaagaggctctgtgtcctgttctccagcccagtggcctccaaacatttttaattgcttgactcatccataaaactttttgagcatccacccccagtatatacatatttatttataaattataatcacataaactacatgtctaacattatttatactacaaatagacattatagtagatgtaacagacatactcaaaatatagaaactgtaaaaggagaaaacaaagaataaatataactcaacattctattatgttcttcctgcgcccagtggatcctcttgtgcacctcctggaatatgcacctgtttgaaaacactgcgtttacccaccggccctttcacgggtcatctctgtggtagactgtgcggttctctgacccttccagttgcccttcctttccagacagacagaaggaccctactctccaacccatgaagtaaggagtggctgcatcacttgctctgtccagcaaatgggtcccttctgattcggagcatcaagaacttcccatgccctctctcatcttcaccacaaagaaccctgaagcctcatgttggatggtagagtcataagatggtcatccaggttgacttgagtggctaaagtgagcagccatgttggatttaagatatggggggtttcgttacatcagcacaacctagcttctcttgactgatcctatttgtaaagaacccgattgccaccttgggcatgggtttgttctctgaggcttgctccctcccagctgtcatgctgagagggtgcttctcagtagtgacagggagccacagtgccacagaggaaaagcacggggtggtttgagggatggggtcagaatgtaagaaacggctcagagtctgaagactgatcaggaaggcactatgtgggtagacttgctccaggaactgatgggtgctttccactcttatcccagggccatccctgaaccctgggctacagagcttcaagccagagagtgaaaaatgcctctgtattccctgtttctgcatgtcctatgtcttcctaatggtaaggagtttgatttcagaccaaatacataaattattttcctttaggccattctttcagcaaataaggcagtaattactgtctcttagaaattttcacagtaattaaattggaagagtatctacatcactgaggcttcctcccatgaaatctaaaacactgacaacccatttcccaaatgcctcccagtctggttgatccaaggactgctactgaattacactgtgggatcccaagtggataagaagaggagattagaaattcagaactctctcttaaacctgatatatgacctaaaatgtttctccagctaccagaatagaaactaaataagagttgtttataccagatagaatctttttctctgcaggtcttgggctggtagggcaactctgctgaacagtattgtttctgcttcattctttctcctctgccacctttaccattgagcttccttctcactatgtaaggtggctgctccagttaccacctccaggcccactttccaggcaggaatcagagcaggaaggcagacccttcatcttatgggtgcaaaccagaaattgcccacatcattcctgctcaggtctcatgggccagaattgagtcgtatggccaaactcagctgcaagggagcctgggaaatgcagtccctagctgggcagccattggtcagataaatttaggtgctattactaaaggaatattagtggacacctagcagcctctggcttcctggcaagccatgtggccttcctcaggaagcttttcctcctacctcaccatggcccatgaactcctatactgttattcttcagcattcatcacggtgctgggtgaatacctgcttactcctctctatgtcccattaggggaagcttcatgaaggcagaggccatgttcattctgtctgtttactattgcatctccaggccctggcacttggtaggttcttaataaatatgtgttgaccaagtgaactatttcacaaatgattatgtgaaaagataattgtaattaacctctgactgttctctgcctttcactccctgcttccctccagttctgcctaacttggtctgcctctccggtttttcctccttgtcctctaggccaggctcattcaggccagacaactgctttgggcttttgtaatgcaagattgtgaggcaaggagcagccagaaaagtagcagaaggtttatgttgggaggacagaatcatgacattctctgtttagcccccatgaaatattttaaattccatttacaaattaacaattttaattagagacaagaagattatatcatatacatgaaatatatcacaatcatgcattcctgtccaaaaagattactgtgaaattaaacataaaaagtgatttctggtagcctgggctccatgagagaagtggacaggaaagaaaagtaggtttcagaagtatcactatggacatcatgaaattaaaaaatgcaagaagaggacagaaattatttggaaattttttaaattcattagactgtatttctatgacccagacactgcctggtaactagacaagttgtggctcagaaggaaatgactcagaacagtgggaaaatgtcagcgaagtgtaaatcccaaaaaaccttcttaaccaagatttccgcctgttttgaatccttaggaaaaagaacccttaaaaagagtgaagtatatgtgtatgtttctcaaacttttccagatagtatcaagcctggaaatcatgacattctctggctagcccccaagagatattttaaattccacttacaaatcaacaattttatatggggacaagaagattataccatatacatgaaatacaatctcacgaccatgcatacctgtccaaaaagattaactgccagattaaacataaaaagtgatttcagaatttttctgttaatacttatttgctactgtttcatcagctttattgctgttgtcatttgtgcttgctggtatgtaagcaactcaaaaatcaaaggaaacatctatggaagaaaaactgtaaacagagaaagttctgtgaattgactaaatgttttgtattaatcaggaaaatatctctagattacaaggcccatgaacaaagtggcaatgactgtcttattcatggctccatttcagttcctggttagtgtatctggcatattctagaagctaagcaaagatgtgtgatcaactacttgattttagctattgaacctgcctcactccaactatcagactactggaacataattggagaactactaggtaacagcaggactccttgttgtccatttttcttttttggtttttgagacggagtctcgctctattgcccaggctggagtgcagtggtgcgatctcagctcactgcaaactccgcctcccgggttcatgccattctcctgcctcagcctcctgagtagctgggactacaggcgcccaccaccatgcccagctaatgctttttgtatttttagtagagatggggtttcactgtgttagccaggatggtctcgagctcctgacctcatgatcaggctgcctcagcctcccaaagtgctgggattataggcgtgagccaccgcgcctggcccatttttcttaataagctcttttttgatggtaccatgtttaagactacagggtcacatgatcacctaccagtcttgaaagacataatgacacattcagtatgcacgttctcataatcccacctactcttgtgatttctgaggtgaccctggataagcggcctgcctctgattaggatttctgagaaggttcttgttgttctgtttagtttttgtttctttgttcaaggtcttaaaatgttaagataataacaaaacatgataaatgccattggtatttatatttgcaaagtccaaaatatttgagtttttaaatttattttatataacatctttactcttattaatttgtttttaattatataactagtgcattgaggatgctttagggttattaaaatccaaacaataaaatcaaaagtctccttaattaccatgtcaagcccagtcctctctcccaagctaacaacattgccctggtttataaccttccagactcttccctgtgctttgacatacataaatgtatatgtacttagagagatttgtagtttttgtcttgttctcattattatttctataaatgatgtaataggataccttttgctctgctacttgctgttttcatttggaatatgtcttaaagccctttccacatccgctcatataactctaccctatatttttaaccatttgtcttagtcgttcgggctgctatcacagaataccatcaaccgggtggcttaaacaatagacatttatttctcacaggtctggtggctgaaagtccaagatccaagttctgaccaatttagtatccagtaaaggcctgcttcttggtttgcagatggcctccttcttgctgtatcctcgcagggcagagagatcatctctctcatgtcttttcttataagggcactaatttcattcatgagggctccactctcatgagtaaatcacatcccaaaggccctaccaacaaataccatcacactagggcttcaacatatgaattttagggagacaaaagcattcagtccatagcaccattccatgctattctataattcaagtgaaccatagtttacttacctagtccctaactgctggtcatttaggtgatttttaatctcttggtttttttttgttttttttttttggtttttttgtttttttttttagatggagtctcactgtctcgcccaggctggagtgcaatggcacaatcttggctcactgcaacctccgcctccttggttcaagcgattctcctgcctcagcctcccaagtagctaggactacaggcgcatgccaccatgcccagctaatttttgtatttttaacagagacggggtttcaccatgttggccaggatggtctccatcttttgacttcatgatctgcccgcctcagcctcccaaggtgctgggattacaggcatgagccatcgcacctggccaatctcttagtttttatacattgctgcaaaggtatcttatttgaggcccaccatatacatgggcaagtgttactctaggaaaaaatagtgagaaatgaaattgctgggtcaaaggacatgaacacttaaaattgccataaatactgataaatagcattctgaagtggctgcaccaatttactctcccacaagcaagttatgaaagaaccagtttccctaaacctctgccatcatcatcaaactttaaaaccatttcaaatcgaattagtgaaaatggtttcccactgttgttttattttgcccaggagtattctgaatgtggaaagtcaactacattgctgctatttaacataatttttctaactctatttcttgccctcttctccccataaataggagactttacctaagtagatagtagtagcagagacagctagctatcctcctaatctcttttccttgggcacacacctagactgtgtttcccagacttcttggtggttgtgtagagacttactactgggttctagccattgaaatgtaaatggagtgatgtgtaccgcttccaggactggcctataaaaaccttccgcacacaatcttccatgctgtcctctcttccactggctggatataaacaagcatgatgagcgtagaagccacatgttgaggatggcagaaatacagaggaaagaggaaagatgcctgggtccttgagtcaccacttgaaaaagagctattcgccaatcctgaacaactgttttggatttaatgtgagcaagaattattcaagcatttgtggggttatttattattattacagcaaccaccagtattgtggtgaggattagctcattaaaatgattgcaaatgctataaaaaacattgggaaaataatcagggagtcatcctgggcatataggtatacctcccagcacagaatactccatcttacaaactgtctaaagaattaggagctatctgaaggaaaaaaaaaaaaatccctggcctatgtcacaggttagctaagaaaagagatttcttccattttctggtccccactgtgacctaagaactacttcccagatgactccagttgttggtcagcgcatcaggcttgagggaccctgttcccttggaaatgtcctgtcagacatcagagtcaattactgcagagagtctagatgctgcagaattgtttcatctgaggtcaacgactatttaaaatgccatttgctattaggaagctgccctcgagctcagggccaggggtgaagctaccacatggttaccaggttatctgttgaagttgactttctgtggcatggagaaattgcccgaggtagagtcatgcccagcatttctcatgaagcacggctgcccagccaggtgactgtcaaagctatttgtgcaggctattgttccatagctgcgaaaggaaaccaacccacccctccaggtgacccttccagccccttctccattgggtataagaactaaaattggctgggcatggtggctcacagctgtaatcccagcactttgggtggctgaggcgggtggatcacctgaggtctggagttcagccgtgcccaacatggtgaaaccctgtctctaatttttgtaaaaatacaaaaattagccgggcgtggcagcacgtgcctgtaatcccaggtactcgggagactgaggcaggagagtcacttgaacccaggaggcagaggttgaagtgagctgagatcacaccattgcactccagcctgggtgacaagagcaaaattccatctcaaaaaataaaataaaataaagaaagaaaaagaaaagaaaaaagaaaaactaaaattaaagtcttcataccctgattacattccaataatgacaacaaacagtctatgcctctggctgccctgggaagaatgagaaggaatgggactttaaaaaggactcacccataagtcacatgcaagttagaaaagatcaaggagccagactatccagctccttccaccatagcagcagttttcaaacaatcaaataaaacagtcaaaggagagcaagcctggctgaagacaaggagaggaggacctagagtccctcctgtttgctctaccccatacccatgtgagtttctccctgggaccctggggctctacagagaacagtttaaaaacaaccactccaaaggcctttacaggtgacccatccaaaagtctagcaggaagcaacccccaggttgtacagcacctcacccaaaggtggcagaccaccaaatgtgaacctggaaatcttaacgttggaccataaagccaagctgcttagttgctttttgcctgttgtactctgagtacctggcttggtatccatcacatatcaggcacttaatatttggggaatgaaagaataaaggaagcttagtctttgaattgccatcactaatagtcacagcatattggccacatagcatttcacagtttatatagtactttcccttatattgtctcattcaatattcagaacctactatgatgtagtcaagatagattgtcatttaatagaaacagaatgtcagagagatttggtgacatgctcagtgccacaaagctagtcccaaggcagttgcaagactggaaccacatcttcaggctccaagtacccgggctctttatcctaccctcactgctgagactctgatgctgccatcataatggtagtacccgtggtgatggtagcatactattcattaagatcatagcaatatgcaaagcacatacagactccagtccctggccataagcacatgcctggttggttagctcccatggctacaggttctgtctcttcacactgagaaaggtgatcctttctcatgagcatagatcacagagcccatgccaaatagtggaaatgtttatgccagaggtcacatgggggtgtgtgtgtgggaagaatagagagaatgagcagatcagcacaaactcatcctcatgacctagaaaccaattcaaagcccaagtcctacttcatatgaaaagtcacatctgggggctactcaatcttggaaagggaagcatgagcttgaaaactacagttcctgggtcctggtataagtcatgaacttggtccatataactcacagattgctgatttagtgttcagtaagcttagggttaaacaccagccccaccagcaaattttgcaaaggctgccctatttaggctccccaccacctgccacgacctttagaatcaatttcaccataaatctcaaaagctcacctacctctaagtcagtcctcaagcctgaacaggaagcaagtgtacaaagggtcctgagtaaaagagaacaaaccacccaagtcctcagactttcttctgcttctagattgcccaatttattctccttgtataaagtagataaaataactcttccccacaaatggccaatgctgtgaatgcattttcacccacaggactctgagccccccaaaataaagctatttatttggccttcacgattttttcttctttgttcttcaaacttgtcctctacttactttttctatctcaaaagtgagggctaggcaatttgaaagaacctaaaccctccgacggggtacagaccgatgacttcagcccaagagaggtggagagtgccaaatcaagcctctctgggttgagagtcatgcaaccacatgatgaaagcccctccagcccagcacagtgctggatcctgaaggagcagaattatgaaggtcaagggatccctaactctgctcttctgacatttgtgtccttaaaatgcaacaactacctccctaccctgctaatacacattatgtgagttcatctccaataaaactggttaattctgcaatatttcaaggggatattcccctctctctaggtactatcttttcacaccattcacatagatcctgtagagcattgatcctctgtcacatcaagcaccagagagaccatcacagaaagcaggtctgagaggcagggtggagtgtgtggagtcctaggcagttacaggcctgagatcccctggctttcatcaatccgttcatcctcatgcatttggcacatgtgtaccagcactgtgctgagtgctataggatgtaaaggagtaaaataattttcatactatcactgcaaaagacttgcactgtcattgaagaagtcagacacaaagaagtatgttggaatggtagatcaacaacaaatatccacatattgctgcatacttcataccagtgtctcccctagggactgggatacagcaaagaccacgacagacaaaaatcctgctctcacggagtttacattcttgtaggaaatatatttcagggtttgattgtggaattcagaaaacagtcatcagtaattaagagaaaagatctgagtagtctgaaatagaagctttaagcaggtcttctcccctcacaggcctctctattcagtttatcccaaactgaattcatcacccttacccttatacagaacccagccttacaagcaagaaaactggtggtataccagatgatcccaattcactctccttcccttcactcaccaccaccaatcaagtaggccttgtagactttaccttctaagtacctctgaaatctattccctcctccacattcccactgccacaaactaggtcaagccctcatcacatcatcttttcttacctactgtagtggacactgtcatgcacagcccagattccctctcaatctagcctgaaggacttttgcctcagctttgagagtgctgtcggtgctcagccttcagctattgctatagtttggatatatgtcgctgcccaaatatcatgttgaattgtaatccccagtattggaggttgggcctggtgggaggtgattggatcatgaagatggatttttcatgagtggtttagcaccatccctttggtgctgtccttgtgatcatgagtgagccctcgtgagagctggtcatttaaaagtgtgcagcatctccccacatctctcttgctcctgctccggccatgtaatgtgcctgcttccactttgctttccaccatgtgtaaaagctccctgagccctccctagaagactgcagaaccatgagccaattaaacctcttttttttaataaattacccagttccaggtatttccttatatcaatgcaagaatgacctaacacatctgtcaatccctaatgggattgcttcagctgcagagaactgtctcactcaaggtgcatgcatctcagcccaacccaggatatagctctggagcaccctatggggtcatctgagaatgtgagtgagcctgcatcacagaacaacatggtactctgtccgtttcctttcacagatgttgatcccaaggaccctccttaataaagggcctgcatgctggaatccaatctatgatgacaagaaaatttcaatggctcctgactacctgctctaccttggctcaacccttcatcaatcccacctctgaatatctacaaaagttatatttaaaatctctgtagtttaacttttagttttattgaagtactacagtttatgaaaccatatataactcatggctcataaagaagaatggtattccttcccaacacccatcccatcaccttctgccatttatttttacatgtctaaataacatgcttatgcttctatttgttgatgtttttcagttttagatacctgtcaacttcctattatgaaagatgaaggtttagatcttttacacacacacacttttcctgtcttcattctcctgagattcttatatcacaattttcatggcttttgttgttttgattctatataacattattcacagctgatccatggtgtatactatgattacatttcttttcctgtacagttttgtttgttttccaaggttgtcttatttgcttagtttttatgtagccttcatttctatcatttgaatgtatatgtcccacacacacaaattcttatgctggaattaagactcaatgtgacagtattaagagaaagtgattaggtcacgagggctccacacttatatatgggattagtgcttttataaaagtgttcaagtgaactcactaggcccttttgcccttcatcccttccaccatgtgaaggcacagtatttgcttcttccaccatatgaggactcagcaaaaaggcaccatctttgaagcagagaacagccatcatcaaacaatgaatccactagcaccttgatcctggacttcccagcctccagactgtggttgcataaatgtctgttctttataaataacccagtctaaagtattttgttatagcaacaagaatggactcagatactctcactaatatctctccaaaccctccaccagaatatttcttctcaatatgtttaaacattcccggtcttcaatgcatttaatattttccttcttggaggcattcctcctgaggctctctctcctctttttccaatatagacagaagccttctaatcctgctcaatagtcctcatccttgtggaacacattttctaacagcttactgtaaagagtatacaggtggtaatactttgagatctgccttcctaaaaatttattctatcctcatatttgaggtactttggttggatataaaattctaggttcaaaagcattttctgtcagaattctgaagacatggctccatggtcttccaacttttaatgttgttgatgagaagacccatgctctgttgactcctgctcctttgtatttctctcttgctctgtctctctctcgctctctctctctctctgtttctctctctctctctttttctctcagcttttaggctctttatatggcattttgaaaattcatattttctgttagagtgtttttttctccttgattatgctgaacattcaacagatcattttagtctggaaacttatattctttgaacatgtctttttgtttgtgggtttgtttctaaaaatgtcctctctctctctccctcatttcctctcttctctttttctaaacatcttttattttttggatctcctggattttctttatttttctcttccatttcagtctctaggttaatttgatctaatttctagactttcctcaactctgtcttgtaactttctggttaagagttatttctgttctcttatttttaatttctgtgatcttgttctctgaaactccttgttttacaaccttctgttattgttttatgaatgtagtattctgtcttacatctcaaagcattttcatcatgaggatattttttgttttccttctacactacgccttgcattcatttcttctgagttccttctgatttgcttagttcaaattctgtctcatgttaaaaatatttcttcagatgtcttatgtccttggctgtctatttatattcaagagtgaggcactcaaatgctgattgaaagctctgtcactgtcttttctgctagttgatctcactattgattgatcaggtatgcccaggcccttttgtaaggagaccccaagtggtaatacctttagatcttttctcttgggtggattgttttactcagagaggaatacttagaactcctgccttggacagataaacctaactaccagcattccaggaagctgaatggaagaaggggaataagaggcctcagtaaattggctttaactcaacctcaccatcaattttatctgatgactctgagtctagagactctcttgtacgacttctccagagaggaaagcttcattcctgcactaaagtcatagatagatacctgagtatgtagacttgtaaagggcatctggtaggtcctattctattattctaatgctgagtgcacattaatctcctcggaaacattttttaaaactgatgcctagaccctctcctgaaccattacctctgagtttctggagtgaggtcctgacctgcatattttttaactcttctagatgaaactgatgcatactgaggattgggaaccatgaatccaactgcatcttataacaacttttaactgtttctcctattgccagccagtgtcttagcttgggctgccataacaaaatatcatggactgggtttaaacaacagaaatttattttctcacagttctggaggctagaaaactaagatcagcattctggccaacttgattttcagtaagggctcttttcctggcttgcagatggccgccttctcactatgtcctcacatggcctttcttctgtgcatgcatggagagacagtgttctctagtgtctcttctcttttttttttgagacagagtctcgttctgtcacccaggctggagtgcagtggcgcaatctccgctcactgcaagctccacctcccgagttcatgccattctcctgcctcagcctcccgagtagctgggactacaggtgcccaccaccacgcctggctaatttttttgtatttttagtagagacagggttccactgtgttagccaggatggtctcaatctcctgaccttgtgatccacctgcctcggcctcccaaagtgctgggattacaggcatgagccacctcacccggcctggtgtctcttcttataaggccagtaatcctatcagattaggaccatgcccttatgacctcatttaaccttacttgtctcctaaaggccctatctacaaatacagtcacactgggtattgggcttcaacatatgagtttggggaaaacacaattcaatttccatagcacacaatctataacagaaaacttcagactctattgcctctgacttctgattctttctgaaaatcactttgcttcttggtttttctccagcagagttttcactttctctgcactgctaagtcatttatcatgtgccccgttgcttttccagcttcctcaattttgtaaacattgtttgtccactttgggtttttttgtttttttgttttgttttgagaatgagtctcactctgtcacccaggctggagtgcaatggcacaatcttggctcactgcaagttccaccgcccaggttcacgccattctcctgcctcagcctcccaagtagctgggactacaggcgtctgccaccacacccggctaattttttgtatttttagtagagatggggtttcactgtgttagccaggatggtctcaatctcctgaccttgtgatccgcccacctcggcctcccaaatagctgggattacaggcgtgagccactgcgcctggcctttatttgactctttatggtcatgtcagtggagttttcggaggaagtagaaataaattaagtgtttgatctgtaagtttacctggtattcctcaagaatgacattgttaaactgcaacctttattatgactctccctaactaaaacccttcaacttcttcccatgacacacagaaagaactttcaaacttttaaaccagaacacccatagtggcagagaattaacatgtgtattcgtaagtgtctgggatggagtccaaaagactcaaccacttgcataaaatttctttgaaatctcacattttattttttaaatatatgcagattttgcccctgttccataatggatctgtttgttttaatataagaatattattttaaattacttggcatttaaattgcttccctttactttctttcttcaatcttcaagtcaaattgatgctttgaaaaactgatcaatttatctcattactttgtgtatccatgagacacatacagtttaagaggcacagcccttattcttaaggtgccttagtcctattgagtcctcaaaactgggcccagtagctggcttctagaagataatatacttaacaagtgtttgatgaatcaactgaactgaataatcttgtaggaagggtattatttggatggggagtagggagataggcatttccagtagatcatttagctaaaccaagctctagagggaggaatgaacacattgactagtgagtgtctgctctagatggtaccccaggctggaagtttttccaaatgctcttatctgatcttttgccctgagattccagggtagctgtgtccctgaatgagcctttcactgaaatagcttcaccctaacactcaactccatagaccatcccccaaccccatggtctcatctgctcctcacccacctctcctcattattcctgggatgattaaatctatgctacatgtccaagccaatgctagaagctacatgcttggaagtagggctgatcttacactaagggacatagtcagatgttccaacttcaagcactctcctttcaattcctttcttttctactcattcctctcaacaaaactctaactgccgaagaaatatgagtgggattggattaattagtggaggaagatcgggcatagtggctcatgcctgtaatcccagcattttgggaggccaaggcgggtggatcacctgaggtcaggagttcaaggccagcctggccaacatggtgaaacccccgtctctactaaaaatacaaaaattagtcaggcgtggtggcacacacctggaatcccagctactcaggaggctgaggcaggagaattacttgaacccgggaggcggaggttgcagtgagctgagattgtaccactgcactccagcctaagcaacagagctagactccatctcaaaaaaaaaaaaaaaaaaaaaaatggaggaagagcattctaaatttcttaggtagaatttctgaaattagagctcatggtaggcaagaaaatgatatatgtaatggaaatctttagaagtaataataatagaggatacacattaactcatttgatcctcacaaccctataaagtagctactatattattcccactttacggatcaggaacctgaagcccagaagtcacacagtgagcaaatgctggagctgagtgtgagcttagatgcacctggttccagagttaggctcttactcattatctacctcccgggatagaaatgtagcatccatctctacagctcccaggctctgagatttcacctgccaagaaaatttcaaaataatttgggggagggtagataatcacaaaattgccaagtttatattttgccaaataagcacattaaaaataaatcccattatcactatcatttcattttttaaatgacttgttaacaccgcaagatgggaagaagataatctcaggataaaagcagaaacttaaagggaataaatttagacttatgaaaaataggacagcctcaacattttccccattttgctgaagaccagtggaaattatctgggacctactgtgatccttttacagcatttggagccagagattagctcttctaatctctgtgttctcaggacacagagctgagtctctaggctgacatggagtggaaggtggggagacagacccccagcttcaaccctgggaacatcacaaggagcgaaaacctgtgtctgctcctatccaaggcattctccattctaaccaggctttccacactcccttcaactcaaaatattcctgggtcaagggcagtcagtatgtagggggaggtgggcgaagagatggggagagaaaaattaaatcaatgaagccagtgttctgagtgggctgcagacagcaaaggtctaaaattgcctgagacagaggaggacaaacacaatttgctccaggtgattgagaaaacagtggggcttgaggttctcatttttttttttttttttttaagacggagtctcactctatcaccagactggagtgcagtggttcgatcttggctcaatgcaatctccacctcccaagttcaagcgattcccctgcctcagccttctgagtagctgggattacaggtgcccaccaccacaccaggctaatttttgtatttttagtagagacagggtttcaccatattggcaaggatggtcttgattttctgaccttgtgatccacctgcctcggccttccaaagtgctgggattacaggcgtaagccaccaccccccaccaaggttctcattcttgtgcagattgttcctttctcagtctactgtgtcatcaaggatatattcaggcactgaatagttaaaggcaaggatctggtcctgaccattttatctccaaagtatttttcacgtttttcccccagctgcgtccctgactctgaccctcatcatctctttgttggaccactgaagtagctttgctccatgtccccatagcctgtccgtctttctccagactaaattttcagaaatgcaaacctgtgattcgcctcctcccatcagtatcttctcccttgtcacccaaggaatgaagttgagctctcccactcagcacacacagcaactccagcacatcacacacacacacacgcacatgcaccacactgcaccacacacacacaaacacacagtgtatggcagatgcacctgacagcaataacttaaacataccctgagactggccctgtggtctaagaagagtgctggttttggagttccaagctaagaaatccaggagtggccagcctggagcctcattccttatctatgagggtcatctaaacccttggcccattccttggaatgcagggcacacagggcatcaaggccctttatttagggttaaatggaggttgctaggttgaggttcccgggtagaggatactaagtgaaaatgctatgtaaactgcatgctttttacaaacagtagcagttctcctgtccagcccactgccactagtctgcccatatgtaaggcttcaataaaccctatgtctcattcactggctccaggtctcttctttggcctctctgacatggttccatccctactggagtgagtaggggtctgacacaacacacatacacacaggaacactgccccagcacacacacacacacacacactacacacacacatacagaaagccatacttatccacaacatcctatcccactctttgccttaaattcaatactccagaaacatagaacttcctctagatcactgaacaagcgcccctgggcctttgcacatgctgttctctctgaatattgccctctcccttttccacctaattctattcacccttgcaggcctcactcaggtctcagcttctcaaggagcccatctgagatccccttctggccaccacctctcacgtagtctgggacacgtggatgtgcctgcatgccttgtcatgatggcctctgtgatggttaataccaagtctcaactttgaaggatgcaaaatattgattctgggtgtctctgtgagggtgttgccaaaggagattaacatttgagtcagtgggccaggaaaggcaggcccacccttaatctgggtgtgcaccatctaatcagctgccagtgtggttagaatataaagaaggcagaaaaacgagaaaagacgagactggcctagcctcccagcctacatctttctcctgtgctggatgcttcctggcttcaaacactggactccaagctcttcagttttgggacttggactggctctccttgctcctcagcttgcagacagcctattgtgggaccttgtgatggtgtgagttaatacttaataaactcccctttatatatatatatatatatatatatatatatacgtatcctattagttctatcgctctagagaaccctaatacagtcactgtgctctgctgaagtcatgtgtccactgcttcctccttggggtcaaaggtcatagcgtacttagttttgcactctcaatgccagcacagcacctggcacagagtaagaacttgaatagattttttgaactgtatacttggatttagggatatggcccctgtccccaggagcttgtaaattggctggaaggatgatacacccacaggcatgaaacattctaagacaaaatacagtgctagattcaaaataaccaagagatagaacacacgatgttcccagcaattagaaggaaaaaacaatgtgagctgacattgctaagaggtttcctggaggactgaagaggaagaaatgccgtgacaattcctcagctccccaggacgggctctttctgaccccactgccctgcaccttgccccatgcctctgtcaggctggcctcaaacccccaacgaaccacggaagatgcaaaatcacacaacagcaacagcatcaggaagttccacgtttaatacttaacaacacaggaattttccaactaactccggaagatgtaaaatcacacaacagcaacagcatcaggaagttccacgtttaatacttaacaacacaggagttttccaagggccgggttattgaacttgaaataggtaaatgaatggcatgtatttatctgcaggcagcaaagataggatgcaactcttccaggaggctgggggatggaggaggcggttccagggatctgttaggagaagccctctcaacagaactcagagggtagagagcttcaggagtgggcatcccctccaaaaggctccaatgtgcatagggaggtgtgaggaaaagcatccactatcttgcaataacaatggaaaatgagtgcaagaaacattcagctcaaagactcccatccaatacccaggttggctcagctctgcgcaagaactccaagcaaaccgaagatttcatagccaaaagccagaagagctcctcagccaagaggcttctgggagtgcaggggcctaggaattggggaccacaagaaaccaggcagagggcagaggagagaaggggctaccccaagtcaaggagggaagctgaggcaccagcagcctggacttctagccacatgggttgggagatcccctgtagtctgatgtttcatgggtggggcttctggggtatggttttctaagaatctgtgagcttcagagaccacatcaaggaagagcccccccaggagtgattggttattatcccacactctcggctccatcccatggttgctatgaaaatgcccaaatgccctgaggcaagtgggtttcaaagcacagccatacaaggcccagggagtagcagccagtcacctgccaaaaccctgctctgctgttgcccttccagattcacgtaaagccttggaaggtcagatttcatatgatgccaccccacatgcttcccccactgcagcccaataaggtggccttgtttgagcagagaaaggacttcccagcctagcagttctctgagcttcattctcttcctgaaatgctactggcctcaggcactgaatcattctggtctcccttgtgcaaacccaagccaaccctcgccttcgctatttgaatgaggttgcagagaccacagctagctgcatgcaaaggatgcaggaggtggggaggtgggaagaattctgctccatccagctcccccaatatgcacgtcctccctcccaggaagctattgcctcaagtcttcttgatattgtttgacgctgaaacagtgctttgtagaaatgcttggaatgacaaggatgagagagagggaatgcagagatagatggctctaaaagtccattcccaaagagccttttgatcattctcttggctctcagctccttcacccttctctttttctgtctatcccctcccctattcctcatcccccattccgctctcagaccaggaccacaatttgtatgcacaatccttccccctttccgtggctgtgaaaaggatgaattaccttcttgatctcaacgtgatggccctgtccaagcaccccttcacctgctgtgtccgtaattgaagtgtggtctctgaatctgcagctgtcacagaggacttgacaaagagaccagagcagggtcctgcacataccaggctctccttggttgccttgagcacagaagaatgcaattttccacaccctgcacaggtggaaggccacacgacgttctcagtcactggaagtgctctttaactgggagcaaaatattagcaaagatgcccccagacttgctttcagctgcccctcatcccagctcctgcctaagaaaattctggaagactgaaagaagccatgcttgtcttccaagtctgagaaacccttggcagccttagcattggcctgtcctatgcctcagtttccccacttgtgatgtagttactccagcagaaaatccatcaacaagcaaataactgaaaatgaggacaggacatcccaaaacctcaggtgggaggctttgcctcatctcccatgcctttgcctccccatctcctatgggctgactacagagacttccctcctccactccctgcccaggtcctgaactaatcctgagacaggaagcttgtacgttggctcagtttctttctccccactataaagttttcttccttggttccaactcctaaatccaaaaatggatactaagcaggagtttcctggcctctgtcagtcctagagtttgcccacagccccacagtcagctaggctccactgtcttccacagcagtgcttcctgacagcttttgaccagggcccaggctgaagcctgggctctcatccacccctagggtctgtgctgccacaacggagcctccactcctagcgcacagcctcctccctacacagctgtgtgtgcaagagagactgtggtttggtttccccatatctgtccctctatcacgggcagctctcatgccaggcacagccctgtgcccatccctgcttaccccatgaggtcatgagcagatcaacacacatcatagcgggtttaggcctaggatggttggaagactaagtgagacaatctcagtaaaactcctatacaagaaaatgccagggccgggcatggtggctcacgcctgtaatcccagcactttgggaggctgaggcaggcagatcacttgaggtcaggagttcgagaccagcctggccaacatggtgaaaccccgtgtctactaaaaatacaaaaattaactgggcgtgatggtgtgtgcctgtaatcccagctactctggaggctaaggcaggagaatcacttgaacccgggtggcagagattgcagtgagctgagattgcaccactgcactccagcctgggtgacagagcaagactctgtctcaaaaaacagaaaaaagaaaaaaaaatgccgaccatttgtacccatggtttctggtctatcacatcttcactctcttttaccctttttaccctgatcacatgaaataaaaatatatatatatattaatggtaaggaagcatcttgagcttagagggagcaagacatgctctggtgtgtgtctagccagaatgtcttagcccgtggggacaaatgctcactgacattcaacgtacaaagagcaatgactctgagccccagcctgcttaatcacaggacatcttatcttttcaagtctccagatattcctaaggtcctcaggaattacacccacgtgtccagcacttcccagttccagtgggcacccctcgcatggtgctctaggggttggcatcccagagcagcaactctgcagcatctgggttatatcaaagttcaccatccaaggatggactgagaacacccatcacggtgctgagcttataacccaggccagtgggcccagaatagcttctctgtctgagattcagtgctgatccatcctccatatcctgggtgcccagatccagggcttctcatttaaaagggacagtgataactcttccagtccttaggcctttgtgctaatttttctatagcagggtagtctgtgcctcagtttccacttccagcccaaagggaagatcaaacctcatgctcttgcgtcctctgtttctattttcctgaaagcagctcccaacctccccaaactctcaccatcatgaccatgtatacactgacatcattgtgtgtataagaaaaagcaagaattcaggcaaagtaaaatataatatttgccactcagcttgtccctcattcactgaagccctgccaagaaccatgcgcccccacaatcaccagtagtaaaatgttcctaaaaagaacatttatctttccaggctttacctctgcgttgagtcaacactgccgcctcccacccctacctggttccccagcgtgggtggaactgaaggggccattcagggggtcttgcagaacaaaggattaatcttctccaaaataatgttaaagttttcatctatagctaggaaacaaatgcaagcaattttccaatgataaatttcctggcttctacactcaaattgtaaaagtcttaaagccatggcacccacttccatgtgacacttgtaaatttccagaccatgatgagagtcatgggtagaaagggcaccacagaggagactcaagctccagccccagccctttctctaactggcttcgggtaagaacactgtccaggttcctcatctgtgagtcgaggggattcagctagatttctaaggattgcagagctccaatattctagcgttgcgctatcattcatgataagtaattataactaagacaggatttggccttgacaccagcatctgaagcatacatgagatatctctgttattctttcccaaagcagaaatggtgctctgttcttgcagaggatcaggaagagatggcagtgagccaacagatgttcctggagtatctactgcatgccagaccacgtgctgggtgctggggtacacagtgaccagagaagacatgatcagcatagaactgacaaccaaagaagttatggctttcagggatctttcaattggtaggagaaacttacactaaataaatgcatatagccataggttacggaatgcatcgcatccccctcaaattaatttgttgaggccctaagcccaatgtgactgtatttggagatagggcctttggggaggtaattaaggttaaatgaggtcatatgactggtgtccttataagaataggaagaaagaccagagcttgctatctctgcatgtacaaagaaaaggggttatgagagcacacagagaaaaggcagccatctgcaagcaagaaagagagctgtcaccagaaaccacatatgctggcaccttgatcgtgaacttatggtttccaaaagtatgagaaaaatcaatgtttttcagttacccaatctgcagtattttgttatggcagcccaagctgaccaatacaccatgtttcatcaaatccaggacactattgaccttgtgacacaccattgtcttatgtctactgaaaaaaaaaaaaggggggggccctgccaattaaacacaattacttcttatcacttagaactcttacacttattgaaaaactcttttagaatcatttagttttgtgttgctcttatacaggcaaaaaggggaataaaagcaaaataaattaattacactgtccctaaaacttcttattcagtgtcaaaggcttctgaatcactttccaactcagacttgaaaatggcaccacggatggatgatggatgaggctgtattttctaaaagtttgctccactattgcttccaagactttcttccaagttcttgacattcatcatacaaacggatgttgatgcttccatgcttgcctgtgatacacaattcttgcacactaatgtaactgtaacatagcttgatctccttgtggactctttctttctttgtccttatattaatctgctcaggctgccataacaaaatgccacagcctgggtggcttaaacaacagagctttattttgtcacaattctggggaatgaagttcaagatcaaggtacaggcagctttggtttctcctgaggcctctctccttggcttgcaaatgaccaccttcctgctgcatccttacatggcctttcctctgtgctcacacatcccttgtgtctcttgttgcaaggacaccagtcatgttggatgagggctctatccatatgaccttatttaaccttaattacctccctcaaaggccctcttttcaaatacagtcacattgggggttagagctccaacatgtgactttaagggggacacaattcaggctacaacagtcttgtaaagcattttgttgtcactttgcaagagaatagtgatcttatctttcgaataataaaaaatttgctttgcttgctagcatcaaattgataccctgctattccgttttctttctatataaactttttgtttcggtaccaaattagagtgatattgttttttaagaggtattctaaatataaactaaaccccagatatgcaatgtcaatcatgcacctaactccactggagggacgacaacataagtacccatgaccaagtctgtgcatgctcagacaatgatcacagcagtcaatgtggctgtccagcccacagcatcataagatagcatttaaaagtgagacacatccccctttcagaaatgttaaatgtggggaaatgtgtgtgtgttttagatgaaatatggtaaaataaataaataaataaattaggatatccatgtaattcttgtgcagtttgagtttttaataaatttgcttctatataatatataagcaaattgcaaagtgtgacagaaaatgaatttactgaagatttcaatgacatttttaatgatttatttgttctaatttctttctttaattttctaggtaataaacccttctgtatacagaatggttctatccaaatatatctaaaatgatgctggatatgtcgaaagccaacatttctgtaattaaatatagtaaattatgattaaatttcctctattttccatctagcagtttgtattacagaaataaatgtattaaaattcctaacagcatacaaaccttagggtaaccctgtatagtattaagtgattgattacaagtctacagaatgctgggatgaacagggttgcccttaagaaagaatttctcaagctgagacccagaaggtgagttaggagtcagccagggagaagggatattccaaggagaaggaacagcatgcacaggggcctggagagagaaactagggaggaggcagacagacttgaagttgagggcgagggaggggggaacgacagggcacagagcagagatacaggcagaggccttcctgggcccacctcaccacttctaggcacatcccagagtgcaagaaggttgctcactgcttcagtttttataacagcaaaagattacaaacaatctcaacgtttcatccataaggggctggttaaagaaactacggttcacccaaacagaaatttttagaaagttccaaaaaaaaccaacatggaactctttattgctatgcagtgatctccaagacaaattaagtgctagatgcaaaaggtgctagatagaaagtgctggatgcaaaacagtgagtatgatacgatataatttgtgttaaaaaattaatttacacatgcttatatgtgctagactatttcttgaaggatacacaagaaattaaaagggctggttacctccagagaagggtattaggtggctggggatggggtgggagggagaatttcaatggtctgccattgaatcttttcagacctgcaggaggaggagggggaagaagaaagatgttttaagtggaagggcagctcatgtaagactgtggctctgtttgtgggaaggcttgcatgtggacaggtaatgatgaagctcctccatgttccttcagcttcctgcaggatcctgtctgtctggtattgtttttctgctgtttcacacagagatgctctttgagaaagatcataaactcctcaagggcaggaatcttcaagtgcaagttcagagcccccacagtgcctaacacacacgtgaaacacagcaaagttgtcttaattccagccgccaggtgtgctgactcacttgaccccccagcccccaccccacacgaagcagcctctagagtctgccccaaacccaaatgctgcataatcaagctggaggaattccctcctcctagaaattccagcccagtctcagaggccgcattagaactgctctttgtggttaaaatgactttcacaggcaccaaggggaagggtttccaaactgagggttcacaatccaccagtaagttgtgaaatcaatttggtgatccaacaagccttttttaaaaagaatgagggcctggcgaggtggatcacacctgtaattccaggactttgagaggccaaggtgaagattgtttgaggacaggagttcaagaccagtctcagcaacacagcaagaccccatctctataaaaaaattttaaaaaattacccaggtgtaatggcccatgcttatagttcctgatactggggaggctgaggcagaaggatcgcttgagcccaggagtttgaggctgcagtgatctaagatcgcaccactacactccagcctgggtgaaaggagaccctgtctcttaaaaaaaaagaatggaaattttcaaaagtcagaatatatcacacactagtaaaaataagtattattttgtgaaaatgtttaatttcaaatatgtgtgtggatagtgggtcatcggtaaaatatatttattaccgtgggttgcagccaaaagtgtttgaaaggcagtggcctagaggagtgagtgagcaaatggctccagagttgagcaaagcttagttcaaaccccacatctatgattttgtctccctggcaggtgacttaacctcctctcatggtacaatggagacagtagcaacgcccacctcatgggacggttgcaaggtgcttaggcttagcttgaaatcttggcttaacacttgataaatggttagcactcaagaaacattcattatcactatcacaaccaagaaatatgcccttcgtcttgctcaagaatctctggcaccaaagcaaacaatagacttggtcgtggcctgtgttcctggctgccccatggctcttctgcctggcagcttctgcccagtgtcctccttctcactccacagggagcaattggctccacagcttcctgcctcttcaccatcaaaggggctgggtgaccagaaaggcgcatttcaattcaggggagaacattactttactctaataggacatttgctatcccagccccctttcagcattggttccagggaaatagatggtcccagccactgtaattccttcgtgatatatttaaagaggaagatgatgaaggaaataatggcagtcgatctgtggttggaaagaatatatgatgtgcatgccccgtccaaaattaatgatgaatcaatatctgagaggcagagaaagtgctttattaggacctttgacaaaaaggacaattaggaccttgagacaaaaatctcaaggcccacctccctctctctctcatacttcccaaaccaactgccaaccctgtgtgcccagctcaggtacaggtcaagagagatgggcacagctgaaagcctgagggtattggagagaccaacagatgtttcccctcgggttaggaccacacccagtggctctgggtcaggaagcactgggatgccttctcaggtgtgtcagcttagtttgcagagctgagtgtgggccacaggggcgagccacctgttactaacgatgcccattaagaacctacaatgtaaccagatgtcaagtttcatgcagccgcttcctttgccctcatttcatggtcccagtctgatatggtttggctctgtgtccccacccaaatatcatcttgaattgtaatcctcataatcctcacatatcgagggaggagcctggtgggaggtgattggatcgtgggagcagttttccgcatgctgttctcatgacagtgagttcttatgagacttgatggttttacaagtgtttgacagctcctccttcacgtgcgctgtctctcctgctgccttgtgaagaaggtgccagcttccctttctgccatgattgtaagtttcctgaggcctccccagccatatggaactgtgagtcaattaaacctcttttcattataaattacccagtcttggttgtttctttatagcagtgtgaaaatggactaatatacagtttctgtaagaatactgggagaggatcttaggcagctgtggctgctatggcccactggtaggggctcatcttatgagtaaagaaattcagatgtagagttgttgaatgcataaaactagactggaactaggacccaattcccaagctgctgccggttccacagtctcacagacacaagttgggaagagcacaaagtgatgggcacacgtaaggtggcattaccatcaagggaagcgaaagcagtaagagctagaatgattggtcagagcagtgaggaagagaacaggactgtaaagagagaggagccagagacaggcttgattagaaactcaggactgaatttggtgcttgagccagtaccttaaattccaaggtcagaaggctttgtgtggatctgaggggtcatggacatttgcattcctgctgcttgccgccccagcagctggcctgatttccatttctaacagtggcacttgctgtggaggtacagtatattatggactaattaaggctgttaatgatagtggcaatccattaagtgatctacggtattattctgatctttctctgtcacctcctttcatcaggccattaaggtgacaagcttcatagaacacactaatctcccctctgtcagtcccttggtgtttttttccctggaagagctacggactctctcgggatgagtcatccgaggatacagctgaagggctggactcaccaagctcctcctccaccctcagtctcttccactcagaacacctgggctcatgggaagtctcttttgtattccctccctgttatggactgaatgtttctggctccctaaatttcctatgttgaatccctaatctccgatgtggtggtatttggagatggggcctttggtagctgtttaggtttagatacggtcatgacagcagggtcccagtgatggaattagtgtccttatgagaagaggaagagagaccagagtgctctctctgccctgtgaggacacagtgaggatggtggccatgtgcaagccagcaagagggccctcaccaggaaccaatcctactgataccttgctcttggccttcctagcccccagaactttgggaaatcaatgcctgttgtttaggccactcagtctgagccctactggtgggctcatcttatgaaagaggatatttgagatgtagagttgttgaatgcatgaaactaggctggaactaggacccaattcccaagccactgccagttccacagtctcacagacacacggccacacatacgaacacacactgtcatacactcacaaacacatgctatcatatacacacacatgcattcacacgtacaccaacatacacacacatgcagtcacacacatatacaaacacacgctgtcatacactcacaaatacccacatgctatcatatacacacatacactcacacatacaccaacatacacacatacacgcagtcacacacatatacattcacaaacacatgctgtcatacattcacaaacacccacatgctatcatatacacgcatatacactcacacatacactgacttacacacatgcagtcacacatatatatacattcacaaacccacagtcatacattcacaaacacccacatgctatcatatacacacatatacactcacacatacactgacatacacacagacatgcagtcacacatatatatacattcacaaacccacactgtcatacattcacaaacacccacatgctatcatatacacacatatacactcacacatacactgacatacacacacacatgcagtcatgcacatatacactctcaagcacacactgtcatacaatcacactatcatacacatatgcactcacacacttacatacacagtcacacatatactcacatgtatattcatgaacacacacttccatacactcaaaaacacatgctatcatatacacacgtacactcacatactcacacatatgcagtcacacacatgcatatacattcacaaacacatgctgttatccactcacaaacacccacatgctatcatacacacatacacactcatacactcacatacacacagtcacacatatactcacatacacactcacaaacacacacagtcacaatatactcacatacattcacacaagcaattacacacatacatatacactcacaaacactatcatatacacacatatacacacacagtcacacacatacacatacactcaaaatatacactcataaacacacactatcatatacacacatacactcacacacatccacattcttccatatatactcacgaacacacactgtcatacactcacactcatacacttacatacacattcacacacagtcacatatatactcacataaacactcatgaacacacagtcatatacccacaaacacacatatactcacacacacacagtcatatatatactcacatatacactcatgcacacacacaaactcacaaactcagtgtcatatacacatatacacacatatgcactcacacatacactcacgtacacacacacttatgcatacattcagtcacacatatactcatgtacactgtgtcacacacacatatgcatacacttacacactcacacatcgtgtatgtccttctaagcacagaaacgctttccatttccaacagtatcaataattcctgattactgagactagtgacttacagaaccttccctttttccaactcttaccaatttttcagtgacataaaatatagaatttggccatttcccatggggcttcagccaagggacatcactaagagctgtatctcagctttcctctgccttcacactctcaacagtaatgctgctcagtatccccagtgatccctaatgagggggctcctccgcccaatgctttttaccttttcggggtaattaaagcagaagcattcaaggtttcagtccccatgttccctcctcaatccagctccagaggggaaatactggtctgattgggctgtgtcccaaaacgctgggccacgctactagtgggcaagatctccatgcattaaggtctccatgtggtctgcatctcat

SEQ ID NO: 2641 - DNA, 3587 bp, Homo sapiens; identical to SEQ ID NO: 763

SEQ ID NO: 2642 - DNA, 1048734 bp, Homo sapiens
atgtgaaatcagaagtttaatatgacacaattaaatatatttgtatatctcacaccggaggtttctcttcaaacataaggagttagaaattacaagtaggcatatgcttcctatattcagataaattcatttcgattaattaaattccagatagagagaagtaattttggaaaagaaatgatagctatattaaagcagatattcattacaataccatgtagagacataagcaatattttggcatcattctgtccgctcagtaggccgtgttccctctggtagggcctttggagagtaccatctatctaagatggaggaatgctgtgggaagggcgggatggaggtgcgttttctacgctgaaccccacacaggaaatctgcagcccacacagctgcctctgtgccgccttccatgtgatcatcttggtcaatgaagtgaattgtcctatttctggggtagggggtgatggcgaatcggatactcaaatgttattttgtcaaatccgaatcatctctacgtgcttaggtttacatgatgtcaaaacacgtggttcattaagtgatcccgggaagaggggcagggccggtcggctggtttctcacttcccttccaggctctacgcagtgcgtgcaggtcgccctgatctcctctcccgggagggaaatgctcgcagccctctccgagttgccctgatctccttctctcccaggagggaaatgtcccctctctggggccccacaggtccgggacgtgcctggaggagccagcgggggcctggcagggttcgtgtgctcccggggaccctcatagcttgctcaatgcccagatttgttcttcctggttgtggttatctcacaggtaagcattcacgggggcatctgttttcataacgtagaaatcaatattttaacattaaaaacacatctcaatgttggggtgcatctgtaactttgcaaaggtgaggtcaggggagtgccagcctcaagtgggcactactcatggggtgcacaggtgtctgcccccggggagcccctgaatcactctgcttgggctgacaggtgtggctgacggggccgtccatggtacccggcgcagtgttgatggagacgcagcgaggagctgtgattgtctcacttgccccgaagctgcaggacgttcagttctgtccctgcggcttctcccaatgataaactctctcaaagagaaatgccaaacgtgccttgtgtgccgggcggcctcactgagtgctgccagcttccccggccactcctgcacagtggatccaccctcccgaaagtggcagatgacaagcacactcttcctggaaaccgcctcgaacgtgctggctactgcattgttaacacaacttcaaccaagaaggtgaacgggtgctttaagaaaaagtattttttttaagcaagtgaaaattgatgaaccgattcccctccacccgtaactggatttttccacaaatctctctttattattgtttgattaaacaaaaatacacttttaactgctaaactgcgctgactacgggagagctaagggccctattactatgcagttataatagaagacacacaattaaagtcagatcatgattcctgacaacatccgtggggtgggggctcccctgaggcccctgaggctgccgctcactggggaagggccttgaggatggcgttcacctcctcagccacggctgtcagcgcgaactcaaactgctcctgcagggcgagaaacgagagaagtgccaatgagagcggcgtccccccgactcctgccacagcgtcggctccctgcagatgaaagcggcgtccccccttcccaacgcagcatcagctccccgggccatttcgcagaaagaaattgtttagcaaaaaaaagcaaaaggctcagatttccttagaaaggacagtgtacccttcggtttgggagacacaacagtgacacatgtttgagcttctctcgcactagaaaagcctcatctttccccctgcggggagaagctgcccacagaagcagcgagaaggcaacggttcctgcgtactgccctgtccttctgaccctacgactccacgattcctcctcacagccacccgccttggtggacggtgtgaggggcaggtgcagacactacaaagacgtggccattaaaactcacaatgagggccatgcttgggcgtttcctgtcctcggaagtgtggtgttatcatcgcttttgaaatccacctgttactcagaccaaacccactccgttccacatgctgagaaacctccccttgtccacacccctcctggctcagggcatgcgcgtccacagccacttgggcaggcacacctgaggggcacccctccctccacggacagcctgccgagagcatccagtgggcacgagggacgggttcacgatgccaggactattcgctcctccaaagaccagggcttagcgccggagagcgtatctgcctcctctcccacagatgaggtggataaatgctcatttcctcttgctcttcagtttccacctcaaaacactgctatggaaaactccaaagcaggccagcagcactccagctacagctgagaacgcgtggacggaaacaacactgttacccagctaacaacttctggaaggaaagccctgttgacagctccaatacttgatcatttaaggaacagggcagccccaagccaaaaacgatgattaatttccagttttgaatgtttagtgcataacagaaagatggaaaatagcttgaaccgagacatcagaaagtcaaaataacgtgatgctcattctgagacaaaagacagtttctcctttcatattcttctgccctgatgctgacggaatggtctgctggactctacctgcctttggtagtgtggccacgcggcctcttagtgtacgtgttagaacctattattaaaggagtcaactgagcctggcggccacctcagggtgggacccggggagatgtgtctgcctgcgccccgtctctctcccctctgcactgccagagggcacctttctgctcctcgaaattacgtgggagctgcccctgtgggggcaggggctcaggtcgggctgtgccgggaaggtccgcaaacgttctgtctaaatgctgactcctgcccctcccacaccaagtgtgttcgatgaaggtgctgtttaggggatccaggctaaatacacaacagccattcagaccatttcttccccagtgctgggctgccagtgccctgaggctctgtgagggcttggagatgccaaaaattaagcgtggctttttgggaagcgaaatgcaagtgtcatctatctatttacatcttccgacacactggaaatctagcctgagaaatgatctttaaagggaagaatagagaagcgctgccgccccgcagccccatcatgcagtggaggctggaaagcgctccacccccagggccagtgctaatcctgcagagctgcccagcggcctctcaggcagccacttgcggcatccaacaggaaagcccaatatccatgctatgggggaggggacgggcagggggaactccaccagggtctggatcataactgtttccaacactgcacagtcaccggacagagcagcaggaagggaaccgggccacagagacaggtgctctactcactggccatgtttggcaattgttaccgcactgtttagctcaaaggagaagctccaccgggcgtgtgggctggtgtgtgccgtgcaccttactcagagcccactgggccctgtgggcgtcggctggcaggaggagggggtgcttcccggaggggtgctgtgagcctcagagctggcgtttgaggggacaggggcttgtggatcatcttgtcctttatcgtgaagtgtcagctgcatgcggcgccgggatgtagcacccaagccctgtgggtcctcgaaggtctgtggccacgttctgagcagaatccgctgagcaagtatcacctagaaccatgctctagatcccgggtaggctgggaaaaccccagcatttggataacttttatgataggagtttatttcaaaggagtaaaatacaacagcaacagatgaccagatgaccatcttagcctaaactgcatctgagtgccagcagtctgaacaggaggggtgcaaagcctcctgggtttgcaaagacaggacattcgagaggccgagtcaggacattctaagcaagaaagcatttttgaacacatactacaataaaatttgaggcctgttggagaaagatcccacggcttcttccagtagaactgcacccggtggagaagtggctgaggtgggacggccgagccaggctcaggccaggtcaggctgtctggtcaccacccctgggtccacgctggacagcgagtgggaacgccccttctcaggctgtcctgggacaaccacggggtgcccacatagttggtggagggatggaggctgcaggagctgccatggctctcggacacccgctgctggggtaagggtcagccagggctggaagccgtggagctttgtggaggctgcttggatttctatttgtgcttatgtttatatttgtaatccttcaggtgtaaacaaaggcctgggtggagatgtacaaataggaaccttaaagaggacctcagtgatcgtgtctctgagccacctgtgccctccaggaggctgcacacataactgcggggcagcttcccccagcacctctcaaaagggggtgaggatgacacaccttcctgtgtctgtcaccttcagcttctcttttcacaaaagtagacaagctccaagccacaccgtgagagttgagccctgcccaagttagggactaggcattgtgtgtgtgtacaccagggcggagggacagagacggagatggagagagatgggagacagatggagagagacagagagaggtggagagagatggagagcggtggagagagacagagagaggtggagagagacggagagaggtggagagagacggagagaggtggagagagacggagagaggtgaagagaggcggagagaggtggagagagatggagagaggcggagagaggcggagagagacggagagaggtggagagagacggagagaggtggagagagatggagagctacggaaatgaacagtttcaatggcacgggaggccttgggagaagtgggctgcgggcctggagctgatgtgtgagcgtggactgcgctacgcgtgacagaatccgtgtctgtcactccggtgctgtgctgggttgggaagataggagcatgtctgggcaacgccctgcttctgggacggaggacaacaccgggtacgtctgaggaggaggctgaggtcaggctttaggacaaggggctggtgcagaagaaaatggggaagaaactaaaatgcagatgtgagacggcaggttggggagagtgacgcacgggcagcacgtggacatgcgaggggcctcccgtccagtgaggagggggcggggcctcccgtccagtgaggagggcatggggcttcttgggtgtgggacacactcatcactggctctacttctggaactgacagatgtaaaagaggaaacaccattgtgggcaggaaagtgttaaggtccttggtgaaatgggaaactcttgagacgtgtggagggaaggaagggaagaacccatcatctaccacagaggcatggacgggagagaggggtgatttcagccttgtctggcatcccttgtgtctgctgagggtgtgtgcacacgggaatgtgtgcgggtgtgtgtgcgtgcatgcagctgtgtgtggatgtgcatcgtgtgtgggtgtgtaggtgtgtgtgggtgtgtgcagcagtgcaggtgtgcatgggtgtgtacaggtgggtgtgtggatgtgtgtgggggtgtgcacagctgtgcaggtgtgtgggtgtgcagggtccatgactgtgtgtgggtgtgcactgtgtgtacacctgtggaggtgtgtgggtgtgtgcagtgtgcatgggtgtgtgtgtgggtgtgcaccccgtgggtgggtgtgtaggtgtgtgtggggtgtatgcatgggtgtgtgcaggtgtgtgggtgtgtgcagtgtgtggctgagtggtgtttgtgggtgtctgtgggtgtgtgtgcaatgtgtgggtgtgcgcagtgtccgtggctgtgtgtaggtgtgcactgtgtgcaggtgtgtgcgtgtgagcagtgtgcacggctgtatgtgggtgtgtaccacatgcgtgggtgtgtaggtgtgtgtggggggtgtgcctgggtgtgtgcatggggatgcgcagtgtgtggctgagtgtgggtgtgcactgcgtgagtgggtgtgtaggtgtgtgtggatgtatgcatgggtgtgtgcaggtgtgtgggtgtgcagtgtccctggctgcgtgtgggtgtgcgcagtgtgcaggtgtgtgggtgtacacagtgtgtgtggctgagtgtgccgcctctctggcggctcgtgtggtgtcaaagcccgcactgccgttcagcccctgggtgcctggacttctcttctaagatgatggagtttgtggtcggggactgagttgccaaatgctcaggtgggcgctggtgaaacattttctattcgacccaaattccagggaggaaacagctctcctgaggggcatcttttttaccacaacgatgatgttttgctgtcagggcctgcggtcatcctggtcatggtctccgggtgctcaccctcgacggctcgctctttccttgtcttcagttccaaaccaggcgacgtgacttcctccgttcaaaggagctgcaggcgcctcctcttggcttcgtagaagcaagcattcagattggacagcagcattttgcccaaataatttttctatctttgtgaaactgaacttgtaggggaagtttagtctcggggcgatgttgggcagcgcagtcacggattaagatgtgatggtgactttcgcatggttccatttccttatgccttgaagttccaggagctgaatttatgtgcatgctccaagacagctcctgaacacacaccctgaggaagagggtgaactcctccggacgcccagtccaagaaggaagcagctaggaagctgactctgttatctggagtgcagaaaacggagcttcgggtcaccaagtgatctgggcaacagggctggggtgtgtatgtgttatcatcttgctatttatttatttatttatatttaagttctgggatacatgtgcaggacgggcagctttgttacataggtaaacgtatgccatggtggtttgccgcacccatgaatccatcaccgaggaattaagctccgcatgcattagctatcatcctgatgctccccatcccccttccccactgacaggccccagtgtgtgctattcccctcccagtgtccatgtgttctcattgttcagctgtcatttataagtgggaacaggcagtgtttggttttctgttcctgtgtttgtttgctgaggatgatggcttccagccccatccatgtcgctgtaaaggacatgatctcattcctttttatggctgcatagtcttccatggtgtatatgtgccacattttctttatccagtctatcattgatgggcatttgcgttggttccatgtctttgctgccatcttgccatttaaaaatggagtagaacggaagacctggcatgtaatgattgtgactgtggcttcctctttctctgatgagtcccaaagcacctcacttcacgaagggtcctgggaccaccgttgtgcacctcagccatctgtgtgccaggaagggcttgttctggcgaacaggatacatacaatgggaggcttggagggtttgctccttgtgatttttttcacttttggcaaagatatccccttgcgatgattttgcccagacccatcctaaagccagtgtgtgttctgggcaaactcacctgtctggagggaagaggctgcctgacaggcaggtgttctgggtgaactcacccgtctggagggagaggctgcctgagaggcaggcagaggtgtggggaggaaactactttgaatttagatttcctggggcttatcccagagtgggcctcactgtggagtcacgaacacacctgcctgaggtggctctcgctgaccattcctggtaatgtgtgccccgttctcccagcctccatggcctcctctgtccagttcagagccacctgaagctcacgggatgcagggccagccagaaggtggtatgtgccagccttgacaaggccacctcttttactgctaggcagccagtacaggaggatggtcagtgcggcaagatggacccttccaaggttggacccttccatggcacaaaacctggaactccttggtacagagaggccagacacacgtcaacctcacgtccagttcctgttgagccaaagctcatgagaacttttttgttttgatggctgttgctgctggaacagcagctgtcccgtgtcacctcctctctcgacagcctcgcaacacatgccgaatgctgttgtgaacaagcagaaggaaagacagacatgtgcacagtcccagcttctccccgcgggacactgagtaaccacacagggaaaaatcatcacgcagccacgcagaagcctccagacacacacgcctcagtgggtgtagatgtgccgctccctcgtgagggacagtcctgccccctgccctgaccatgggggacgtgggacacgcctagacaagagacgttccacaaagagcaaggccgctggcgctctagaagacctcacagccgtgaagcgtcccggacagcagaggaaccatgatgcccctcgcgtggccgccctgggcgtgtcctgctccaggggaagctccctgggggggcgcgtagggcatcgctgggcctgttggtcagtggtttgcatcggtgctgacttcctgggtttggtcactgcgctgtggttatgtgaggtgttcacatttggggaaacttggtggagggttggtggattatttctgcattttatttatattttttgcttgggaggctgaggcaggagaatcgctttaacctgggaggtggaggttgcagtgagctgagatcgtgccactgcactccagcctgggtgacagagtgagactctgtctcagaaagcaacaacaacaacaaacaaacaacaacaacaacaaaaaccgaataaaatatagtgtcccaagacttacaaagaactttcacaaaatcacgtgatggtcctaccagttgcacagagagggcgaaatgaaaccaaggagcagagaggccaaaggcacaccaaccccagcctcagggccagagagaccagacacacgtcaacctcacgtccagttcttgttgagccaaagctcaccagaattttttttgttttgacctctgttgctgcaaactgggcctcttcagcaagcatgagggattttgggtgctcaaggatgctgtgccctgggggcctccacaaagcgcaggccccggagaggccgggcagcgctcagagagctcagaacatcctcctgagggttctgggatttatcgtcaacctctttctacaaaaatgcagcgttctccccccacccccaaatctagtgaatggaaagagccagtggatcgagttcctaggacttgagatgtggctgcatctggaggtgttgcaggaaacgccagtggacctttgggggcccagaagtgaccccgcccatgcaaggccggcatggacgaggccggtcagagcagagcaatcggtgtgcggctcacattaaaccaggccctccccgtgctcctctcaggaacacggccgcagagaggcaccttgaatgggtctgcgtcccggaggagagactgacagtaccttcgtctggaccatgccgggtctctggtccctcaagtgctccagggtcgctgcgatatcaatctctttagcacctgcaacaaaccacaaattgggctgagttcagagcacaagataatccatgccacatctgtcaatctcctgctagccacgttccctctgggctgagaggccaattgaaaattattacgctcatccctcagccggctggcaggcggctgcaatttcagtgttcatgtagaagacgaaggcaggggcagctttcattagcattaattccagaaagctgggctgaaaaattgttataagatgcttaccaacagcaggccgtcaccgtcagaaaccaaagctgtactggttttcttttctttcttttctttttttttttttttgtgacacttcagggaatgtagtacctcatagggagccatatacgaactttaactttgattgcataggattacttttttatttaaagaaataaaaaatcagattaatttagattaatggactcaaccttaatattggcttttaactgtagagttttctgctttttaaactcaaatgttccacattttgggactgggtaaaggtgcccgtagctactcccagctcagtggttcaccaaaagctccatcctcctgtagacagcaccgatctcacggcaggtgatgctggctgcactcaaatcatgctacttaagttttaaattttaagctaataattaattcagcacatattgttatttttccattttgctaggttctttagtagacagataatgagcaagacagggtcccgacctctccagcgtgttgcagttgagaggggcagacaggacacagccgccaggatgagaaacacagagaagtgtgggatgaggagcaggaggcagctccgaagcgggtcagaatcccacagggaaacccacatgggtgccaggcacttcatgtcacctctaccgaacacggtgaactgagaactgtggtcacccgagtcgcagatgaggaaatagagacgcggccaatggcatgtccaagccacagacaggaagaagccgcagccattggaaccccaactaccgtgggcaggacagcgctggccgaagacctgaggaggcccgggtggcccagagtcaggtggtccccaggcctttctctccggccgcaacctgagtgcacaccacattcctcgcccagcgaatcaggagagaagctttaaaattcccgaggttcctcaatttcctttccctgtggttctgtggcttcatggggtggcaactgtgaagccagtgggggctcaggctccaggaggatcatcccagcagggtagcaggtgcctgcgaagcacctccaagtcacagcaggtgcctgcgaagcacctccaagtcagaactgcgggcagctaggagggaacggcaggggtggcggggaggcctggggaggacacacgttggaaccaaatgtcatgtttgcatgaagggagaacaaagcaggtggtgtggagaatctggctgtcaggacagccccacagcggctccaccagggaggccgggcgcgagatgaccaccccacctgccctgcctggctggtgggtctccccacctttgagcacagaagatggagacactggcatttcctggcaggaacagggctcgtggtgatgggagccactgtcggggctaagctggccgtccctccagctcccatcccctggttaaaggaccccattctcctgggcagggaacaccatgagggccaccaccttttaagccagagcctctgcaggcataaaaggcggctttcttttgcggcagcccgtgagctcggccaccagggaactagctggcagctcacgcgggtggaaggcggggtcaggtgcacgggtttgcttaattgctccttttgggtctccaaaggcctaaaaagtcgacaaggctacagtaaatacaatcttgttttaaaagaaatccataaatttaaaacagcctgacacaaacgggtgagtttgtgaaatggtagagaggaagggaggaagccaaaggacccctcctgcggccatgactgtggcggccaaggaagccgcttcctctcctcctcctcctcccacggacactcctgcagttggtgcctacacagcagaatcatggcagaaacgacgcaggggaactggcctctctgagacaagcttgtcttatgaaagtcaagtccctgcatggagagcgccaggttagtctcagtgtcactgcacaaacattcgtgcttgagccaaaacaactcagaaatgcccatattgtctgttgcacccgtgactgtacctttggtaggagctgtggcttctggacacattgaacccagaactgtgctgcaatttaaatgtgaaaaataccacaactgtaggcagaaggataaataagctgcaattcacagcatctttcaagcatctcaagttggtatagaggctcaagctaaacacagaccccagctggggctcacccaaaggaaggccgctggccaccatgtaccccacagacactgtgcagcccacagccagcatgcaccccacacaccccactatcacacaccccacacaccccacagccaccacacaccccacgcaccccacagccatcacacaccccacagccaccacacaacccacagccaccacgcatcccacagccaccacgcaccccacacaccccacagccatcacacaccccacgggcaccacacaccccacagccaccacacaccccacagccaccacacaccccacagccaccacacaacccacagccaccacacaacccacagccaccatgcaccccacagccagcacgcaccccacagccaccacgcaccccacagccagcacgcatcccacagccaccacacaccccacagccagcacgcaccccatgggcaccacgcaccccacagccaccacacaccccacagccagcatgcaccccatgggcaccacgcaccccacagccaccacacaacccacagccaccacgcaccccacagccaccacacaacccacggccaccacacaccccacagccagcacccaacccacagctggcacacaccccatgaccaccacacactccacagccaccacataccctacaggaaccatgcactctatggccactgcacaccctgtggtcactgaccacacaccccacagccaccgtgtaccccacggccaccacgcaccacattctgcttgattggctctttagaaatcatccagaagaaatggcaagacgtttgctgtttaattaccacgtgtaaaaaacaataacataactaaatagcttcccgataaaaataattctatgtatttttacatatttctatgtacagggaaacctgccctctcatttagaagggaagtcatcgtgcaaagcggctggccgtgtgaataatagctcagaaacggggaaatgtacaggctccatctaacactgggtctcgtaactcctcacacaccccaactgctgacctcagcgagatgctgacctggaccacgtggggaggggatgggccgaggtgcaggatgagggaggctccatgtgctggggcctcacacccacgtttagagcacgctatttgtctttggccatacgctgctgggtttggaaaccgggttctaatacacaaaatgtattacaaccagtcttgtgtaattaaaaacgtaagatgtctattggcttttaagaaattttcccaaaaccaaaaaaggtgagttaaaggcaggagtgctggggttgccgacagacgtcgagttgtgtcacatgacgtggggaagctcgggctacagtgctgaggtgtgggtttccgctccgcgtgcctatgctgggcctggccgggaagctggatgggccagcctcacctctggaggggctttcctcccgtttccagggtccagtgagggtccagtgagatgacgcatgattacgtgtaatttacaaaacacatttgatgctcaggcaacctcacagatctcgtgagcaaactcttctgggagacagtgaaatccaatcagttatgttctctgaagccttccaggcacgaggacagcagcggcttctacggggacccctcagctttctgtctcaggagtcatgaacctcaggagaagcaagtgtggtataaatagtctgactcaagagacggggagctctcagccctcctgagacatcacgttgagggttcatctgggccacagagttaaagcctctctccgttaggtggctttagggtacttgctttcagtccctgaaacttcttttttaaaacgactgtcaacagcaatgtcatctgaagggctgtgtgtatgatggtgctagtgggaatcctgggagactgtccctcactggcaaccgccctcccgaattctggccggagccatgaagccgtcaggagctgtagcaggtgtgggcgaggaaggggctctccctccgcgtgcactgatctctggagatggctgttgctggcggctgtctcccagagtggcgtcgtcgtcctcacataaaatgtgatggataaagtctctcttatttcatgacatcgtggctccctctcaggctgtggtttgtgaggaaaagtgaaaaaagggaaggagaaagacttgccgggccatccccagacaacatggggagaaccgggcggaaatacaaaatgacacgggagcgtgcctccgagtcgcgctgagcccgagaccaaaactgaagagcggaggaaacggagttaacgcttaaaaagtgtgcagcaccagcattaggtccataatgatgtagcaggaaaatcaactgtctgctgtggacggctcctgcttcttgcatgccaggattaagactaactccttacttcaagtgtggtggagacagaagctttcatagagcccatgcatgagatctttcataagggacagaccctggatagccaggctcaggctgggcgccgtatcctgcccgctctggtgccctcctgagcatgggtacggccaggccgggcgccggatcctgcccgctctcgtgccctcctgggcatgggtgcggccaggccgggcgccggatcctgcccgctcgcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataaagcacctgctgggtgggtagggtgggatagggtgggcgtgtgtcccccttcacttgataaaaggcttttcttagtgtcaaaggattcatttaaagcctccactgcatagaaagctccctctagtgcatttaaaatagaattctctcttgaaaaatccaattttgctgacaaggtgaaggagcagctaacgaaagttaaattccagggaaacagaaaggcccagtggtgtgacgctgacatcgaaaagcctgcaaacagtcgaggagtcagcgcacacacaaagaaaatccagatggaaggaaagaaaggaaccttaacgatgtctaccggggacagagcgtggggtccacggagaagtcccaggcgttttccacctaagaagcatcatggtgattcaaacaccagggaaatgaatggactcagtggagccactttctgctacttgaccaggtttaattcgagttgtccatgtcgggaatctacagggaagtgacgcaggctgccatcttgctcagcaccccagtgtggcgggcgccccagtgtggcgggcgtcccagtgtggtgagcaccggccaagtcagtttgggttgggctgcaccctcgtgcctgggacacccaggaagacccacctctctcgtgttagtggaccagggaggcagccacagacaccaggctctgcgtgctccgctggcacccgaatggccactgggtaccatcccgtgccaagctcagcaaatgtaaatcgctctcattgttattttctaattcactcagggctcattgggttaaaagtttatacattggttaaatacatttgtaagacaacagagggtttttttttagctttagataaaaaatgttaaccattaaacaaaagccattaaaagaatattagtattaaagtattaaaactatctgtcacaatgaaagaatccatttgaagttaaagaaaaccaagcaaatatgccaccggtgtctctttccaaggcttgtttgatttctcctggactctggctcttggctgaccgagctgtgtgattcagctcatggccctagaccacatcctcccagtaaacagtgaacacggacggatggggtgtgccgggagggccatcgtcgccgtctcctgaccgtcattcttccgcatggcttccggcagcctgttcatggataatgactgcatgagcgcaggtaagttttattacaattttactcagaggttttgcaaactgcagggatgcaatgtattctttttttcttgaaagtaaaaacgacaatgtgtgccaagtgttcaagagagagaggcctttacttgcaggagaaaattttctcaactctaccctctggaagaactgaagaaaagcttggtcctaactaaatgcattcaaatacatgacgaatggtgattattaagaatccagataaggaacgaagtggaacagttcccgtgccccaggagcgcagagctcctcactcacccaggctgcgatgtttctgctttgtctggagctcacgctgtgggaggactgggctctgaagggcacagacaccccatctttctagctctccatgtcagccgaggtgaccccagaactggactgggtgcagaggtcaagctagagcccctcacgtctggcagagcaaaactcggctcaaggtaactgtggttggggatgctctgggtgccccacacggttcaagccctccccagacctgggtctcagggatgccacttggcactgactacacactacacgcatgcagatacatgtacatgggtacacaggcatgcacacaccacacaacactcacccacactcacatcatacatatgcacatgcacacacacagaggcatgcacacacccaaacaacacacacacccacactcacactcacgtcatacatatgcacatgtgcacacacacaggcatgcacacaccacacaacactcacccacactcacatcatacatacgcacatgcacacacacacaggcatgcacacatcacacaacactcacacccacactcatgtcatacatacacagatgcacacacatacacacacaggcatgcacacaccacacaacactcgcatccaccctcacgtcatacatatgtacatgcacacacatacacattcatgcacacatccaaacacacacaccccacacatcatacatatgcacatgcacacacacacattcacacaaacatgcacaccccacactcacatgtcacatacacacatgcccacacacatatacacatgtgtgcacatgcccacactacactcacaccccacactcatacatatgcacatgcacacacacatgcacacgcccacaacatgcacatcccacactcatgtcatacatatgcacacacaaatatacacacagccatgcacacactcacacaacatacatatccatgctcacatgtcatacatatgcatgcacacacatatacacaggaatgcacatgcccacatgacatgcacaccctacgctcatgtcatatgcacacacatgcacacacaatgtcatacatatgcacatgcatgcacacacatatatacaggcatgcacacatccacacaagatgcacaccccacactcatgtatcatacatacacacacacacacagatatacacacaggcatgcacatgctcacacaacatgcacacccacactcatatatactcacatgcatgcacacatatatacacaggcatgcacacaccacacaacacacacaccccacttacataggtcatacatatgcacacacacacacaggcatgcacacaccacacaacactcacatcctacatcacatgtgcacacaaacacccacacttcacactctcacacaatacaccccacatcacacatgcacatcctttatacctacattcaggatcacacacatacatcatacacatgcatacacacagaacactcacagctcacactgcacacaaacattccacacccatatcacacactcatacaccacacacatgcacacacctatgtgcatgcacacacaggtacacacggcatgcataggcccacacaacacccacacccatcacacacactcccacacacacacacacacacactctcctgggccttcagtgctgagtttttacttcacacctttcctggatgatcttaactaaagacttatgaaaattataagcaggtttttttttgctgaccttctagataaattatattgtctatgttgtaacatattgctgggatcaaaggaggcaaatctgcatcttattcacttgaaaatcaagtagatcagaatcataacaaactagctatttcttatgtttttttttcctttgaacaaattctaaatccttcttttggagaaactgaaatgcctccagatccttattaaaaatataagttaaagaaaatgtagaagtgtatgaatgagtactgtcattttaaagtcaccatccccaatactccaggaggacagggaattgtgcaaaatatcctggtaagtttctatcgactgctggaccatcccataatactgttgaggtgctggcagcatcaacgcggagacaccggacctctgcacccctgtgcaggcgagcacagcttcacaattcaaggggggattgttaaaagggaaagacgaatacgatggctccacaattccgagtcctatctgtgtgtgaacacgtgcacattggtgcgacgcggtgcccaccgcagtttgctgccatcccacctacctgccctgcacaaccagtgccagggcaccggggcaggaccgagatgcaaacgcagcgtctgtgctgacagaagaggtttgggagcagcacgagagccccaaggcaggggactgctgaggtacatcctggagcatccgtgtgatggggcacacgcagtcattcccagatcagtgcagagcacacacacccacatgggggcctccacgatgtggctaggtcctcaacacctatgtcagaatcaacaagcatgtgcggtcaatggcgttcaggaggccgtctgcagctgagtaacaatcacaccaaattgtgaatattgaacaggtggaggagaacaggagctgggctcacccagggcaaaccttctcatgctgcctggaacacgcacacaccacttgcaccttttacccaaaaggtgctcatgcactggtccagcggggatgcgtgaagcatgcagccagctcccctcccaggccgcactgactgctggtactgctgcttccgggggcctggcctttacgggggtctggcaggatccctcctgcaggtgcacagcccaggctctcctcccccttgctcctgtagggccggcagctgcctcggtccctctgagtctattttgggttcagaaagtgcctgggctggggacagggccagttacgcattgactcagttccgtggcttacagtgcaaacacagagaccttgtcccatgcccgtgggctcatggtcaaggacactttgcatcatttgacctcggaaacaggagaaacggaagcacaggccaaggagggagccgaggggccgcgtgacactgcacgggatcgctgcccttcccacacgcacgttctgtctcacgcagttgctgtgcatttggaagaatcttgcatgaggattactgattccacgggacagcgtgtgaccccctgcagcaccctgactccatcgggggacccccagcatcctactcaacactacgagggagccccactgccaaaaggccaggctgcatgtgcctggacttcaggcgctaggaacggacgcttgggacctgctgcctctggggacagcccctcagggtctggacggaggatgttgggcctgcgggctgggcagggatgatgctctgggaggtgcctccaggacaacagggagacccctgcagccctccacatgggcccctggaaacccaggatagggagtggcagaacacactggcgggggctggacgagcagaggaatgagggaaggacagagtgggtgggagcgagagcagaggagatggaggggggaccacagactgtgtggggagggcagctgtgccgcaggaaatggagcaaccaggctgtgagcaagatgcgcacagaggacggagaggacccagggactgagatgaaggagtgactgcccggcagcagggagcagaatcaggcaggcaagtgcgcaggccgggccagcctggaccgtggagctgtgtctccaacgggaaccttggagggcaggactttgatcccctcccgaatttccaaacaggagtttgaacagaaacatgtggactcagggaccagtgcttcgggcacatcctgacagcgacacagctgccccgacagggctgtggccccccccgccccgtctctctcctgtgttctctcccacattctcaggggccgcctgctgccagctccctcgctgtggcctcatccagctcctgctggcgtggtctgacccctaaatgtgtgccagcaaggcctgtgttggagggaggggagggcctggatgggcctggatgggctggtgccagcacccgggaccaaggagggagcttgcagaagggacagccctcggccaggtgggacctgaacgacattttgcggcatccaatgggcctgaggtgtctgcgtgaccatgaggagaagcggaggacagcccaggtgaggacatcagacccaggagtgggtgaggagcccctgcagccaggctatgtgaaccctggctcagcagggtcagcctgaccccttgaaggtgggagaccccttgaaggtgggagacctgtgagctggtacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcgatcgacaccagggtccgcctgtgccctgcctgggtggggtcagccacgcccccggaccactgctccaaccagcgttcgtcgtcagccccttacacgggacagggcactgcagaccggcccgggaacctggggacacctcacgccccacatccctcactgtttctcttgcaccagaatagctcaggggaaggaaaggcacagaaaataaacaacacacagcagaggaggccctgctcctgcccgaccgaaggcaacttctcccttgaagagaaaggtgcagacaggctccctctccccttccctcctcccacctcacccaattctgggcactttttcagcctgaaacttgcctgagcgagacaagagacactgcgggcccaacgtgtctgtgaggtccctttcccactggcccttcgtgttttcatgtttcagccaaacataaaagcgagacgtctcctgctcagctttcccaattctgcccagccctcgcgtccccctaagtctcatctgcagaaggctgagcctcatgcacctgcacctccttctcttggtgcctgcgcccaaatgtgtggctctgtctggctcaaccctctcctgggccccgtggctgagctggcctgttcttcagttccagctccattccctggccctcttagtcccgcactgcctggctggtcccccagccatctggttctgcactgcccagccatgccatcccctcggcccccgggtcctgtactgcccggccagtctccccgccctctggttctgcactgcccagccatgccatcccttcggcccccgggtcctgtactgcccggccggtctccccgccctctggttctgcactgcctggctggtcctccagcacctgcctgggttctcccacttccctgcagactccaggctgtgcccagagagagctgagctcggcggcccaggcgcctcaccactggccctcagtttcctcttcctccggtagtttccatgagagccccaaaggaactccccagcgaagctgcccctctgtccctggagccctggaacacaccacgctgtgcctctgagcgccgtccctggggccgtgtgccttccaccatcctccctctgggccctgagcctttgcagactgagcagggttctgcatctgactctggctgaccggaggccttgaggcaagtcacccaacctcccagaactgcttcctcagcttgcaacagagtggtcagaacggagggccccttgggcccccttccattcagtgaaaagctttctgtgggtcctcctgagccccaggacagcccgtgagtgaagctgccatctctgcatctgggagtgtccttgtctgctctccaccaccctgcagccacagactccttacctgtctctcggcagagcaggaagatgcagcaggaggatggggcttctctgttttgctctcacaacccacgcctggcaggcagcaggtgccaaaccagcatcagcgtggatccagcatgcagtggacgctgccctgccatcagctggagccacactttcacggtttaccctggcatctgccagagaaggaatggaccagtgggactccagagaggacagagggtgggggatgcaccctggggaggggaagggtgcgccccccacgccacagaaaagaacctgcaaagccctgagtcctggagccaaaggaggcagagtggcccaccaagggggatcggcagtggccaggttgcccagggctctggggacagctcgcccagggctctggggacagctccagggccgaggcaggcacccaaggtctttctgtctaaagcatcttactgactgctgtgtgacacctaatcaggaggagaaaatggagcggggagaccagcacacgaggggtgatggggctgggcccagggagatgagaagagggtgagggtgaagtcaggagccaccgtagtgccaccttggagccgtgtggcccccaggacctgctgtgggggaaggagtgacttccagcttcaccgcctggtgtagccactgtggctttgtcatgcagctagtacaactgaagagctgacttgtaaactttatccaattttagtgactctaaggaaccacatgtggctactgtatggaacaaggcggctctggagggctgctggccttcaaagtccggggaccttcaaagtccggggagccacaaaacacgattcgacaaagacgttctgctgtcaccacacacagcagatcaggaccatgtgctcccgcgtcaccacacacagcagatcaggaccacatgctcccgcgtcaccacacacagcagatcaggaccacgtgctcccgcgtcaccacacacagcagatcaggaccatgtgctcccgcatcaccacagacagcagatcaggaccacgtgctccacgtcaccacacgcagcagatcaggaccacgtgctcccatgtcaccacacgcagatcaggaccacgtgctcccgcatcaccacacaccacagatcaggaccacgtgctcccacatcaccacacagcagatcaggaccacgtgctcccgcttcaccacacacagcagatcaggaccacatgctcccacgtcaccacacacagcagatcaggaccacatgctcccgcatcaccacacaccacagatcaggaccacgtgctcccacgtcaccacacacagcagatcaggaccacgtgctcccacgtcaccacacacagcagatcaggaccacgtgctcccacgtcaccacacacagcagatcaggaccacgtgctcccatgtcaccacacacagcagagcaggaccacgtgctcccgcgtcaccacacacagcagatcaggaccacgtgctcccacgtcaccacacacagcagatcaggaccacgtgctcccgcatcaccacaccacatgcagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccgcatcaccacaccacatgcagcagatcaggaccacgtgctcccacatcaccacacaccacagatcaggaccacgtgctcccgcatcaccacagacagcagatcaggaccacgtgctcccacatcaccacacaccacagatcaggaccacgtgctcccacatcaccacacacagcagatcaggaccacgtgctcccacatcaccacacacagcagatcaggaccacgtgctcccacgtcaccacatgccacagatcaagaccacgtgctcctgcatcaccacagacagcagatcaggaccatgtgctcccacatcaccacaccacacacagcagatcaggaccacatgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgaccttggatttggccaatatatcttgggtatgatactaaaagcacaagaaaaaaaaatatatttttgagatggagtttctttcttgttgcccaggctggagcgcaatggtgcgatctcaggtcactgcaacctccgcctcccgggttcaagtgattctcctgcctcagcctcctgagtagcatctgccaccacacctggctaatgtttgtatttttagtagagactgggttttgccacgttggccaggctggtctcgaactcctgacctcaggtgatccacccgccttggcctcccaaagtgctgggattacaggtgtgagtcacaagaaaaatattttttaaaaagtaaactggacttcatcaaaattgaacacttttgtgtaacaaagacactatcaaaagagtaaaaaaccccgatgtaatgggagaaaatacttgcaaattacatagctgataagggagtagtattcagaatatataaagaactcttagaattcaacaacaaaaaatacaaacagcccacttcagaaatgggcaagggacttgaaatgtctgttttgctcaagttgatatacaaatggccaataagccattaaaagatgttcaacatcactagttgttagggagatgcatgctaaaaccacattgagatccactcacatccactgggatggctgtaatcaaacagccaagagataagagaattacggtcgatgtggcgattccgccccagggacatatccagggatgtgggtggacaccctcacatccacattcacagcaggattactcacaacagcccaaagccggaaacaacggcactgtccattaatacacaaatgaatccacaaagtgcggtccatccatgccatggaatatgagtcagtcataaaatggaagttagtgctgacacacaccacgacacaggccaacctcgaaggcattatgcaaagtgacatataacagtcacggaagcgcagacgcggtatcactccacttagatgaggtgcgtagtatattcagattcgcggaaacaaagaagaacggaagtgatccatccccgtaggcaaggagatgtgtatccacacacaaaatagtaccatgtccagtcgctgagtctgagagctgggtctatgcccgtgtggacaccccaccgtccactcacattcacgccgtgagactacttaggaacgtactcctagccagctgaagtttaaaaggtcgctccagcatgggctcacaagccgtggggattcatattggaacacaaaattcccggtctgtggctcctgccagacaaaagaaatgagtcaccccagactcactctgcaccttgtcaacagccacagctgctgggggatcatacagtgtctgcttggcatggcctccatggtacctggggccacacaggcaccctcttccggcccaggcgcagaccctggtgggaatgccgtggaagtttggccacacttctcagccactgcatttctgtgctggcccctggggagtgaagcctgaccccacccagcatgctcagcccacctcatctctggggagtaccccctcagtgctggttgctcctcatccctttaaaaaattgtggggaagtagaaaaataccctcagtaagtgaagtcactgacaaaaaagtaaaaggcacaaccttggaaaatatcttgcttgaaaaaaacatgttttgctacatgtgagccaagcccttcaatgagagaggaacaggctacctaaaaacagattcctacacaatcgtctattatcggtgagttagaaacgcatctgctgccacagaaatgacacgtgtaagcgcttcccagattggtgcctactttcctgccacaaaacccattgcagaacatgagcctgttgactttcattccaaactgcatcatcgtctacttgctgctaaactggacagtagagaaagaacttcaactattctgagtttgtttttaaaggcccttcaactaggcccaaaggccttaatccctgatgggctgtgtggacaagtgctgctctgctgtctgcggccgcagctgctggagctaaaagcatgcagaggccctgcatgcaggactggagggccctaacatcagcgttggcactgcccgactgcccgggaagcttgggaagggcattctctggtcttctgtaatgcattcctttacagaaagggaaatgggaagaaaggtttcacgtccaggactctgggcctttgatcatttgagaaacgctgggtctgcagtgggggcctccagcttctcaggccagacaaagacgccccgccacacgggcagggcccagcctgcaccagaacaaaaccccagcgcctctcagtgtggaggcctgggaaaggcccacctcagccggcagaggggctgcctgccctttgatctctcctgagactgtggcctgggacccgggtcagggaatttcacaccgcacacaccccagggaaagaggagcaggtcaagaacaggaggagggtcaccaatctcagaaaaggccccaggccagccctctttggccatttccacatggctgcatgcgtattgtccaaagctgagcccactctcaaaggagaattgacatcacatgccacaatggagccagtgaacagcagctcaggtgcctggacaatatgccagccctgccccccgtaccggggtctcgaacccaggacatacttctccatgtttccttctctgtggagtgaacctgagccactcagaacccaggctccatcccatccctgtggagacgcacgctggggtcacctgcgtccggccgcctgcctgtgcttctggtccctggatgggcaggttccattggaatcacaggtgcccccagcaactcaccacatcacacgttcacaaacataggcttggtcagaaacacttacatcaaatgatctgtaacgttctgaagacattttggtttaagagaagaaaaatctttgtctgagagagggaaagaagggagggcccatgataagtggagaaatacaaattccatggatggctctgagctccaatagctgtaaatttggaaaggaaaagaaatatttgacaagacacagcagcattaatggacaaggaaaaatggacttttaaatgacaaaaagttaggattgtgtcatgtccaaaacaaacaaaaaaaggattaaaaatattatgagtgtttgcattttgtttttgtttgcacattcccaccactaaactaatcttgggtgtttaaaatgacatttggtggcacaaaaactgatttcatttctccccagcagccagcaaaggatgctggcggtgttgggtaggtgtggggtgtggggctgggctgcagccctcccctctgctgcaggacgctggagaacttgcccaggctctccagtccttctgcgtaaagccatggctgttgttttatcttcacatatttatgtctttttttttttaaccagaagaaaatgaagtaaggaaaatgcttattttaaaattgctggcattcgtggaagtgtatagaaacttgtttctataatcaatggctgctcctgtcactgggccagtgatggagaatgggatgttacggaaggcggaggtctctgtatgaacacatatacgtgtgtgtgtgttgagacaaagggaattgtttattcacagctgggaaagagaccgtaggatgctaccacctcggtgcctcccaccttccatgggacgctaacgggtatcgcaaggctaatgcagactcttctcaagtaagtgtcggaggcgccaactgaagggaagctggacacatctctctgccctggactccttgggacctctccatgcacacctgccctgtgatgcccaaggagcagactcagtgtgtgcctcctctcaagctcacctgcctggggagccttctctctggcccctatttaaagagatgaccttagaggttgggtattctggagaccaccttttgagaaatgccagagctcaatccccatgcttttgtaggagaaaattggatcccagagaggttaaaagctctgtccaaagtgataaacctcattgctggcagagccagacccgcgcacagatctgcttttccacgctgctgctggacccatcctcgcaccctgcgcctcatgtctaagactccccacgccgtctgcgcatgctgccgctctgccaaacctgtccttctcccaccacaggcctcaagtctaagactccccacaccgtctctgagaggaacgcctcccacagcacgcacagagattccctagataagaaggacattcacaaagagggctgaaaggctcatttgagagggggtgattgacatttgatggcaattactaacggatatttttagtgtgcctctagtgtgaataccgttttgacaacagtggagttacaccaaatactggagcggcattctgcactgcaacaacactgaaggacccgagggtggcttctccgtggctctgaggttaacgctgcagcgtatgcagcaaacacctgtcaaggacccactgtgtgctcggcacaccaaggcaggtaacaaaggacccagtgcatgctcggcacgcagaggcaggtaacaaaggacccactgcaggctcggcacgcagaggcaggtaacaaacgaccagcctcagaagcagatgtgcttgctgcaaaccaccttcctacggcccagcagaggcacaacaagcagcgaattttttccagggcctcccgtgaacacggcaccctacgttgccatagcgacgccatcccagctctgagccgcaacaaagcggcagtgtctgtgtctcacctttggccatcttgttgagaaccatgtcgatcaggacgtaggtgccgctccggcctgcaccgtcactgccaacagaaggagagaaatgaaagtgctgccgtccacacggaagcccgacccacaacaaagctagtgacagttcatttccttcctgcttacgggggccggcgagaggaaaggatggcggatgtgagagggggaggaaggacgcgggctgggagaatccaagtgaggggagaagggaggcccctgggggcttcgagcctctgagcagcttgtagcttgtgggatgagctgctgtgctcagatgtgactccctcttgcttgttcccccctctttggccaaagatgtggtaaattttgccagaacaaaatgaactaagcgtttgactgtgtcagagttgatggcatttgtattgaaaatatctgcaaggtgccttctctagtgttgccgggcaacctcccgagcggagaggggagggcgctgggcggctgggccccgctggctcatgcacgcagggacacttcaggcacatccccctaggctgcctgccaccccttctaaacgcaggtcctccgtctcagaaggagaaattgacataacagtcgttactaaatcttactctttaaaaagcactctcatttcatctctttctcatcccaccagctataattggaatatttaccatctgggctagagttgtaaaaatgttttgaataatacttcaacagtagcaaaggaaaaaaaatttccctttttttctggaagaagagtagcctcaggatcatccttttcttatgaggaatgtgtgaagccatttcctgcccccgtgcagacgctgtcactgggttgcatgagtttgagagaccttcttaaaagtacatagggctcgtgttcacacccatgactggcttttaaacagaggaccttttacatttataatcctagcaaaatcaattgtgactttccggaaaacgaataaatgtttccatttcaagacttcaagaaagatgtgactacccagcagatatcacactttcggttctgctttctatgccgtctgtgatcccaagaaatgactggaatcctataggtgatcttttgatggtaaagaatcagcgcattttggctttaacatgtttcctcaaacaaatggttgaaaaaagctgcagttgggatggtaaatgtttaaaaaacggcacgttcacatcctcacaccctcactgcatcaccaaggaggagaggcggtcggcctgggccgccacgtaaccctcactgctcatttcaaagggccacggtgagcattctggttgctgagtgcctttctcacttgtctcctatgcacagcatatattcacatgaatattttaagatatacttcaaaaatcttccaactaagtgttgcttgtcttgatacatttgtgggtaaaaaagatgttctactctactctgtaaggataacaaaccgtaatctattttcatcctcctctctcatagacaggaatgcacacacaaaacacacatgcttcttgattggatttgacagatttggtgtttgttctttggagacaggtttcctttttattccaggcaggaagaacattctataagacagttctagaaaaatggaatatgagttcttcaccaaaaggagttgggtatgaagtccagcagagacagtactattaggttgagttttctttgcgtaaaatctattcttactggtgtggttttaacgtacttagggatatgagtcactgaatttttacccagaggcctgaacccacatgataaactggaggtggctgtacctcctgtaatgacagatttcgtccctgtacataactggccccaagcatttctcaccatctgcagagggttctgagcctctgctggacgtcctggtggttgagacaatgcaacaggctgaaaccattgtctcgatgtttctgtgtcatgggaccacagggtttaagaacaagcaaggtggcaggacatgctcacgggtgagtagaaggcaggacactgcaccgtgggctgctagaaaatattccatgtgaggcctcgcgcggtggctcacgcctgtaatcccagcacgttgggaggccgaggtcggtggatcatttgaggtcaggagttcaagaccagcctgaccaaatggtgaaacctcgtctctactaaaaatacaaaaaaaattagccgggcgtggtggcgggcgcaatcgcttgatcccgggaggtggaggttgcagtgagcctgacgagaccacgccattgcactgcagcgtgggcaacagagttaaaaaaaaaaaaaaaaaaaagcaagccatgtgcagtttatacagacataatacaagcaacgcccaattgtatttacccaaatggcatagaaaagtaagtttatatttttggtttcctttagaagtgccagttagttatatttattaagcaattagaaagttaagcttctgtatttaattgcatagattagtttttgaggtagccaaaacttcttaatccattaaaagttgtacttgcctgcaatgaacaattattggacaagaacggcccctgtagcacttgtttacttttctgaaataaaaagagatataaaaattatcgttgtgtactaagactttgcgttatccaaaacaactattaaaacaaagcgcaaggtctgtgtgtttgaaatcattttgcaatcgcttgttttgacggagaaaataaaaatcatacgcataatatcaaacatttattcttcttctcaacatgacgttattaatcggagctttaaaaccaatgttacacctctacactgctttcttcttccaaggaggggtgccaggctttgaaccagtggactcccggcctgtcctgcccgtcccacccctgcaggctctcctctttctgtttctgcttatgttgacttgaccttttgttacactacatcttgattcttcactaaaatttttgagttttgcaatttatgctcaaaatttcttagtccagacatcatattgaaaactgttatttccatactgtctaaaaacagcatcttcaagggcatttgtgacccgtcagcttttggtaaggatatctaaattacggagaaacctctatgaagtccaagacaagtcccttccatgcttataactttgagtatacaaacaacttcattgtgcagagtttagatcagaagttgtaaaaattagaaatgagcatatatttaagatttcataaccaacccctaaatcaaaacagaggactgatttaaaattcactgtgtaaatccaggtgtttttttttaattcagtgaaacaatgaaacatgtttatgaagtccattaaagttgtcagtgaactatttctgaataagtaaaattaaaggcggaacctcgggttattggaataaagcatgtgtgaaggagagtgttctacaatgtgctgcgtgaactcctacaagaaacaaattaagaaaaatggaagtatggaccatcaatgggaaaatgtcacgtttctttgcaaagccttgcctatccagcaccaaagagtccgtggaaagtaaacattccatcaaccggtgctttgctacaaacctttgaagccaggaggggcagggtggctgtggaaggagaggggaggtgagtgtccagtgagcatgaggggagggatgcttgaatacggcggagcccaaaccacagagctttctcctcctctcttcctattccctgaggagttaccagaacaaggcccttctgatgggagtgtgaatgcccagtctggagggcaccacgggagctgaaggagcagttgcagggactggactcggcgtgcccacctgcagatgggccgcggccacagcctagccaggacgcacttgatctgtgctgccctctggtctgtgaaacacgaggctgatgcccaaaaatgggcgggctcagacacaggcacaaccagcaacggcctccagggccgtgtcaccgtttctgttagaggtgtttgttgttgtttttccggggcacacagtggtgcgaaggctttggggagaggcggggaaggcaatggtgaactccttagaggcaacagcacttgtatgccagagtgccttgaacattcttggtccctggagaataaagaggttggaaaacagacccacttatgtctacttctacaattttccattcctgactcaggctgtaaagcatcgagggctcctgatgacagaatggataccaggcctcaggggtgcaccccagcatgggggtgggaagccctccagctcagtaaagaccatgtgtgtgtgcatgagactgcacgcatgtgtgtgacgtgagcacgtatgtgcacacgtgtgcacgtgtagaatcaagcaggctcaactatcagaccaaatggtgagtggctttgctttgaaaggccttttgcctttggcagaggagtttactggccatggctcagcctctgaatcttgcaaatgggaatgacctcagttctgctcctccagcttcctgctgtgtttcacacctcgtggtccactctacgcagagactaagctcagcttctgggtccacacccaccagtcaccaggggttgctcattttttcctcatgagaccaagtacacccaaaaaagggacagtaaaacaaaccaaaccccaaaccccaaaccagataccctttaagaaagtgtgctggtttgaggaaaggccagcataagaagtcagtagacagcggtggctcatggatagctggtcagctcctgctttggcaaaatgcagtaataacccccttggctgggaaatgctcctagccagtgaatttgtggctacgatggcctcaacctgcttccccactcccgaaactcctgtctctatctcacagtatacggaagataccattttctctgacatgttgtgcctggtggccttgggaaggtttcgctgtaattttcatatccgtaccagcccccaccttgtgctcaacctatttacaaaaacccacgggcagtcaaggacatgtgcagtgtagatacagggtgtggcatggctgaggactttatttacaaaggatcatgcagttgtattattacacgcaaagcatcacaaatagagaggaaaaccacgacatattgaacacaagagttcatccggttgacccaagatgtagaccacgagttattcaggaaggtgacacagccgtctcatttgactccatcagaacaaagaatcagtgagcaaaaggtctccaacagtaagaaaagttggtatcatagaaacttccacaacaggaattcactgagaaagaacgattagtgatacaaaccaacccaggggtcaccgggcgagagcgcaccgtcatgcaaagcaccagcaagcaaggtcagaggtcgttagaggctcagaaaaggggctttccacatcgcccctgcagtacagtcacagtttccaatgatcacttttgtgactatgcaactgggctcatattactagctgcaacatcacaaaaatgacactggccaccgctaattagctggcaaggtaagggtttgtccgttttaccgtgagcagcgttagtgagcaccattgcacacagcaagaagggagagagtaataatgagagagagagagagagagagagtttttaaagcaaagccctcacatgtgatgctaattatctcttagcagtttctctttaaagtgtaaatgcgctccctctgggctccagaaatatttaatcacacatctcggtgcctggcgaacgcgccaggccagagtgagaacgcgtcgtctattgttcaaagataagaaacgctgcagcatgaagatggccggtgtcttcagaaggggtctcacctttcctgtcgctgaaatcggggtggctattttatacagaaaaccagccaccggcaatgcttgtctaagtgtgaagctttctgagaatgtgttcgctcaaacccactgtccagataacacatgaaaggtggccttggccgaaacgctgggcggtgccaggtaaggcaggcaagaaaagctttctactctgacgtggctttcaaaaccgtgtctgggggttcattagcttttgaatttaacaaaaaccttcttaggctgtatctcctcagaccctggagcaagggaaatttgggaatccaatttttcttggtgatgaatcataaacactgagggtcggtgatgtacatgttcccgtccatatatggatatggacatagcaacgtgcccatatgcatatacgtgcaaacacactggatgaacgcaaagacggggtgttaagatgaattgccgtctttgtagttacatccattttgccaggaatgactgttttttgaagactctatttcaggaaattatgtaagatttctacatagtatgtctttagaaataaatccgtattgacagaatgtacataatggccaggaaattagcgtgggtgaggaaggagccgtgtacagtagttgttttaggatgtactcaggactctggatctacgctctgcgtccccaggggaggtgacggcaggcaggggccactgagtgtgtgttgtggctgtgacaccagattcaagtgtctccttgcagaggctcttgattgatttctattgattcaaattacaaaaaactgcattttgcttttcaatgtagactaaaaggcaaaataaattgaatcataataagcttcagaatctgtaatacacaaattcaagaattccacagagaattcaaaaatcgcttctttatgacaatctttgtctcgttaacctccctccagttacataactgtagactcgagaatgagtaactgttaagaatcaagtcactttatgatagtggggcatggcattggattcaaatgcattttttcttcttattctccttgtttggatatttgtctcttttcctcaataggtagacttctgatcagttaaatgtaagacatattctatacaatttagagcttcgtcactgatgcttttgacaatttcattttccttgtggtggtttattcactaagcaccaccacctagccaatgcggaccgactgtttaccacaatcaaagctgtggtcttaaatgctgcttttttttcattgtcaatttcttcctgtaagacagagtctagcattcacttcaacagttcagtaaatacactctcaaaccagacaacgtattgggtgactggctgactggagcaatgaacaaaaaactgaattttttaaagagggtcagtttcaaaatagccctaaaaatacagacagccacgggctaagtgtctccgggcttccctgcaagatcacgcagggtggtatctgggcctgcgctcgctacctctttcatcccatgcagccagatgagaatccaactgaacatccgagctttatgcatcaatatcctgtggcacatacactttaggctctttgtcaactgaagaaccttatcaaaaataatggccctatttccacagttcgaagatgcctattccccctcacattttaatacctctgaagctagaaaatcgctcacgattaacacgtgccgttaacggagtcttcccgcctctcgcttcccttcccctcccccctgcggcgccgacacagacgcggccctcggcgccaggggcgtctcaggagcaccgaagcctcgctcccctgtgccgcgcgctcagcgcgcactgccctgccggcgggccgcgcgtcatacctgcggaagtccaggagggaccttgaggaggaagggactcctcggtcataccaactcaggaagtggaactgcgtcacggtgcgcgtctcgttggtctgcaggttcttcagatagaagctcctcaccaggaagtcctcacaccagatgtgctcggagaccaggttcacctggcagggaggagcggagggaggggacagagacaggtgtggacattgtgaaccgaacctcaggcactgaggaacccagggccacgtctgaccagagaagggggcgctgcgaagagggcacattttacagcgcaggtgggttccctcggcttcgcggccccctcccaccttcccagtgttaacgcactgaagttagctccgtgcgggtgtgtgtgcttagtgttatttaggggcttgagcgtcaaataattttttaaaaggttacaatccaaaactatcctactttctgtcttttgcatgtccatgttacataaaccctcaaaaaaaggaaccagagaaaaattacacttttcaacaaaagcagcgacacgactacatgttctgctcagtggttccactctaagtgagactccgtcgcagctgcgcacacccgggtctagagcaggaaaagcaaaaggctcacggagtcgcgctgatgtgaaccccagcgcaggcacttccgggcctaagcgtttctgcaggaaccccaaggccacagctgtgtggtttaaggttcacacttgagcctctaactcgcttcctgctgtggagctttggcattctcactcatttaatgccaaacagaatcaaagcatgcattctagtgctggcttaatcacccacgtttatttagttcattcttgatgggggcagaaaatccagccagataaataaactggtgagcaggttatcctcaaataaaaaggtcacatgatccagccacgaaactccaagcagagccacggggaggccacacggctcaggcactggcatcaaggatgggcgccaggttttcttaaaaacggaccccacttaaaggcttgttatatgggaccgggaccacgctgtgaggcgaatgttttttctactctgttatcatttggatttagaaaaatctaaaagataaaaaccacaccacactcccagggtctggttcatgagcacacagccgtgtgaaccatccacacgggcatgcggccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctgccctgggtggctctggtcggagtacctcatagatgtggtagagattggagccttcatccggccagtagtggtagcactgccggacgccgttctccgcgaggggtgtcagcatgacgatcaccacgcagccgctctcccacaccatctgcggacaaagaaggcccgtggccgcggtgtgactgtctcatcaccgcgtgacatgtgtaattactgcactcggaagcacagtccaaatttattccattcacaggacatttatttcattttcatcagacatgtttactccgcagctgcctgagcatctctgaatgcactggcccatagtttgcatgttccacgaaatattaaaaaaccccgcaaatttatcccatgccatttagagcttcctcaggtgtaggttcagctgtgtggttttccaacttctgatctgtaaaggaaactttctacaacgccacacataacagccagcacttctcgaggcggtgccgacaccctcacttgctggtggctagcatcattttgctcacctagagaaacgttttgcttcgtgaagctgctgtcctgtcagaagcagcctccgaaaggcttcttttcaaagtacttcacggaaagcagtactgcactgctgcaatttcatttgtttataccgaaatatggcaacactattcagattaaagcaaataccaaattgatttactaattcctattagccacattgaaacacaataaacaaaagcacatttaaacccacagaaattacaaagacacaaagtcctctgacctcgtttctttgcaaacacaactggctacttgtggctgtaaacccacatcttaacatttacagcctaactacccaaaaccactaatcctgtggggcacactgatgtggcatttgtagatttttattagcatatgaaattatagagtgaagaggggtctgctttttctgcaatgggttacattaacttggcagaaatgtttataagcaactgcatttagatgtaaatttggtatccaagacagtttctatttcttttaaaaacagacacaaaatccaattaagaccttgttattttaaaaaccctcatatcccaaatataaaatgctgtcatcgtagcgcatgttactgaattccacatttatattttaaaaatcagacacaaacacgacattttccttttttaatattgatttatgttctcacggggctgaaatagtcaatatcctcaaggcacctcactgtgtaacatttacatcggaagccaatggaaccaactgaagtatttacaaaacgcccacaaataaataagaattatgctcaaatttgtgcactttctctttccttagtgcccatccgacaacaagatgagaattcaaaacatgtttcttacgccaggcttttcaggctttcaaacctgctcctccaaatcggttcttccatcacataacaatttaatgtgccttcagaaggtggagaagctcatggaagccattacgaaaatgaggagaaacacagattttatgagtgtaataaaaatacaatgatctagaccataaactaatcatccggcactcggctccgtgccacccaagtgtgacattacagagccccgtcgactggggggacccggacggcctggaagccgcactcattggctctcgcgtccgcccttcattatggggcgccttcccggctctctgaagatttggttaagattaaatccaaatgaaacttaatttaaacaagcaatcccaaaggcgctctggggaataatatttctttttaggtcactgtgtataaaagcagagaggggaatttactaaatcaaacaaataggcagcccaattgggtaccaatattacaagctgttcatggaactgattacattatcttgtgttcctttgaatcggtacaaagcaactcaatcgaggaggaaaactatggcatttctccatctgtttccagccttcaacagcgcgcctgaccagataacctcagaatacatcgcaaaaagttaatttggattttggtatgaatgcagaatcagtaaaaatcccagtcgagtaaggttcaatttctaatcggggagaagtttcactattttctttctcattgacttggtctttgctgacaggtgaaatacggaagtgctaacccctggcacctgtgaatgtgacctcatttggatacaggatttttcagacttaatcaagttaacattggtttgtgtcacaaatctttgagaaatctaaaactgtctctttcaggaagtaaataatgacccaggatccttatttaatcttaatgcagttcattggaatgcgcagtttacaaaactgtatgcctgaattccagaaatgaccattactggcacttcctgtttggtgaagggtaagagaacacggcccccatggccacctgcacagccgagtacctgcacaccccagcacctgcacaccccagcacctgcacaccgcagcacctgcacaccacagcacctgcacaccgtggcacctgcacaccccagcacctgcacacccgagccgagcccctgcacatctgagcacctgcacatccgagcccctgcacaccccagcacctgcacaccccagcccctgcacaccccagcccctgcacaccccagcacctgcacacccgagcccctgaacacccgagcccctgcacaccccagcacctggacacccgagcccctccacactccagcacctggacacaccagcacctgcacaccccagcacctgcacaccccagcacctgcacacccgagcccctgcacaccccagcacctgcacaccccagcacctgcacaccccagcacctgcacacccgagcccctgcacaccccagcccctgcacaccccagcacctgcacaccccagcacctccacaccgtggcacctgcacacccgagcccctgcacaccccagcccctgcacaccccagcacctgcacaccgcagcccctgcacaccccagcacctgcacacccgagcccctgcacaccccagcacctgcacaccccagcacctgcacaccccctgcacaccccagcacctgcacacccgagcccctgcacactccagcacctgcacacccgagcacctggacacaccagcacctgcacacaccagcacctgcacacctgagcccctgcacatcccagcacttgcaccaccatccctggatcgaaccaaagtcaccaacatggactgaaaatgagccgcaagtgctggatcccgagtgtgaacggctggcaccacgctttggaggaaaactgatactccccagttttacatacttcttctccagtgcagcgtccccaggcctcagcatcccccttgaaggctctagctgtgccagctctgtgggcctggggtggggaggggagcaatgttgcgctttgctgtttatgattccagaaggaatggaagtggtcagcccagtggttctcagagaccaccaaacacaggggttaaagcctgctgccaggctctgtgaacctgagccatctcgacgcgcccggcagggacacagcagcttgctgtgaggtctcctgacagctgttcagcagcagcaagtggagaaattcagtgattcggacagtgacccaaggaacaagaagtgcagacttcggctgttatttgacccaactgagtaagtttactgactgtagatttaaaaaccatattgttgtttgttacaggttcaacgctgtcctccccacagcttatattgacgtcctaatccctggtatctatgaatgtggccttatttggaaacaggatctttgcagatgcaactgagctgagggtgggtcccaatccaacgtgactgtgtctttagaagaagagggagacacctcgagaaggcacagacacggagagcggccacgcgcagacaggcagagatggagtgttgtggccacccacgccacacccctcatggcaggcggccacgggacactgcagaggccgtgaggatcttcccccacaggcttcggagagcgtggccctgctcacacctggatctcagactaccaggctccagaactgcgaggggatgccctcctgttgttttaaaacaacgagtttgcagcaccttgtgatgtcagccctagcaagagatgcatccgctgcaacctcactctcttcttcacccatcaaatcacccacaggcgtggaacaatggccaccccgcctacgcttcctatcaacaccgatggagaggaacacagggcctcttcactctaggtcctttttgagtgctaagtatttaattagcaaacaaacaaaaaaacaaatgacccaactaaaaatgggcaagggatctgagcacacatttctccaaagaagacagacaaatggcccgcacgtatgtgaaaaggggctgaatgtcatcagccatcagggaaatgcaaatcaaaaccacagcgcactggcacctcgtgcctgttgggatggctgccaccgaaaagagggggatggcaagtgttggagaggatgtggaagagacggaaccttacacactatacggtagcaatgtgagtgagggcagcctttacagaaaacagtatggagggccaggcacggtggctcacacctgtaatcccagcactttgggaggccgaggcaggtggatcacgaggtcaggagttcgagaccagcctgaccaacatggtgaaacaccatctctactaaaaatacaaaaattagccgggtatcgtggcatgcacctgtaatcccagctactcaggaggctgaggcaggagaacctcttgaacctaggaggcggaggttgcagtgagccgagaccgtgtcattgcactccagcctgggtaacaagagcaaaactccacctcaaaaaaaaaaaacaaaacaaaaaaaacaataaaaccagtatggagagcctcaaacaattacacagaaccactgtgtgatccagcaatcccacttctgggtatagacccaaaggaaataaaatcagtgtgtggaagggacatcagcacccctttgtttattgcagaactattcacaataaacaagatttggaacaacccacatgtctgtcaatggataatggctaaagaaaatgtggtatatacacaatgaaatattattcagccttaagaaagaatgaactcctgtcatttttgacaacatggatgaacctggaggacacgacgttaaattgaaataagccggacacagaaggacaggcaccccatgatctcactcacatgtggcacctaaaaaggacgaactcagggacagagtagaaggggggctgccagggcctggggctgagggtggaatggggagcaattgatccaaaggtagtaacttccagtagaggacagctgaattctggagacctggcattcagcatggtgactgtagttaataagagtgttgggcacagagatttgccaggagagtaggcttcaggtgcttcaccacacacaaagaaacggtaactacgcgaggagacgtgtattcattagcttgactgtggtcatcattcacgatgtctgcgtgtgtcagaacatcaggctgtacaccttaaacatttacaattaaaaacaactcgaccgggcacaggggctcgcacctctaatcccagcactttgggaggccaaggcaggcgaatcacttgaggtcaggagttcgagactagcctcgccaacatggcaaaaccctgtctttactaaaaatagaaaattagccaggtgtgttggtgggtgctgtaatcccagctactcaggaggctgaggcaggagaactgcttgtgcctggaaggcagaggttgcagtgagctgagatcatgccactgcacgccagcctgggtgacagagcgagactctgtctcaaacacacacacacacacacacacacacacacacacacacacacacacacacactcttaaaataagctctcctgaagccccacagagacctgatttaagggaagatgatcaatctgaaatagtgaaacactggagctggatgtggtggtgtgaacctgtagtcccagctagttgggaggctgaggtgggtgggaggatcatttgagcccaggagttcaggaccagcctgggcaacatagtgagatcccatctctgaaaaacaaaacaaaaaactgaaatagtgaaacgccaggccattttctctacaaaacatccctgggccccttcaggaggaaagcttctcctccttctacttagatcttttgtgatgagtcccttcctgcctgtgttagtcttgtctttagcccgtatgtctttcctctaccagactatcatctctttaaagactccatcctagtccagttaccttttctaccctccatggcatctaacagatgcttcattgaaaacaattcacatttctaagaggccgtttggatatttatgtaaaaaaaaagataaccgaaagaaaatgttatcaaaggcttgcatggcagaagtcctccaggacttgcttaaatgtacagacaagtgttcagtttttaaaaaaacaagcatggtaactgcatcccgctgaagcggttgccatgaagatgcatttcctccagagcaggtgcggggcccacgcaattctgctgcacagctcatttctgctcatttctgttgtgagcgtcctctcgtgggctgaacagaggtttagacttataaagaagatgcagctaaatttaaaaggatgaggagtcagttaatgggaaaacactcgtatttcactccttaggagctcaccgatgcctggaagttaaactgtgtggtctgagacagattaaagaggaagaaatagtgtgtgtgacatcttttgcaggggaaaccttcagctctgctctcaccctgcccagaggacagtcctaagaaatgaagcttcaggctttgcggctctggttccgagagagtcacaggctccaggccacagcacgcacatttggacacggtaatataacccaacgcagggtgacaaaaccttcgtgatgccgtccatgaccagctcatggtgcacctacctggcttttttttagtaaacaaatatctcagtgtgggattcatttagggatgacacgatgaggtgacgtagcccacacacacgtcagcagtgctgatggaaaggctgatgagggggcagcgggaggaacccccctgtgccgctatcagatcgacgcctgtgctgccttgtagccccatcccagggctgaggagcagctgcagcaacctctgggacttttccaccagcagtattgccgcccaggaggaaggggaagcctcagaacaccagcagtattgctgcccaggaggaaggggaagcctcagaatgaggacttgccactccaccaaagtcgggtctgtgttctccgggaaggactcagcctgcttgtgtgcaagcagaccccgtgtggcttggtgtggccatcctgccgcataggggttcccacggtgggaatgcactcacacactggacttcctctccacccggcctttgtgtgaccaccgtgggtgcctttgtgatcaggcattggacccgcacaggaagtcacctggcacaggcgtcactgagactccctgtggcctctgcctgtgctcacgttcccggttaaatatgcgcctggtctccttgcggggagctgctgcactgggcggcctttccttttcaagatcaggacctgacataaatgcatcagatccagttgtgaagcaagagaggaagaggaagaggaagaggggaggaggagtggggatgggaggagctggccggaggctgggaaccaatcacacacaggagcagcagagcctgctgttctcagctggagcagtaagaatcagtcagaaaggaaagccggacctgtcctttctacttgagtcccattttaaattccgcatgtgtgcggcgagagactgaccgaccatctttgcactgtcccaggcagaaccatggacaagctttgaggtcataggtttcaaacccaaaatttagataaggcaacgtgagaaacagtttctttcacctttaaaggttcgtgaatttatgaatagaaaaaaatccagcaagaccaaacctttgaaatataacaatgtcctggaaagtctcaggcatgtggttaaagtacttatcaatcatggaaatgaaaaatcaagtttttcctaagaaattaagaatgaacacaactctcatgttaattcctaagaattaacacaactctcatgcttccctttaatcaagtaacgtgccttaaaatcaacccatctgtgacgtagcagcctctgaagtcatttccccccgctaacctcctgactctcccttcactccagagtcagtgagatccacagacggttccctctcgcaccagtcactgtccagggggtggaacaggatgatgagcaagctgagtcttcacccacactagggagctgcagggactgggggacattctcatgcttttggagccagaccacttaaggtaaccaaggacccagagcagacaccgtggtcccaggctggacacatctgacgagaaaggagaggctgccagacaccgggtctgtcctggagactcagggcccctgctgctggatgctgggtatgtcctggagactcagggcccccgctgctggacgccacgtctgtcctggagactcagggccccctgctactggacactgggcctgtcctggagactcaggggccccgctgctggatgctgggtctgtcctggatgctcagggtccccgctgttggacactcggtctgtccgggacactcagggccctgcctcccacatgccgagggaacattaaaacagttgtgagtagctgggggccgtgaaccagctcgggctgagcggatgccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacagatgccaaataataaaaagctgtatttacatcaagcctatcaatttggaaatgagaaaacatatccccccagctgaggcttcatcacagaatacttttagaaagcagaaactagaaattgaaagtgcacctttttcttggtaaaatgttgatgtgcaataagagtcaacacacatccgatgccagtgggacacctgctgacttcagcgagcgctttgtgctctctctgggggccaggagagctgtttcgtgtctgactctgtcctgaaaggcagcctgttcatcagacaggagaggcaaggctgaactttggagttgtcctcttggctgagcctcccatacagggagccagttcccacggtggctgtccccatgcctgggctcccgtggtggctctccccatgcctgggttcccaaggtggctgtccccgtgcctgggctcccgcggtggctgtccccgtgcctgggctcccgcggtggctgtccccgtgcctgggctcccgcggtggctgtccccgtgcctgggctcccgcggtggctgtccccgtgcctgggctcccgtggtggctgtccctgtgcctgggctccagggccctggctttccatgtcacatctgcagacatccactccgcacctgatggtgacagactatgctgcctacatttctggtttagaaacagctgttgtgtatctcctgggcacagccagtgtttggtggtgacacacagaagctctctctggaagaagagcacataattctgcagctctttctaaaaataggaaaggggggatggcgggtggccaactcccttcggttgactcgagccgcgtagcacagggtgtggtagaaggtggcgcagcaggtgcaggcagtagggaggtggtccgtgatggaatatcgatgcccgcggcccctcccctgcctccccggcagtcctaatcttacagctacagtcctgcccgcaggggcttctctgtgatccagctacagtcctgcctgcgggggcttctctgcgacagctgccctgtgcaccaggacatgactgggctggggacgcactgtggggccacgtccccgggaaggtgcagaccttgcttccccgtggggaagtctcggcacctggagaaagcgtcactttatctcctgtctctgaggactttgactttcacatattctgcgccttgagactctgcacacgtgtatttttgtaaacaacacctactctggaaatgccgaggtcactgctgccggatctctcttttctgtttatagagacgtcttcatgtcactgtgccttctttatctgtgaggagtgtgtatgctgaagagacaccctggcactacacatgtctgggtctagaatgggctttgcctcccaccagctgtgtggatctgggtgggtccttatggctctctgggccacagcttcatcctgggtagaattgggctcactctgtatatctctattttaattgtagtaaaagatacctaacatataatttaccgtttgtaagtgcacagtgcagcggcagtaagggccttcccaccgttctacaaccgtcaccgtcaccacgctcttcagagcattctcatcttcccaaatggaagccctgtcaccatcaagcccctctgcactgtcccctccctgagcccctggctactaccccctagattcatactaggcttctatgaatctgacgcctccggggaccccatgaggtggaatgatgggaggctcacgatggcttcatcgcagggtcaatggctcggccaaatgagatcccatatgggaagtgcctgcccagggcctggcattgaagagctcagtaaatgggacttcctttcttcccccagccccctttccttatgcccactggactcgaatgtcccctccaatgggtgcgtgtctttcactcaaggtggccccatttggcaggtgggaggcgtctttgcagattaaaatacactttctagagaaaggctttctagagaaaggctatctgacaggtacccaaagccgcagggatccaggagtggaccatggagacctgcctcctcctctcgtcttccttcctgatattcagcctcctccctaagcggcttgttgacagcaaccagagctcaacgcctgggggtgtcaacggatgggtatgaggtgttaagactccttatttagaagcattgaacaaaacagtaaaacctcacagccaaactcgtgttcctaatttaaaatttattagaatattcttaacccttcttcagatttaaattaggattttaaaaagaaagtttaggatttaaaaagaaaattaggattttaaaaagaaagttttacgcaccaccaagtccagacgccagccgaggccaagtttccttgtgacgtctgggctgacagcggcggcgtggatgaagagggagcttgtgggtggtgctctatgccgaggacggctttttctgcctcctgcagtgattttcaaaactctcaccaccccggctgtttccaccaaactctctggcttctttttctgttgtgttttgaatgtcagcaccctttttgaatttatgattgcagaaggaacatcatattccagatatcatcccagaatgaccagcagagaggacggtggacatgtttcttcctaagatcttgatatgacttcaaataatgtagcacaagattggcccatacttaagttttctttccattcttcctttaaaattgttccacactttaaaaaaaaagtttatatgacaaaatgacaccctcaccccaaaatgggtattctttccttgagggatgttttatttctaggccagtttactacttactagtaacactgatttctgaactgtaactcagacttccacagacccctctgagctggagtaaggaccaggaattcagccgaatgatttggagagcactcacagacaaggaattaatttggggtacatcttcctttaggtaatgaatttatttttaggaatttcttgatgtaagtcaaattttggaaatcaaattcttgaaatgcatccagtgtccatatagagctggttcactgcaggaaagcaccatgtgtgcagtgagtggtgaccctccgtggattttcgtgcacgttctgggctctgctcagggacgcagcacggacagaggtgctgtgggccctgcgggacggggagctgatggggcctcgcggtgccatgctgggggagaggctggtgagcatggagtgacctcgatgccccatgctcaccgaggggacttcccctgaacccgtcttccaggctccccccttctggacccatgggcccctgtacagcatttcttgctgaggaacttggggccctcctggctcctctgcctcccagcagcccagtgacctccaaacggactcctgacccatcaccatgtcatgtgggtgccaattagctgcttggaaaaggtcttttttcttcttagccattgtactgggtagaatcatgtacccccaaatccatgtccacctggaacccatgaatgtggtcttatttggaaatagggtctttgcatatgtggtcaagttaaggtgaggtcacacaggctaggatgagctctcagtccaatgactgacatccttagaagaggagggaaatttggaccctgacataaatccacggtggggaaaagctgtgtgacagggaggcagagatgagggggacacttcgaatcccccaaggagtgcacgggcctggggcagacacggccatctttcccatcacggcctttctcacgctcacactttcttcctggaatttgctgattaccgacagagaagaaacacctgtggacctgccccaaggaggagcttcagatcagcatcaacagccggagataaaaggaaggtgctttgggatgatccataaccttcagtctgtgtcccgatccttggtcagcatctgagaatggtccagaatggggatgcaggaggagacggtcactccaactcagcctgttgacttcgtcatcaccaacttcgcatttcaaatccacctttgtccttaaaaatacacgttaccgtgggtttggaaaagttctgccttccgtgggaggttttaaagacaggtgttcttcctctgcctgcgttctgctaagccagagagggcaaagagaaccctaactttgaatttttaagaatgtcaatcttggggcttactggtaagtattcaatgaagaacaacgcctgagagatgctgacattctaaaacacacggtttagaggcctcccaggcaaatgtgactgtgctaggaagcaactctcctccatcctgctctgtgtggatttatggcatcgatggtgggcagctcctgtgttctgcacagagggatccccaggttgaaggatgacgtggaagcaatgacgtcgtggtcagggacgtctgcagggagcaaaatgaagcgagtttctttagttcacaatttctcagaggctctgctcggctggcatgctcgagaacatcctgggagggctgaggctactggccatgagctcttgtcttagaaaagctgtgaccaggttgagggacgctggggtttcctggaaccacctgatacctgctgtccgagatgtgtctcaaaattatcttgcatttcaccttgctttaaaatttgtctctacttatttcatacagagatgcatcatttcaatttcaagaatatatgctccttgattatcactctaaaatagcccataagatgtaaacactgatcaaatgaattgcctccaacaattgcaactatccataataaacagtaagaaaaatggttcacgccttctattcactagccacaggaatctgggcacgctatgagcctctgagtctcacggaccacagagactacaggtcagcatgtgagagcttcatgtaggacccagcacctgctgaacggaggttggatgtgggcatcatcgtggtcgttgagtgtggacaccgagagccttcacacaggatggagggtggatgtggcacctgctgaacggaggttggatgtgggcatcatcgtggtcgttgagtgtggacgccgagaggcttcacacaggacggagggtggatgtggcacctgctgaaccaagggtggatgtgggcatcatcgtggtcgttgagcatggacgccaagagccttcacacaggacagagggtggatgtggcacctgctgaaccgagggtggatgtgggcatcatcgtggtcgttgagcatggatgccgagaggcttcacacatgacggagggtggacgtggcacctactgaaccgagggtggatgtgggcatcattgtggtcgttgagcgtggatgccgagagccttcacacaggacggagggtggatgtggcacctgctgaatggagggtggatgtgggcatcatcgtggtcgttgagtgtggatgccaagaggcttcacgcaggacggagggtggatgtggcacctgctgaatggagggtggatgtgggcatcatcgtggtcattgagtgtggatgccgagaggcttcacgcaggacggagggtggatgtggcacctgctgaatggagggtggatgtgggcatcatcgtggtcgttgagtgtggatgccgagaggcttcacgcaggatggagggtggatgtggcacctgctgaactgagagtggatgtgggcatcatcgtggtcgttgagcatggacaccgagagccttcacacaggacggagggtggatgtggcacctactgaaccgagggtggatgtgggcatcatcatggttgttgcgcgtggacaccgagagccttcacacaggatggtgggtggatgtggcacctgctgaacagagggtggatgtgggcatcatcgtggtcattgagtgtggatgccctccagaccctgtggctttgctggacagagaagtcttgcacaggtgaggagatgaagttgatgttgggctgtgggggcccaagggctcataaaaatgaaagaacacatatttgggggcaccccatgccacacaaataagcacattttgggtaatgggttgaggtggatgaaaactccagtggtattaggactccgtgggtattctctgcccgccctccaattctgaacactctgtccttttccctgagaagccggggtgagcgtgcacagcagggggcatccctggaagggccctggggctccattctaagggcagcgctgggacggatgggtccatgtttcaggaaggcaggtgtgtgccatgcaaagaccttcctaccacgaaactcctgagacgatgggccccagggtgccatcttctctgggaaaggcatgttctcaccgggctgggcgactccccagctgtgacaagtagggagcccaagtgcccccaaaaccatccaagtgccacaggttcgccgtgccatgccgggattacaagcttcaacaacgtcacacagagatgcagtttagttttatttatttattttcaatagtgtgaagacacaggcagacacaaagggcaggaggtcataccgatgtgtttcagatcctggcgtcatccgagctgtcctgggtaagtgatgccatctctccaatacccatgtgccttgcccataaaatgggatgatggcacctgaggattcaaatgctcaccatgcaagggtgctcggaggccctcggaaacccggatctgttccagacttttctggaaagccctgcagagactgttctcaagggcagagagaggaggctccccttcctgtaatcggagtcacgcgaggctgacgggaaagccaggaaagggaagtaaagggaataggaagagcctggggcagaagtgaatttaccaactccggtgcacagcgacatcaggaaatgtctcaccccagtgctgcacaggcgcccgggctgtggatcgccaggaggcccgggctttggatcaccaggaggcccgggctgtggatcgccaggaggctgcagcctgatcccagcgtcactgctgcgacaggcacctccctgcctggattctgccgcatgggtgacgcgtcgcttcccaccttcgtccccagctcgactctccttaggagctcctctctgccaggctcggggttggctggtgtgcccgacacgcggccggtgcctgtgctcctgcggtaactcacggccacgttccaggttccagaacccattcctattcagctttgtcacgtggctggtgaggggagacccgggggcagctggagaaggaagaccccacctgccctctgcatgttgctctatttgctgatgtttgacattcacgtcagccctcacgtctgtgccttcatctgtgtgacctgggcttgcgtcgagtagagaagcacggcctggccttcagatgccctacaggactccaggagaggatgacagaggatgtacttgggtcctgctgtgaccgccatcataacaacgccatggacaacaggcacatttcaataacatggaatgacttactaactttatcctcgctgttttataaaatgcaaatgtaaagtggcttaaaagtaatgatcttgaaagcattaaatctctcaaagggaattttttcatactcaagttttggaaaacaaaagattgataataaaaaatatgaacagactgaaattctgatataagtaacatttgatgagcatttgtaagaagtttgattggcctaatcagattcaagacatgattcgtgacccagttattgagatcttcttttcagaaagagagattttaatttaaaaatgttcacctgccaaaagtcagccacggtggcgggcagcggtccctgggtggcgatgtacgcggggttcctcgggtcgtgatccatctgcagagacaagaccacaccacagcggttagccaggagattaggaagcctggaggttaggaagcctggaggttaggaagccagaaggttaggaaacccggaggttaggaagccaggacgttaagaaacccggaggttaggaaacctgggggttaggaagccaggaggttaggaagcctggtgtttaggaagcccggaggttaggaagccagaaggttaggaagccaggaggttaggaagcctggaggttaggaagccaggaggttaggaagcctggtgtttaggaagcccggaggttaggaagccaggaggttaggaagcctggtggttaggaagcccggaagttagggagcccagaggttagggagcctggaggttaggaagccaggaagcagagcctgggttcaggaagagggaaaggtggcatctcctgaactgagcaacacacaacttgccctttgttgattcaaacgagcacccggcacaggtagggacccagctgtcccgagccttgagcctgaaccactgcgtctgaaatgctttccttatacctgaggttgaggttctaagagcagcatcaacagaaatgaagaccagtagcccaaggagggcaggcagccgttgttagcccactcagcaggtgcgaccccatgacatggatgagctttccagcctgcaagtgaccccagagcttcctggccacggagcccacccaggctgccctgtgttcaggagaacgagcctcttgctagagccacagggctggctggggtgaggctgagctccaagctctcaatggagagtgtgaacagggttcctccaggcctcatggacaaacttgccagcgtcctgggagaacgaactagcgctacctgctgcttccctgctggagttaactcgttgtgtgtgggggcttgtttttgtgtatcctggaaagggggcacaggcacagccggtcagcctgggcctgggtctgtggcagagccggggcggaagggccttgctgggagtggcctcctgttctgtttccccaccaggcagggaccagaaacaaagagggcaggtgtgggctctccggctccccagtttgtccgaacgcatcttgctagctccaatgggagaaggttggcttagaagaccataattattacatttatttcgaagattaagcacagaaaaaagaacttgaggacaaagccttgagaggcaagcgagatttgagcacattgctgaggggcgtcagatggaggtggttctgtcttccagagggcaagcccaggccaccctgcaaaggacacgaagataccaggacatcactatcatccccagggctcaccagctcctccccacacctcccagaagcatctgcagagaccgacccccggagagccggatgctgcgctgggggaacctcaccttggggaggcagccgcttgtgcatctgacgcacagtcctttcttctattgtgtctaggactaaaatggactcttttgctatcagggtttgattcgagatttacaatgttcagatttcaaggtaattattaagaaaacatttctcaacacagtgaaaaatgagcaaattttaaccctatgcaattttaagccaacgcacgaggacatcagtggtggccccggtgctaccttaagtgctgctgcatttgggaagctgacgtggggcacgttttctttaacagcgagccagtgagtccccgtgcagccgtcaccagccccagagatgatggctgtcagcacaaaagaaggcaccaaatgcaccttataattatgttcaccataaaagaggggcgagcataaaggaacagatgtaagttattctcacagaacaacacggtgacgctagccgggggctggggggaagcagggagaaaagctttttgtgcatctgatttagtgattcgtaattaaaactggacctcgttttgaaattcgccacaacacacacaatacaggtaaaattatgttaccgtcgctgaaagccccaattagaatgtttcagtagaaaaatgcttagcagaaataagttttgattttttgaaatatgcatttgttgggggtgacagctatttacagagacccctgtctcttccttgcaaatagtaatgcatgaaaaggaaagccccgcctccttctgaaatgtgtgtgtgtgtgtttttttttttgcccagagcaatttctacagcaacacattttaaaattgtaagcatgttcaaactagcacatttagttgctttcaaaatgagaaataggtgattgaaagtaaaatgctggacagggttgcaggagggtcgataaggtgactgttgatttaggtctgagttgttaaggtgtcctaaagtccacacacccatcacctgctccaatgcctaagacaggagcaaatacagtcagggtgctgggagggggatggctgaacaggaagtgtgggctgtgcagactgagtggggaccggcctcacctccctcccgcccacctgccgtcctgtgggggccactgggaaggcgggaacagcatgatgatccgagtggtgacatgtgtcatcggtttcacaataattcaggagacaattacattcatttaattccaggcacattctgttgaacagaaaattattctgggcagaaggattttgtggaagcagcaactgcaaaggccacaggcagcctccttgtggtctcacgcaggcttcgaggaaaagtcaagcaaatacttaactggccacacagagattttactacatttaaggttttcgggcaggataagtggctgtggaggaaatcaagtgagtttctactaacattgctttttccaatgagggcatctgcgtgacaaccggacatggtgggtgtgtgtccctctgtcttccccacccagcgatcacacggcacctactctggcttcctccggtcttcattcttacccttcgcctcctactcatgactttccatttcattgcaacatactttttatttgtatgactgttatgttcccgacacaaactgcccggctgtgggaaaaggcctgtcatatctccaggcctcagtctccgtatctgtatggtgggtgagctcagggagtgaggagcttggacgtcggcgtctccgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcgtccatgctgtcctcagtgaaccacagaaggaaggaaggatgctgcttcctcaagcacagagctgctgtgtcctccagtggtgtgcggggccaagcatctgaatggcgaggtgcggtcatttctgagcgctttctccccagacaggggcttctgcagcaacacatcccgcctagagaggccggtaccacagagaatccagtgtgactcactccaagtgacttcatgaaaatcaacagccagaaggcaagtacaattaacagtataattctgtttttacttttttttttttttgagatggagcctcaccctgtcatccatgctggagtgcagtggtgcaatcttggctcactgcaacctctgcctcctgggttcaagcgattctcctgcctcagcctccagagtggctgggattacaggcgtgtgccaccacacccagctactttttgtatttttagtagagatggggtttcaccatattggccaggctggtctcgaactcctgacctcaggcaatctgcctgctttggcctcccaaagtgctgggattacaggcataagccactgcgcctggcttacttttttaaaataaaaataaagcccatttgtctgtgttgactctgttatcccttggttgactgattcttatgaagatgtcatatgaactaggatgctagtgaggtgtgttcctctgtctctctgaatacacagtgtaaagatggcctagtgatgtgccttatgctatcagaggataattactaaacaagtatctttagaaaccctaatctgcatgaaaaacttagccacaatttccccaatattccaaacaaagctcattttagaaatgaagcactcagcatgtcaggaccactggactgtgtcctgcagtcctcaacagcctccatggtggcagaggcacccactgcggggcaggtgaagggaacgccagtttctgctcccaaaccagccccggcctctggcagctgtgaccttaacatcttaagaggatctggccagctttggggaagggcatgggtgtcacgtctttactctgaaatcttgcacagagaataagcacacacctcatctgtaggtatttctacctgcccacctctccacctgcccacctctccacctgcccacctctccacctgcccacctctccacctgcccctctccacctgcccacctctccacctgcccacctctccacctgcccacatctccacctgcctacctctccacctgcccacctctccacctgcccacctctccacctgcccacctctccacctgcccacctctccacctgcccacctctccacctgcctacctctccacctgcccacatctccacctgcccctctccacctgcccacctctccacctgcccacctctccacctgcccacatctccacctgcctacctctccacctgcccacctctccacctgcccacctctccacctgcccacctctccacctgcccacctctccacctgcctacctctccacctgcccacatctccacctgcccacatctccacctgcctttcctaacatttaaagcaaattgcatgaaacgctttcttgaaaaccaccatttgacttctcaagtctcttttccaaatactaaggcttaatatgggaatttattgggaaattgtagcttcagtaatcaatgggagattgacttgttttttttgagacagggtcttgttctttaccccaggctggagtgtggtggcatgatctcggctcactgcaacctctccctcctgggttcaaatgtttcttctgcctcagctgggattacaggtatgcaccaccatgcctggctagtttctgtgtttttagtagagatggggtttcaccatattggccaggctggtcttaaacttctgaactcaagtgattcgcctgccttggcctcccaaagtgctgggattacaggcatgagccactgcacccagtcagcagattgacttttgaacttgaaatatttttatatcgtattcttaggagttgagatttacttaagtaaaatactgaatataaaccattattatacacagaattttggttgtaaataactgaagtgattcccatatttggccaatttcttatgctagtcagaacatccaacctctcttctttttctgaaaagccactctgtccctacatagttaaatgcattctgaattaaaactttaaatgatgtttttttctcccttaatagacagtgaaatgaagaattaagctagtttttacacgtcactgggagtttcagagttgtcctggtaataaagcttgtgtgctgtgtttgagtgggctgttgcgtgaacaccattcctcaacttggtgtcctcagtaataatcaggctgttttaaatgtagctcatgggtttctctctcagacaacctacgagggaaaacagaattcccattgactttcatgacctctgatttaaaagcaaagattgcacattatttaccactggatgccttccctgaaatgtaatgaggactaagtacaaatatgacagatgtaattatcatagttttatcctgcacagccagggccttcctttgctgtaattgtgagcttttcattcagctgctgctaggaaggtaattatcattgtaccttcagctatttcataaagaagaggcaccatcgatttcttctgcttcattcttacaacccaaatttggaaaaaaaaaagaattgtggtatgaaataaaggaaagacacaaaatgtaccataaaattacttctccctcctggccttgccttctcacccaagctcctgcccagtaaggcctggagagggagttgcatgaatgtgcaggaattcatcccccaaacacacaccccctctggttcccacatgggatgaaagctgtccaccgtttccagctcgacacagttgctgcactgggcactgctgcccacgctggggcttggctgtggcctggaatagcgcagacatctgcaagttggaacccatcgagtgggggagagtgggcccagctgcaacgctgaactctcgtcttttaggcttgtgaatcacggctttattcctcattctggcttcatcaaatggttcatctcagggaaaagggacctcaacatggcttttcttttccttcggacggtttcgtgttgccaactctgctgcacatagtacaggaacggaatccaggcgcgcacacctggctttaccagaacgcacgttctgttcatcaagtgagaggctggcacatcagcgaggctttggtttgatgtttttgaattagaattgatgacagaaaaatactatgtgcatcacatcttattaaggaagatgaatgaggatctttgaaacccacacggaaccaagcttgggagtcaacctctgctggaaggaaggaagtgattccttcttaagaatgaacacataaacagaaacctgggttcaggtggtgtagaccaagtacactaggccagttcttcactttgaattcagtctctcaaagctgaacatgctcactgtgtgggccacgaattgcgggaaaacgggactggctcaggcatgtggacatcttcccagcgtgctttatcccacaggtgtgctgagaccagcagagccgagagctgagcaccctccaccatcagtggccgctgagaccagcagagccgagagctgagcaccgtccgccatcagtggccgctgagaccagcagagccgagagctgagcaccgtctgccatcagtggccgccgagaccagcagagccgagagctgagcactgtctgccatcagtggccactgagaccagcagagctgagagctgagcaccctccaccatcagtgaccgctgagaccagcagagctgagagctgagcgccatctgccatcagtggccactgagaccagcagagctgagagctgagcaccgtccgtcatcagtggccgctgagaccagcagagccgagagctgagcaccctccaccatcagtggctgctgagatcagcagagccgagagctgagcactgtccgccatcagtggccgtggcctgcaggcagttgggccaatactttcatccaaagctccctatggacgagcaaagaaactttgggacaccgtagggtgcgatttgtgcctcgatcacctgccccgtctcactcagccctagaacagcattgcatcctgcaggcaccatgtttgattaaaggcaaatttggaattttagtgagatgtcctcatccttccctgaagaccagaattgagaagagctgtttaaagggggaaacatgacaaccagtgtccgccataaatctgcatggagccccagcctctccaccactggtttaaagtgccatccgccaggtctccaaagccccggccctggacagtgtcccatcccgcccccgccacctgccaccatcactgctcatctgaacacccagtccgagtgtccccagcctgtggcttcagccctctccatgctcatatctctccctcctctgctcactctgggagggctgcaaacctccccattcagccctgctcccccgacaggtcatgacagggaagggggatgcccagagttaaatagggtgagagccgcgtctagcatgggctgagaggagcccctgggaagtgagggaccacaggccacagggactcataactcacggcacaggagctgccaccacactcgtccccagaaacacaggacagcccgatctccactgcacctgcgtctatcccagggggaggaacagccagcaaacggtctctttcataagaaacagggtcccattcactggaaatacttcaggaaaacgaacctgaaattctggacctgcctccaagccactgattgttacaaaaagcgtagactgaggcctcatgtccccatgccccatgaatatacagggaatgtgtagctccaggaaagaggaacggcacccactacgaacctctcctaaaagccatgtcttctagtcaggaaactgtccagtcaccattgctggatgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaagggaaagcctggggcccctgtcccggcagtgcacttacgatggggctagcgttgatgtagtctgagtggctgtggctgttctccgccttcagcaggacccgggagtggtcatctgcaaggacacagtgcaggggtcagaggaacattggcccacccagcagtgtgagacccccacttggcctccagggccccccacccagcagcacaggacccctgcccagcctccagggtccatcacacagcagtgtgggactcccaaacagcctccagggcctatagcccagcagtgtgggacccctgcccgggctccagggcccacccgcatcctctcccaggactctgctcacacccttctgaatgtggtttccaatgttcctgctcccatcctcccctccgtttgtgatcctccaggtgggaggcagacgaacggcatgtggggaactggcacaaagctcccgctcagcagaatggagatatcctggtgttttcccccacgtggagttcacacaccaaggtcaggggttcctctgcagaattttataccatgctggcctttaaatcacagacacacttggcaacacacagcaggtaaacagaaatatgaacgttaagcaatcgcccgcgtttcaaaatagaaagtttcatagtcaatgaacagttaagtcctcaagattactggaatttagttttaaaaggagagtaagagacaaataaaatgcagataaagaggaaatggaggaaaaatgtactggtggagactggcataaaaactcgctcggacagacagagtaacctgacggctgctgaagccgggcgcagcggggggacagtaggcacttgtgacgtgtgtgatatgagagctgtcttggctttggttctgggataacccccatcctgcttgctgtggccgccctcctctttgctctgtttttagaaacttcgacaagcagagctcacagaggagtggaagccgcaagagcccctcctgcacctcccaactccctggtgtgtggccgcttccttctctctgcaaggtgcgctttgtgttacaggatctttggggtggtgtttttctggccagaaatctctgtggccggtggcgcctttgcccaagttttgctcaggctgggcctggcaggccacgtttggctcacactaccagcctgggtcccatgcctgccaagggcgagtcaggcatggagtggcgaggggtgtgtgaggagcacggggtctggccacaccagtcaggcacgctgggtgctgcagcagggtgggcagctccaggtgccagcatgggtgcgggctctctgtgaggctgcggccagaccagacacactgcaagcagcttccatggttgacactgaggaacatggtagctcctggaagtttggagataccaggaaccacagggtcccaaagatggagtcacaggcctagctccgggagctcccaggtctgggctccctgaagggctacagctgttctctccttctcttcacccacagtgtggcgagcagggggcatgtctcagccctgtttgtgctacagctcttctagccccaccattcgacaggtcctgagttcttgttctgcgaccaggaagaatgaggtatggagacaagtggaggatgagcaagatgaagaggggtttatcgagcaatagaacagctcagtctcccacagggggcagctcctttctgcagccagggggtcccgatgagtgttcagctcctagcaaaggggaggctctggagtgggtagctcctctctgcagctggtcatccccatgtctgcccagctctggctatgcctggggcatttatgggcctcagaggggaggaagtacatgctgattggcccacgagtggccgtgggcaggcctggaaaaggcaccatgagttcccactctgatccacaggacttgcagcccagcccccagccttcaaaccctccctggcctgaaggtggtgcttcatggaggacctgcccccttttgcccaggaatctctgtctcctgctgccattcatggcacccaggctgtttgtgccaaggggcacctgcaggccagagctgagctgccctcagccctccttcggcttccctcccatgcttgttggtgcccaaagtccagagggggctgaggtggcagggggctggtgtgtcagcactgcccagagtgtcacacctgctgggctgtgacagcgcccgggctcagccctgactttgctccaagatcagcatgggtgccaacagcagggagaatccaggtagcaggaacaggcacttcctgcaggggcaaggatcttcttcctgggtgcctaagtgtgcagggctgcctgggtctgcagctacggtttgggcagctgtagctcctccccagcgtgggggtgggggtggggtcctgcctgccgcgtggaacaggatgcccaggttacgcctccctgctgcagctggtgtgatggtagtggccactccagagggcctgtcactgccatccctggctgaaatctggaagcaacaacatctcggctctgctgccgtttgtcccagggaaaacctcttggtgctgcacacaacaccaatttccatcttttctgagaaaacaaaagcaccctcgctggagccctcggaggccagtgcttggtggccgtgggtcccctctggacctgtggccaaactccaaactcgctgcgcacctcctgtgggcgctggcaccagaaggaagtggccccaatcatggagcagtgtggtggtggtgaagctgcacggactctgcttctctacgcaattctttcatttttcttggagattttacttacagtttttaaaacaacaaatcctagggcttggaaaacttagtgagtgttttaactgattgaactaggaaagtactgtgcactagagatcaatacactccaggttggatgctgtcctgacaccttccttcaggtaggaatgtcagcctctttcaggggtgacaagatgggataagataaaacatctagagagaggagaagaatgcatgtgtacatacgcacatgctctatgcagctgaatgcctcaggaatgtcatgaagctgcaagtcatcccatcagctctgaacgaaggtgtgaatgatgcaaaaatcccagggactcaatggcttttagctcctgcacaaattagttcttggagagtgaaaattggcagtggcaggaaattgtaatacaaatcatcagaaaaaaactggttgactctgacatctgaacaccccacacacactactccaaacattgattccagaaacccagtttcacagtggggccacacagacaccgcagccagagatgaggctgtggtcagaggtgctgggctgggcccggtgctgcagcccacacagagcgtgggaataaaagcaggggcttctggctgcttccaggggcctctagggccctgcctcattttcagcacagccacctttaggcacttgtgagaccagcaactgcggaccgttcttacgtgtctgagaaggcattaccaagagcagggtcaggagggagcagggcagggaacaggcagcgcagcctggagccctcaggcttttgacctggcttggtctcgtgctttgatggtgcccacggcaccctgagaccagtggcctggcctctacggagggcagaggaggcatcagggcagcgtgctgggagctcctcctcagctgaggggtccctgctgccaggccctgtgagcaacaggccacggggaaagtggccactgccattggactcagcagacaagtgccagctggattttctcattggaaaattaagaaaatgcttccctagctcgggagtcctggggagttagacatgcattctacgagcccggccctctcctctcgatggcagagggggaatctgccatgggcacctgagccctgctggcaagtggacaatccatgggcttcttggtggaaaattgttttagccgaattcatttcccccgaggtcaccctttaaagatggcactgagtcaaggacccggcttccatgacttcggagagctcctacttcctgatcgcatatttgattttgtgtcaacatattgcttttgaaattaccagcgaagtcttttttttaaagagacagggtcttgctccgtcacccaagctcaagtgcagtggcacaatattggatcactgcaacctccacctctcgggttcaagtgattctcctgcctcagcctcccgagtagctgggactacaggcacgcaccactgcacatggctaatttttgtatttttagtagagacagggcttcaccatgttggccagggtggtctcaaactcctgacctcagatgatccacctgcctcggcctcccaaagtgctgggattacaggcatgagccactgtgcctggccagcaaaatcattgtgtttgtaatatggggtcatttggaacctccgggaaatgcttggagccatcctgggagggccaagggacgctgcaggctgtggaggagggcggactctgattcctgcagggggcggcaaccgttcctcgtgcggagagttcatgtgcctggcgaatctctattttgtgattctcttactttttatgagatgttttgagagcaaataggatgatgccatccagttcccgagtcccctaaagggcagtttccttgacgtgcgaggcctgtggaggggtcttcgtgttctatgaagtgaagggaagcaggtggcctggggcctctcaaggccaaccccaggctggagatgaagccagggcaggcccacgcgcaatcagccctggcctgtgctcggggaactgaaggctgctcccttctgttgtcaaatgaaatatcagacctccctggggaggcaacacagagcaatggcgggaaccacagggtgagaattcataacagcctggggctcatgtttccattaagaacgggtgtgctctatcaaaaccgtagtctgagaatttactgagaggccaggaaaatgtgggaactcacgtagagtcttccttcacctggccctataactgagttaatgtcattgggttaaattaacccactgtgcacgttccttttctgaccctttactgtgtttatcatgcgttagtgccttgttcaacaatatttcaggccggccgcggtggctcacacctataatcccagtactttgggaggctgaggtgggtggatcacctgaggtcaggagttcgagaccagtctggccaaagtggcaaaaccacgtctctactaaaaatacaaaaattagccaggcgtggtggtgggcggctgtaatcccagctacttgggaggctgaggcaggagaattgcttgaacccgggaggcagaggttgcagtgagctgagactgtgccattgcactccagcctggacaacaagagtgaaactctgtctcaaaaaaatttttttttaaatataaaaaaaaagagtatttcaaatttctcagatgttccatattttcacggattagatcctcttctctcatcctggacccagtggccatcctggaccacggacagaacagggactactttcccgttttaggctgaagaaactaagactcataaggatggaacgattcacgtggccacggcctcgtggtccacaggggagcacagggtttgactcccagccccactgcttgccagcgggcgatcctgggtaaactgttcagtgttcggagaatgcaggatgataacatacaactcacagcactgttgtggtaaatggcacgcagcaagcaatgaggagcaaggctgagatgacggtggacacgcacccaactgcgcaggtcagccaagctggcaaagcgtgttcttgctgccccgtggtggcagaacatatggagcgatttttcatagatgccaacagaagagacacatcccacaatttcttgttgattattactatggcaaagagccttgggagatggcccagctaagcatgctagaggacgcggcggtatagtcattaatcatgatctagaacctcccgtgcccaccccactgcatctgaggaaagcgtgtggaagactcctctgcccggaacatcgtcttgctacacagatccctgaggacggcattcccccaggcctcctggcttgctgtccacactcaggaagctgctctgcagggccaagaatctgcctcccaccagcacatgggctccacggtgctgctgtttggaggatgcgtgaggccatctgtgaagccactgctgagtccaggggcctcacggaacttggcaatggggttccctcctcccaggggcctcacggaactcggcaatggggttccttccactcaggggtctcaggtgttctctcgggctctccaactgcctctgctttctgtgaaggtttaggctcagtcatttatgctggcaggaggccctcttcttcatgttgatggtgtggcctgtggagaggtggagccggtgtcttgctcctagagggagtcctgactccagcagagaacatgttccgggatgtgctccacagttggcaccagcacccacaagctcctgctccgagtttatggtgtccatcgaggtctgagggctgcaaaggcacatcccggggctgctggccgtcagcaagggccgtcagtgctgcttagggatcccagcggctcacacacagaaaggcctttgaacttgtcatagttgaggcaaaggaataaatgatcggaccacgtttgtttcaatactctgagaagctacatgggcttgattctttgcagacctgggcacttgaagaccagcaacagcgtgatgacagaacgcattctgaaggggcaggtcctcttcctcccacacgctcctgtccttagtcagcaggcagacattctgcttccaactatgcctttgggaaatgctcagctcaagctataaagctcatcgaacatttaggaaagtcagctgagtgtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccggcttccacactggacgcgtcaaaagcaggtcccagaggagcaacagtggccccaaatggcatggtcacaaggctggtttagtgtctcatgtcttaaatggtttcactggcatcccccacagacagatctctcagaaagtcgccccccaatgggatcggaagcatgttgggcaggtgacctggggcaggtggactagaaggagcctcaagccctgggggattcccatacctgaagcgattttaacccacactagtctcatctcaggcatctgtgtagaaggaactccccaggcagggctatgcgggggcagaatgcagggggaacagacgccaaaggtgtgtgggggttgccgtggccaggcagcgcccgcccagtcactgagctgacttggaggcaccaggtcccagggttgagctgcgtaccctcccccaaaaagacacactggagtcccagccctgggaacatgaccttatttggaaatagggtctttacagaggtaagcgagcggagggcatttgggcggccctaatgcaatatgactggcgtgctgttaggaagaaggactctgcacacccacacgggagggagagcgcccgtgtgaagacgaagacagccgcggtcatgctggggacacgcggagggagcgcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgtggtcgtgctgaggagcgaggcctccagagaagccagccctgctgacaccctgacctccatttctggcctccggaatgggagacagcctgctttggccacatacactgcccatccctggcgctctgtccctgcagccctccaggcccagagcacctggagcgacctgggtttggcttcccatgccctgagcagcacctggtgcctgcacggagaaagcgccgcctggagccagcctgcagttgtggagtgtgggcaacccagagaccagctccagacacacagcgaggcgtggctgtgtgcgctggtggcgactttctcgcaggaactagaacagtttgctgtaacaggagcacagatatcagacaggcagggccacgctgtctgcacggctccaccgagaggccgtccatcgacactgatgacgaatctcgtctgtgcgagcagcgcagatgagtgtggcggcggcaagacagagacacaaacggctggggggcgcctccaaggagctgaaactaggagcagggggcagctcacacgccttatcaccaggacacagggtatcaccagaagaacagctctggcttgtggctgtgctgcctgagattaacgcccgttttgtggatcgggggcagaagctgcacctgtgaccgacggtcttggggctgccaggggagccgcagaaggcagtgacctctgaccccacagcacggggcgcagggcagactgtgccaagcaggcgcgtctggaaaagtaagggaggaaattcggcgggaacctacacattagctccctagaggcgtaactgatgggcaggtgtggaaaacgcccaaacagctcgcgggagcaactcacttccgccgcacgggaggggtcgcggtcaaagggcatccacagaggcgctggggtgaagcggggaagcgggtgggagcagctccggcggcacaccccggccagggcagggccccccacaccccacggcagccgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaagcggtccgcaaacaggtcgagggcgctgacgaggccgttttctgggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctcaatcgacagaacgtgtcacctcaggcccaggagagcagggtccggggcgcgtcctcagaagccggcagggcgggctcctcgctgagccgcagggcgagcccggcttgggcctcttcccgcgggaggaggccgccgcgttccttccccggttctccagccgaccccgccgcctccgtctcccacacgcagggaccctctcccgacaccggcctgcctggaacgtgccagaatcgtctccctaacccggcggccgtggatgagcaaacctgcacccgcggcagcctgaactgccgtttgtcgcgtagtcctcgagtctcggagcgcaggggtcccgagggcaccccgggccgccgtcctgcggcccccccacagtgtgccgggactcggggtctctcaccacgagcagacctcggcgctgctatccggactcctcgagccccttacaggccacatggccaggggcgaccctcccgtcacaactgtgactctgtgagctcacagggctggcctccacattcttgctggtggaagaccacaagcaacgggatgccttggaaagcatcgttctgcagcaggactgctcaaccggccaatcagaacacagggaaccatgaaagaggtgggaggaggaaaaaggaggacggagaggagggggaagacaggggaggaagggggaggacaggggagggccagggtggagctcagggccaaggcagggtttgaagtctgtggcccgtggcaaggtcgcagagcaggctggtcatgttcctacagcatcgtggagacctgtacactccgggttcttgggaaacgggggttctggaagggggcaggtgagcttctcgtgggcttgcagagttccctacagacttccacatggagagtctgtgattgtttggaatgggaaagtggtcactaaaagaacagctttattaggtaccattcatatcaggaaaaaaagtcagggacagctgtttcaaaattaaaaagacgaaagagacacaaaacccaaaatgcaatgatgaatcttgactgcatcctggtggaaaaaacaaaacagacaacagataacagaccgtgttgtagagaaagcggcgggagtccctgggagtgtgtgatagcaatggcgctgtgggctgagctgtgccctgatgcccctgtgtgacgaccccaacccccaggactgcggagtgtggccatgtttggagacagggcctctagagaggccagtaagtgaaggtgaggtcctgagggggggcctagtgcagtgggtctgctgtccttaaacaaaggggacccttagttacagacagcacctgcaagccccagggagggcctcggacacggccagccctgccacatcctggaccgcagcctccggcctccaggactatggggaaatgcaattctgtggtttcacctgctcatctgctgtctccaaagcctgggcagatgggcacagctgggtgttagagggcactgagggattgttgttaattttcttagttataacggggctgcagctacctaggagaaggcccttgtatttaggacctgcaggcaggctaaagtatttggacgtcatgacgcctgatacttacttgaagtcgtccagccagaaaataaatgaagtgctcgcaggtcacgctaatacggccaacactgggcggctggccagcgtgggtggtgggtgtgcaggcgatgccacgctaccccttccacttgagtgtttaaaactcttgtaataaaaagtgggggaggaagtcatgctaagccagccacacttctgctccagagagggccctgcaagagcggtgtgcgtgggttgcggctgggtctgcgctggggtagtgtaggctgcactctccggggagccgctgaccttgggctccctaacctccttcagccccagctctgtccctgtgtgaatctcagggctgtttcgaggatgaaaaggaggtgtttagccccgagcctcacgtggaaacatctgatgagcctttgccaatatgctcgggacctggggacggctggggtgaccccatcgcaaggccgggccgtggaaacaatctcagccctggaaccagcgcctgggaagtcccgcggtggatccgcgtcacgggggaggattggctcagcactggtcctgcggaatgtgtttttatcaatgacttgacgacgtgaaaaacatgtttataaaacgagcagatggtgccgagctgagagggaggtgacgcagtgactcaggaaccacaagctctggaggctgaacgagaatcggttacaggagatgaacacaaggctcgattctcctgttaaacttgactgtcaccaacggggggtggggggtgcgcgaggccctgggctccaccgaagaccttaaggaaaagactctggatgttagtgggttcggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgcccaggagacggtgagcccggctgctgccaccccgaaggccaggctcgccccacactgtgagaccctccccacacgaagattctgtaagcggaatcggaaggaggatgtgagaaggacgggtagccatgccacaccaggccagacatcttaccaacctatcggttcagttttaagaaagagagcaaagaggatctaaaatctgaactttgagcagctgaactgtgtggagtatcaacgtggctcctgacaaccccaccggcactgtttctttgcactggaggtcctgaagagctcacggaaggtgcacttgcagttgtagttcagagatgatgcttttagacaatctttcccttcgagaagtagcctaatgagaaggactctgtagatctcttcctaaaaaagaatcctcagtctctggcagaacagctgcccagaacagcttctgcctgtgaggtagcaaagaaaaaggcccacacagaatttgctgggatattttctttccaacaccaacaaaccgacagccttcccaaatcctagggcagagtcggctggcactgagatcaaaaggggtgaagggaaggcagccaggctgggagtctctctccagcaactttcttggcgaggtgacatatatgcccagaacctttttctatggaaggaaaaagaaaaccctggcttaatcatcagagttaggagaatcacccacgtattcatctttaaaagcaaatcatgataacttttggtcactcagaagtaaccaaggcaaaatattcctcttaggggactctgtttagagttttgggagagaaaaaaaaaaaaactaaaccaaaggtttatttagaaataaattgttttctgagtattctaaggaaagctatgcttagccaaagtgcttcagcccttgtacatgtttcaaatacttctgtagaagtttgaaatggacatggattttcccaacacacacgcacaatctcaggtgagcccaagacagcctatgaggatggcactggggagtctggatttcagctctgacgggcgggctctaaaccccaaagttcttgtcggccaagtgggggggtttcttgtgaggaccagaggtggcacatccacgggcatgggggacgctggctcacgatgccccagtgatgccgtggttaggacactgctcacgcagctgcagcgcagagcacgggggacgctggctcacgatgccccagtgatgccgtggttaggacgccgttcacgcagctgcagcgcagagcacgggggacgctggctcacgatgccccagtgatgccgtggttaggacgccgttcacgcagctgcagcgcagagcacgggcgacgctggctcacgatgccccagtgatgccgtggttaggacgccgttcacgcagctgcagcgcagagcacgggcgacgctggctcacgatgccccagtgatgctgtggttaggacgctgttcacgcagctgcagcgcagagcacgggggatgctggctcacgatgccccagtgatgccatggttaggatgctgctcaagcagctgcagcgcagggccagtgtggtgaccctgactcctgggaacggtgatcagctgggcctctgcctcactggaccacgctgcaaggcaagggcctgggagatgcccacagccgcgcctctggctgtgaggcagctgtggtcctccagcagcaatgccctcagaagctgggagatgtgaaccccacatgactctcctccttgctgtcttcctgtccctgagccttcagctcttcgttgtctctgtcttgtctctctgcattgtttgtcctggttctctctctctctctcgttattacaacatagagccaaaaatacttttttgtttaggatatggcaccaaaatagtatcatatccctgttcttcatctgaaatgcagacaagcgaaatgctgcataattcttttttaaacattcaaaaaacagaaaatgcatgttaagttctttaaacttctgagataatacaactagacctagcatggtgccagccaagcattgcataatgtgtgtttccttctcctttgggggctcattccgatcagggtgcatctgggaagtcgggcgactgtgtccatctcctgggtggaagaatgacccagggaagtgctccatggggaaggcggggcatgagagaagggaggggtggtcccgaggaccctttccatagacctgggagttcccggtgagcacgcggaaaggacgcggtgggagcggcaggtgcagagggaggacttgaaggttccatccctaacagaggacagcgtggccgagtactcatgcttccaaccctgcacagaggatagtgcatgcccagcatgcagactcgcttccatcgcgacacagaggacagcatggagcccagctcgagtgccgtccccccaccatgacagcgcagcatgggccttccaagccacagagccacagggaagccagtcctcctggaccgtgtgtggctgttttggagccagttgtgtcctgtgaagagcgcagcggccgcaggtgaggcaggagtgaagatggaggaggcggccatctctctggggcctggcaacagcgagagcttttgccaagccactgtctcccggaggacaagatctccttcccaaaagcaagatggccaagagtatggagaagaaagtaggtaatacaagtttgctcagaataaacctatgtgttcatgaaaatatttctatctagggttctcccaggaggtgaacttgccgttctctgtcttccctggtggcctctcaaccctgaagggcagtgctgtgtcttcacaccctggcacatgggtcgggagaaccctgggaggaggtgcaggcagcttctttctggctccagtgcgagtctcgggagggaggtgctttccccctcacccgtcacctggctcagaatgggcagggctgtcctgatccccatgagaacatcaggcgcccatccacatgtggccaccctgttggcaccggctgctacctggggaggctgcctgtgtcccatctgagcacggaccacttcaccatcactaggtccctcgcccccaacccccccatccacactgtacagacagagcccagaaggctgcagggcacacgggaggaaaaccccatcggcaggtcgtttctgccacgctccgggctgtctttggggagggcgtgctgtcagatgaatatttaccatgaaacacctcacaatctaagtaaatgaccagacacacagagacatataatgcacgcttactgcatggctatttaccacgaaccattctccactcaggactcagcaggatacccgctcaccaccaccctcacttgtcctaccacaccggcttcactccccgccctctcctcccccaggctgctcctctctgaggacagtggccaggcccccagagcctgttagtagcccccgacacagggccggtgcttagtaaatatctgttagttggctaatgggatgtattgtattttgcttttcttctaaatataaaatttataaatcacacagcttctgtttttagatctctttagggttaaaaccctcagacctcatagaaactggtctgaacactaaatgggtagcaagaagcgtgcacccagctgggtgaatgggattttacacaggtctgcagtgccccaggttagtttctgaagcaaaacaagattccagcttctcactgttctgacctgtaacacttcctgagggctggaaggagggcaagggcagtgcctctccctggcgtggggggctgtgctgctggtacggggacaggcggtgtctcagggacaccagtctgatcccttgaccggctccgaagggttgaggcagggacacagtgacggagagacggcctcggccacaggggacactggtcccgcctgatgctgagctgaaagtgagtgtggccgagtggtgctctcgaagtgtgagctgacgaagctccctctgttgcatcagagacatgcgcaagggccttgtcttagggtcctcaggagagtaactaagaaactctacccacactgtcatttatcattcatcactcaacgttgtgagtatctacttccccctgaaactctggtcaggaacatatctaggacccccttcctcctggcgggtgggtttataaccaatcaaagtgtggaaccttcattggaacctgctatacacatagaggatgagtgaggtggacgccagcgccgggcagtccttgccctcctcatcttgtaagcagcttagtgcctcccgtgctgtgggaacacgaggcggtgtctcttccagtccacgagagtcactcggagaactgctggcttatatttccattttctggcagtgatccctagctaggtagtaggtgctcagtttgtggaaataattgtaaagttaaagatgctgtaaaagcaaccactgttgattgtgtgcctgcgacgtaccggtgctatgctaatgacctcgtctaacccttacagcagtaatacttcaaggacgacagcgtgaccccaattacagatgtgacgtggaggctccaagaggttcaggaacatgtctcaagtcactcggtgacagagaacaatagagctgatgctcactggggtgcagatgtccccaggcccgtgctggaggaaaggaagacactggttccttgttggttgggctggggatggcatcgcagaggggagattcccaggagggccttcccagagggggcaagtctgctgcaggcggggggtgccgggaaggagaagcggagggctttgcagaccctcaggatggggctgtttcccccgcctgtaacccaggcctccctccccggggactggtacacacaggtcagcatggccagtttcccccgcctgtaacccaggcctcctgcccccgggactggtatgtacaggtcagcatggccagtttcccccgcctgtaacccaggcctcctgcccccgggactggtatgtacaggtcagcatggccagtttccccctcctgtcaccctggccacctgcccccggggctggtatgtacaggtcagcacggccagtttccccctcctgtaacccagtcctcccgcccccggtgctggtatgtacaggtcagcacggctagtttccactgcctgtaacccaggcctcccgtccccggggctggtacacacaggtcagcacggccagtttcctccgcccggaaccctggcctcctgccctcgggcctggtatgtacaggtcagcacggccagtttccaccgcccgtaacccaggcttcctgcccccggggctggtacgtacaggtcagcacggccagggagcggttcttgggcacgttctcctccctctgggccacgaacgagctgttgggctccgcctggtaggcgcacagcgcttcccactccttctccagccggttcttgttcttcaggtggtcctccatgtaggactgaaagggaaacacagggtcaggagcgcacctaggtggtgagcccagaccggcagatgcacaaaaggcagcggaggcctttgcactcgccgcgtgggccatgcccaccttgctcacgagcctgggccatggtgcgacgttgtgctacggtgcacaatgcatatcataccatgcaaccgttaagtgaaatatgtgcattgttaacacacattttacatatgtaaatataaactccggtgtttgggaatcagtttaccgctgagatgacaacaattatcacatgctttaacgacagggccagggagctcagaccaagctctcggtggggctgctccgcgtgcccatttctgcttgcatggaagtcatttttcttaaaaccggcgcacgtttctgaacccactgggtgtgatgcagttgagagactgggctgctctgatctgtgcaaaatgcgggacagcttctagcatgaaacaaacacaaatggatggaagcaaatattttaacccttggctgtttcgatcttaatttttctggtgcttgtcgttgagcattactatgagtagacaaggaaacaaaggcctcctgaaaattcccttccacaaaaacccccatgccgccagcacagcccactcggttcttattcatctgtaccgttgagaacaagccctgattttaagaaagaacatttcaaaggaccaaacccagctgcactatggcaccacaggaagtgacggcctcgtctgctgtcactctgcttgtggatttgcaaggtactgtgtgtcatgtgtagacacaggttccaagtgtgtccacacgagaaaataaagcatgcatgtgtacacatggtcctttgctgcaaagcggccacgcattccaatgtcaggcccggggtccaagcccttctcaccttctgcccaccccctgacatccccttcgattgatccgaggagctgggatggtccctccctgcccactggggcccgttccaggagacaggtagagaaagagacacagagggagggagggctggacacggcgaggcgggaatctcaggtcatcgtgccgtctagtggaagttttgaccacagccaacctgaacccatgcagcaaacacacaccctgctgtgctggcccagctcacacgggagcaggtgcatcgggcacctgtgctgtttgcgcgacacccccgcatctgggtgggtgtggtggtgagggacaatcgcctggctcagggtgggcactctaaggccgtctgttgggaggtcccaggttgtcactgtcacccccaccatggccctgcttgagctagttgggaaaagcagagggactccagtgccgttgagaagccgcaccgactgcctgctccacgcagcgaacgcttttcccccaccacaccttgagccttgggagcacacctgcgccaggaacagaaacatcagggctgctctgagccaaagcgaacgagttcatctactcccgtcaccagccccgacacccaggaagcctcgtggtttccttgtgcatggaagaagcaccccacagagatgtctcgagttgtgaaattaggcaaaattcaaatggctcaatctaggaaatgctacacattctttcttttgagacaatcattatggaacatcaaattcatatttttgtaccaaagttaccctaataggaaaaacatttttggatgatataatatttaagttttgtgaaaatactgaccagctcatctagcccaaatctggtgtgtgagggaagctgggaggttgatagttatggtgaaaggatagtcccagtctgtttctgtggctacttttctcaagttgggcttacgtagagttctacaaataggtaggtcgaaaatggttcctggcaaaatcattctgggtcctagcttttctttgaaaaatgctcttttcataaaatccatcacaaacaaatgggcttccttcagtaaaacatgatgggttctaaaatgatgaaccctagcaggtttaatccaatcgaaaatattatctgcaaaagaggcactggatattatcttaattcgtataaactacagctatttaaattctcacatttatcttaactataggaagcaaaattacactctaagttctcttgaatttctaaatttatggcaaaaatataaactgagcctgtgtggcccaaggttgggtggtaggagggaggaagaggtagatactgacgcgatgttttttcacggagaatgaagtcatctgcagaggcacgtgactctattaaaactgagatagagctgacatctctctgcacacgccactccagtgggctgtgtttgtcccgttctgctcatttcaatttgatctgttctgtattcttctatcaatattttttatgaaacatcctttgtgatattaaactgatgaaatatcccccaactacatcttaggagtcttttttctctttcatggcttgtagataagatgcttttcatctgtgagtctgtggggaagctaggccttcatagcaaagtaatgttttaaacaatgaaagcaaaaccaaaaggtaccacgggagcttagtacagatgctcccctacttatgatgggttatggcccaagaacttcttaagttgaaagtgcattgaggccgggctcggtggctcacgcctataatcctagcactttggaaggctgaggcgggtggatcacctgaggccaggagttcgagaccagcctggccaacatggtgaaaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagctgagcctagcctgccttacacatgctcagaatacctaccttcctctgctgctgggcaaacccatctcacacaaagcctactgaggataaagtgttgaatatcttacatgattcattgaacactgaactgaaagtgagtaacagaatggttgcatgggtacttgaagttcagtttctatttaatgcgtgttgcttctgcactgtaaagtcaaaccatcataagttgggggccgtctatactgtggtcatcctgcatgtgaacttggacaagtatagcaactctactcagacgtcttctggaattattaggaaattaacatgtaatttaaacagtatttgtggcttttccctggtagtgggcatttagctataggtgtttttaaaactgacatttaagcaaacaaatcagtaagaaaaaaaaacacaatcctatcaaaaagtgggctaaggacatgaatagacaattctcaaaagaagatatacaaatgaccaacagacatatgaaaaaatgctcaacatcactaatgatcagggaaatgcatatcaaaaccacaatgcaataccaccttcctcctgcaagaatggccataaccaaaaaatcaataaacagtagatgttggtgtggatgcagtgaacagggaacacttcttcgctgctgatgggaatgtaaactagtacagccactatagaaaacagtgtggagatttgttaaagaactaaaagtagaaataccatatgatccggcaatcccactactgggtatttacctagaggaaaagatgtcattatacgaaaaatatacttgcacatgcatgtttatagcagcacaattcacagctataaaattgtggaacaaacccaaatgcttatcaatcaatgagaggataaggaaactgtggtacatacatatgatggaatactacacagccataaaaaggaatgaattaacagcatttgcagtgacccggatgagactggagactattcttccaagttaagtaactcaggaatggaaaacccaaccatatgttctcactaatatgtgggagctaagctatgaggatgcagaggcataagaaagatacaatggactttggggacttgaggggaggagaaggaggggggcgagggataaaagattaacaaatatggtgcagtgtatactgctcaggtgatatgtcaccaaaatctcacaaatcaccactaaagaacttattcatgtaactaaataccacctgtaccccaataaatggaaaaaaatcataaaaaagttagctcagaaaaaaaaccttgacatttaaattcttttattttatagatgagtgcatgtgtgagagagtgtggtggtgggacggcttagtttcttaaggcactgcaacttttgttacataaatagcatatgtagaaaagaaaagaaaatgaagataagcagaatggcaacgaataaccccagggcccacagcaaactgtaaggcaaccttttcccccagtgctgagtaccttcatttcagctttggacatcctcaacagaatacaatttactgctttaaagtgaaaaaatgcagagatgaggctcacatcttacagataaggaaaccaaggcctagagaaggtaagcaattggtccacagcccccagcagccagtggcagcaccaaagcctgagcctggcctctgaaatgccctgtgggttttctcctggcccgtcactgcagccttctcgctgatcttcttaccatcgcttcccctttccagttgctttttcactgaacgaccaggttggcgtttctggtgcaaaatataacctatttaaaaaaattaccaagggtgcctagactagcattgtcctttttctgaatttccttttactaatctgatactttctatcccataagactgcttctcagcctttgccccgtccccaccgccatccttctctacattttgtgctgatttttctgtaatgaaccgacccagacttcaaggtgcagttcagacaacacttcctcctccaggagtccggtcaggacatgcccattacctaccccaccccatgatctttcttccctataacccaccccccacatcaaacagttactacttcaaacatacgtctctgtggcattcgtcacattcttcctgttgctttaactgtgggtttcaagctctgattcttctcatgagattaatttttttagggcagggactgtgtttcagctgctcagcacaggcagcaagcactcagccaatatctgtggaataataatgcataatctggaaatctctacaagtgatttatattataggtaaacattttattttgatgatgggcatccaaaacactgcctttgaatcttctgaaacttggaagaacttctccaaaaaggagcataaggaacttggaatgttttactatacatgaccttgctgccatcttcctttctggggttgcccagcaaacatcactgtaactcatgacagacaggtgtcagctcattgagtgttcctgtaacaacctgaacctaacagcagtcgtataaatttggaagggcaacagttcagagagctcttctctacaagtctcctccacaactcttctccttttttcacatctccctcattctccacagtccaggtcccaggtggggtgctccatctcccctggagccttctcagtggcctccaggcaccagtgtgcaccgcacctgcagctgggtctcctccggggcgtgagctcctggtggtcagggaccccttctcacaccgtgtcccacttcacacagctccttgctctgggctctccgtcagtgcctctgagttgaagctttatgaagaaagctctagaatgagctgactgaggctgacaataccagagggagtgagccagtgaaggcgggattgcaccacaatgcgtgctcacatcaggaaatccatgaagagtgaaaacagggagcgaagaattggtggtgaatctcagtcgatgcaggctgaagtgcttagggaagttggagttgctgtctgttccctgatccttaggaagcgtttggaggtgtgtctttcgtcttttagagctgcttgctctataattttgggttttgaagggctcttggctgggagaactcagtctgacattttcatatttttaaactccattaagggaattttacttaagctgtttctagataagccctgagtgaaaaggtgtctccaaccttctcaaattctcatacttcctgagggcctagacatgatgtgcttgtggaagagtgaattcctagatcaaaccattcatggagaaagctacggggactcaggaagtgggtttcccaagggtgttgccaacattcactatctgacgtagatcccagagcacacgacatccacaccacagcagctgaagatgtggctgcattctttttcgcgttctcaccctttgagaatgacaccatcagcgctcacataatctactttgttagagatatgaactcaatctaaggtttcccctgtcatccttctcccgtttctgaatccatcctgccagtccctgtctcatggtgttttctagctcatcctacgagaccatttagggttggagcattaaggacagtcactgggtcacaagactgggtgctgctagacgggttttggaggaaacagcctccatgtgtcaggcaaaccaactggcttccacatttaatggaatcattatacacagaaccccaaaatttgtgtaacaaaagtgtgattgccatgaacactttgagggagaatgtgttcacaatgtattacatagcacaaatgtcgtcagcaccgtcttccggtcaaatggtcaacaccttgaggtcaaggggctgatttctaggaacacggagcacagacagtccagaacacaacagtgtctgttaacgattgcaagagcaccttctcttcaggagaggaaccaccctgtcactcgcagagatgaacatggaaaggagcttctgtggaacaggaacgcacatgaacacactgggaaggcactggactttgtgttgatagagttcttaacagtcttacacagaacggtgtgggtccctcccacagctactttttggcgtggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaaggtgtgtgcccggggatggggtgcgggacggtctcagtgtttcagtagaggaagagggtactggaaagactcctgagttccctcccacgctctgtggctgcactgcggttctggggagactcttatcctcttgtttaaggaaatacaacatgtccactctcttctgttcacttcttttttgaagagggaaatatttcatggcctgtcttcaggagaggaaatcctaggaaatgcctgtttaagagactatgtgacactaaactgctagttaacaaggacaatttctccggtgggaagagcacaccagcatcccgtgtgcatctgatgcaggacccgctcacacgaaacatgctcgccttcctgttggcaccaggaggaagtgcagctgccacctctgagtactggggtagtgcatctggagacttgtaaagggtccagatgtggttccatgtgaatcccgtccacaggcactgggatcctgggtcagccaatgctgattcacctgttcctgcagaccctgctgccaaagacaccgcagaacccatggggaggcagaagaaaggctggagcaggtcagtgctatttcagctccattcagagtcacagaaattaggttattttggcatctatctgttggctgtaacaatgaagaagtgagatactgagaggtgcaagatgatttattattattattaaaaataataatgagaataaactcccaccatgcaatactaaaactcctaaggagtcctaaggactcctaaaactcagtggactatttaaaaatgagcaaaagccggtccatctggcattatttctcatcaatcaaaccactcgtgcagtggaaagtgagtccccacggatgactggaggcgcccatcatcactccgtgggtcttcggatatgggacgagtggaaactgtcctggtgaaacttcgttcctacaacgatgctgccagcagtggagacttcttcccactgtagaacaaggcgtgttaaagaaagctgggctttggggaacccagtcattactgggaaggctatacttctcttttctacaatggcgcctattgcagcacaatgccctttaatttactgaacattacaatcaaaccttttgttaaaacgaataatagaatccctttacattttccttcttgtgacgagaccacaggtttgtgtgttgaagtcacaagttagagtaatgcttttaaaagcaaggactaagctgcttccactgccacttggggaaatgatgaccttttctttctttaaaaataaacacagtcacctgtcttcattaatacatgaacgggaaatattcatgttaaatttttgaattccaaaagtaggacaattgaattccaagcaaaactgtgaaaagatgaaaggagaagttcgatgaggttgattgtcctggctcagcacacacagctatgggggcttcgggagcagcaaacccttgatgagaaggtattttattgtctgtagattgctgcatctggcatattttaaatattatttgttaatattatgcagcaggaatgttaaaatatttaaaattagaaattcaaagtagtacatgtgaacacaaagaagaacagataatggttaaaggatcagaagatagtttcactatttcttagtttaagaaagctcttcctgaaacaggaatcccgacccatacgaccatattcaacttgccatctcactctcagaaagcaatgcccacaacgtgaggcggcagggagtgaaccggcttcttcaccatcccgctcctctaacacaccgtgtgcccgtcacggcagcacctttgacttgccatggaattacgggtcttactcaacagctgaaacaggcattgttccggctctccaaacaagcaacttgagatgcagggcagatatgcacacattaccaaaaggcacaggcccatggcagccaactcgaagtgtgcctgcatgccagggtggagtttgctcgggagaagcaaacacacggttttggaattcagcctctgggtcatccgtacaaagccaaaaagaagtagaaatgggacccaaggaattaacaagagtgtgtgaaagaccattcatggggtcttctcgcttttgatcacattttaaaaactgctttcctgacaacttgtttgtaaggaggaggcattcccacacgtatctgcagtaagtcatatgcttcccttaccgcagggaactgggaagtggtcaacacagatgaaactggcaaaagcctcctcctgtgggcaccacaactggcttccctgatggatgtgaattaatgccatttattccaagctctttctctgagagttttgtctccagctgacctattctgaggaccacctagaatctctggcaagcccagagacccttgaaaactgttctccctgcgtcttaatgtgacttagaaatccatttccattctttgccttgttaccaatcaaactgtggagtaacagaaaattataaaccattaaggtagtggagaaaagttcaaatacttcaaaatggaatcttccggagaaagtccccagttggtatgcagttcgggtggagaaggtgaagtagcagcggcaggaacaaagcgtagaaggggaaacaacgtgtggtgcgtgttggttttgagaccgggaacgctactgaactatctgctttatttaaaactttttcatcattgaaaaataaattcactcactgagaattaagaatcccagcactttgggaggctgaggcgggcggatcacgaggtcaggagatcgagaccatcctggctaacacggtgaaaccctgtctctactaaaaatacaaaaaattagccaggcgtggtggcgggcgcctgtaatcccagcactttgggaggccgaggcgggtggatcacgaggtcaggagatcgagtccatcctggctaacacggtgaaaccccgtctctgctaaaaatacaaaaaattagccaggcgtggtggtgggcacctgtagtcccagctacacaggaggctgaggcaggagaacggcgtgaacccgggaggcggagcttgcagtgagccgagattgtgccactgcactccagcctgggcgacagagcgagactccgtctcaaaaaaaaaaaaaaaaagagagaattaagaatgcccttcagataaggctgtcaagaaaatgacatgcttttttcaaagtcctgttagaaaaacactgtaagaggacagattccttgcctctaatagaggcactgggacatgatcacagaccttacgtactttccgaagagcaaagggaaaggaaggttaactctttgcaaagtggtgtgttaagaggacatgaaaactggctctatcttgattgagtagaaactttaattagtgtatttttattataatttggcttttgatgttccaaatcgataacaaagtccagagttgtaagaaatcacactgacaaaggagttcttacacaatgcccaggtgacctgcagggtacttcctggagtccacagccggcccagtctctgcctcacctctagaaggactgcatgaagacctgcgatgcgtggaaaggtggcctggtgcaccaacgcctggtgatcctcgatttcagtttatgacttccactaaacttctgttacacatttacagaaaaatatgacaatttgataaagacttaacaacaaaaaccccaatggaagatgttaatagtgaacacattgtgttctagaaatgttctaattaataaacttaaaaagataagtaattttttccttaccacctactcttactaagtaggggaaagtcttgttctttcatacgattgatggattgttttacgttgggcattttttagcaagatatcatattagggagtgtgcgtaggagggggtgacaggggtcacctgcagaaagactaagaaagaagctgtttaataatggggatgatgacagaggcatcactttgtatttcaggctgtcattctcagagaagcgcaaagaattttaaatgaacaattttatgaatcttattatcttatttaacatcttaaaaattaaggttatgtgaacataggtaaaatacagagatgaatgcttataagcaatggaaaataattcagagaattatactatgttttccataaatgtacagctattaatatttaaatttagggcaaaagaggtctgcttggcattctaagtgaaatgtgaatgcctcatctggttttgggacagagggctaagagctgctgtcatttctgtcggattcctgccgatgttgtggtggtctagtcatctgtcccttcagtcatccagtttgattaagcacgtcctataagccagggatgacctaggttcgggagcacagtagttagctggccaaagaccctgtcctcatgtggctcatttctttagtttcttttcttttcttttttttttttttgagacagagtctcactctgttgcccaggctggagtgcagtggtatgatctcagctcactgtaacctccacctcctgggttcaagcaatcctcctgcctcagcctcccaagtagctaggactacaggtgcaaaccatcatacgaaaacgaaatttttgtatttttagtagagacagggttttaccatgttggccgggctgggctcaaactcctgacctcgggtgatctgcctgccttggcctcccacagtactgggattataggcatgagctacaacgcctggcctcattaatttctttagctggagggcagaccatctgcaagtagataaacacagctttaaaaagtgatttcagacaacagtgagtagtaagaagatgcggacaagagtcacgacgcagagcctgggtgtggggacggggtgcacctgggatggcactgagggggcccctctgaagggtaaactctcagagccatgggccgagtccccgatgctaaggacctgggcagggcctgagtgggggtggggtcctacagggaagggcagtgaaggctggagcccagggcaggagggcgtggccactccgggaggagggaaggtcggggctgcagagaaggaatggatgtgagggcaacggtgtccggcagaccaggagctgttggcctgcaaggactcagcagtttattttaagagccacgggaagctttcatgagttttaagccaaagatgcttgtgatggtggttgatggtggcgcttttggaagaccaccctggttcccaggtggcagtgcaggatgcaagtcaggactgctgcagcccaccatggaagagcaggcagtggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacctaagttgtcttcagctctttagcttgcaaaatattttgtcattgtttaaactcttcacccctcacagaaccacagcaaggaaagaccctaatgatttgatctgagaagcaaggtcatacctacccttaagttacctgaagttaacagtctggataaaaacctgaaaaattctatccacaactctgatatttccaatagccttcatgcttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtgcctgtgtgcacacagggctgcgttgtcaatgcatcgcgaccgggcatggtcctgggagtgaattatcccccacaggtcagaggggccgtacgacctcttccagaccccccgggctccagttattaaatgactcctgcaatcatgaactgctttccaaagaacacaaaacaattctgtgaaagattcacaggctgacgtaggctgacaggggttctagcccattaaatccatttcaaactgaaaccagggagacagcaagtttgagaaaaccagaatttttaagagatgaaaactgcacatctgcagtggacgtggtcacctgcctgttgtccttggacaccgcgtgtgggaggagcccagaactttctaaagaacctaacaggcctccaggtcccagatgttctgaccagccagcatgtctcgagtgtgacgttaagtccagaacacacgtgaaggacggcacactggtccatctccctggacgtcctttctcctgtccacagcgacacgggctctaaccagccaacgccacgtatattgagtcagtgccattggttcagtgggaagaatcatgaggacaaagatgtaaatggcaggtgtgcgttaggcactccccataagctaactgtttgctcttcatggtgtctctaacgtctgacatagcctggtacaccctacatgatcagtaaccatgtgttggatgaactcagggtacaggcacccacggaatttcattgtgggaatgtgggagtgcctcccagtttctgatcaaaggcctcttgtgtccaaggctggtcatgtgtgccaggcacatgggtttcaggtaacagtcaccttcactttggaagtgcaggtgcaatgtactgagccacggcagtgctgccatgaaggcgtttcggacaaatggttaccagtgtttcatggaatgattttcttcaccaatatttgtcattcaccatctaaaatcaagtgaacaatcagagggggagaagggtacagatctgggacaataaaccaattttcatttttctagaattttctcctatattttattgtcttcgcctcagctcttttctctggctagcttacagactctcaccccagccaggatatctggattttctagaattttctcctatattttattttcttagccttagctgttttctctggctagcttacagactctcaccccagccaggatatttggattttctataattttctcctatattttattttcttagcctcagctctttcctctggctagcttacagtctctcaccccagccaggacatttggaactattgcataatccattcccagaatgcatgagcagctctggaccctataaaatattcattcactttcaaaaatatttgcaccctgctgtcaaatgtagacaaagtcacatgaagtatcaggaaatcgctattttaatggcaaatacttccccaaccctctctttccactaaaacattttcttcaaaattattttcataagaaagattaacaatttcaacattagctgctaatcccctttcatttaaaactctgctgataaaattctttgcttgtcattcaaacagtaagtaataattatagatttgaggcttccatctctggcttcattaatggtaaattgcatggaagtctgaagcataagtcagctttgatacatctcaaaatgcaatttccatagcttcccttggctatgtacaattaattacacagttaataagggaaatatgttaatgaaaggaacattattcatcaagaccacctgcctttaccaaatatcctttgtgtgtttctcttcttcttgtaattttggtctacagacagttaaaaaaaacaacaacaacaattgacagtgtgatgattttaataccagactgcagctacttcgattaaaacaagtctaatgaaaaattaattcagtcttataatatttctactgatttctgccttttagaagtttaaaatgtctacccatatatttctactgatttctgccttttagaagtttcaaatatttacccatggtatttcaaattcctgaaatggctatttatcaaacacaaagtttactattcaggtgtcttctttataccaggatctgcggtcatcacctttatagatgaatggaaaacactggagaactttggagaaatggcgtggaagatgaagagataatgctcaatcattctaaacagattaaactcccccaattcttttcccgtccattttaaacctctctgcttagcaataattaaatcctctcattccatttggataatcaaagtttaactatagatagtttaacacagaaaccaatgctaacctttacaaagaaagtaaatatcttctaagcctttgatgaggaagagaaatcggaatattataaccagaaaaaggaagttggaaaaaactatatttctgtttactttttataacttatttgaacaatatgaacaaatgtatttgcaaatatttgttctacaacatttttttattaatataaatcaatacacattccttattcaatgagaaaagaatttgactctagcttcgaacatatccctttgacatatgaaatatagtttaagccatgagttacttaaaaattccattagtgtgcaaaattcagctgaaaaccaaccttggattccaaacagatcataggaaaagagggtgcaagagaaagaaaacagttcatgaaatgcaacctttacgtaactaagccctgaagaggtctcctaccacactaacatattctaggagaagagcagaatctctaaagtgaacagcagcccctgtcatcccagctctgtgacaagcagccctgggtgggggaatcggggtggctcagcagcaacatccacaccagcctccagcagcctggggagtggcggtttccgtaagatcccttcaaaagccgtttcgtatcacgatttctatgctttgtgtggcagcagacccatttgtttaagtggtcatgcacccacctctccccaccctgatggtcacctacaaagcccatatggccaaaacggtatgatcagattctctcagagaccagactcctttgctggcacccgacccaggagaagcagcccagaggggaccatttttactccactgatgacgacagtggttctaacagggagacctttcagaagaaggatgaggaggggcggttgccaggcaacgcatagacagcttctcccgctcccaagtagcaggtcttttcttagcagcagcattctctattctgtgccaacgatgtactcattacgattttctgatgaagtttttaggaagaataaagagttccagcaagtgctgtaaaggttacttaggacagtgatggagacatgcatgtcttcttccataagcagaggagaaacactgaattctatagcaccttatttgaaaatgccgaagttctaaaggtgctcactgaaagtagaatgttttgatgcttcacttcctaaaacccacaggctatatgcacatgagcaataatacaagaaaaggggaacaaaacaactgacaaggtgatggcaccaaaaataccagaaagacttgcttgtctgagacaaagttaatatccagctcttcaccaaccaaacgtgatcacaaggaatggatcttgaaggggtcagtctatgtgcgagacaaagttattgtccagctcttcaccaaccaaacgtgctcacaaggaacggagcttggaggggtcagtctatgtgcgagacaaagttaatatccagctcttcaccaaccaaacgtgctcacaaggaactgagcctggagggctcagtctacctcctccaccttccagaccttcctgtgagcagtgaaatttctaaaatgttggtgaagggaagagaacattcaggcttccatagtcaaccacaattaccaagtgttgactggtcaccactcctcttccaattgctttgaaacgaggagtttggaggagaagagaacagagagctgatatgtcaaacagtgttttcacttttcagggtgaagagttagaggtgagactatcagagatattttacatcttttcccagctcagtgccagtcacacggcatggggaccaaatgacatgcccgctggcattcccagggtttggagggtgaggtgggagtggatgatcggggtcactcttcttgctgggacttctcatctgtccctccctgcagctgccttgtcgtcactcagccacgtggaccacctggacttccctaaggccatcagcattagccgtcagggcccactcgctgctcacctgctgcagaccttggcccatcagcactcccagaggcagagcattctggacacagcgatccctttgactgcttacagaaaggtgagtgtggaaacccggcggaatgtgatcattacctgctcatctttgactctagacagccatcggtaggatgtctttctttccttctttctttctttttttttttttgacagagtcttgctctgtggcccatgctggagtgcagtggtgtgatctcggctcactgcaacctctgcctcctgggttcaagtgattctcctgcctcagcctcctgagtagctgggattataggcatgcgccaccaaatctagctaagttttgtatttctggtagagatggggtttcgcctgttggccaggctggtcttgaactcctgacctcaagtgatctgcccgccttggcctcccaaagtgttggggttacaggtgtaagccactgtgcccagctatctttctttattagggagaacacacagttggttcttggaggcaattgtcaatgtgatgtgagatgaagcacagtgcggcctctgcactgttttcctttgtgtaatttgcatggcatgtgtgtttccagtgatatgaagaaggagataacctgaagtgtcttcctccacagacacgtagaatgctggacaaatggcacagtcagcctttcacagaattaagggaaatccccaggaatccaagctgaaggagaaagtgaaactggaatgggggatgtgcggcctgaagccgctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacaggaatctcgtctgtcaccatatggactcaaaatgggaagacgcttgaaacatgggcctcatccagaattgaggctcaaacacatgagtgatctgggtgaggaattgacatgaagatagtctcagtttaatgacagcctagtgtgtctggcaaaagctctcttgaggttaatactctcagaacagggccatacaaaactagaactaaagccccaccaatgaggagcttataatctggaattatagaacccaccagacaacaaactaccatgagcaaatcagcaaacatcaaagagcaggcttagacccatgagaccttaataaacgtgttagaaaccatcggataatgcattgatcatgattgaaggtgttaaagtaggaaccaacaatttaagaaaagaacaacccagcaggttgatctgaaaaagaacaaaatagaacttcaagtgaaaaccatactctttaacattataactacaatgcatggattacaggttagacactgctgaagagaaacactgtatgttggaagacagatctgaggaaattccctggaatgcaggacagaaagatagagaaaataggaaagggatttaagggacatgggaataagaaggtacaacttatttccattagaggggagaatggaagagagtcaaatgtaaattatatatggtttataattttttaggattagctggagaaaggaattctcagattcaggaatcacagtaagtttggagcaaaaattaaaaataaaataagtccttaccaagacaggacacaaggaaactccaaaacagtaaaggttaatcaggaaggagcggcccacaaaggaaccaccatcagacatagcgatcaggaaggagctagagctggcacacaaaggaaccaccatccgaccagcaacagacagtcttctcaagtgcaggggcaccagagacaagagaacagggtttcaaggtaataaaagaaaaagaaatagaacttgacccttggctaatctgttatgcaagtgtgaggatcaaagacattttcagacaaagagaaggaaactttcccaataaaagactgaaagaaggatatctttcagaaaaaaggtagttttacccaaaatgaagaattgagcagtaaaaggaatggtgatggggggagaggggaacctcataaaatgagagtcggtctgaacaaatgctgactatgaaagctagtaaaacaaacggttgatttcaggatacaaagacaaggcacaactgaaatactgaacaatactgtatgtgtcagagggaggtagctgaggtctgtgtctcaggtcctgggtttatttgtgaggagggcagaaatgtgaactccagatattgttaagccaagcatggttattaaaagtatcaggataattactaaagtataactgctgaactagccaagggggagagagggaataaagaaaacccattcattcccacagaaggcaggagaggatgctgcaacaaaatacaactcagaaaatgcagggcatatgtaaggcaaagaatgagatgtacacaggccaaacactgagtgagtgagagattagcttttttaaagaaaaacttacttggcaacatggtttctataattttagaaacgtcactgcaatactctgcagtatgttaggagattttcccacagtgggcgtcattatttttctttacggcagtatggttgcatgagttttgtaaccagccatattttgtggaaggggaagccagagttcacaggatgtaatgctggcccagatgtcacactgggaagccagactctggacgtggcaccatcttttcactgcagcaccaaatcttcctgtctttccaagatcactgtcctcttgctccagaagagaaaacactagtgacaagtcaggacccactcagtccctggctcatgcatcctaagtgctcccaccttctgcaaacgtacacaaataagtgaataatgtcgacttttcgggttcaagaagtcacaacaattacatgtggagtcaagcaccactccacatgtggacgcacaaagctacctgacgtctggctcaaggtgttcactcgagtccaggctgagctcatcttctgctccttccaccgtgaactccaattctgtgaactgccctctgcttcctgatggagctgtgctgttccctcctctgcatgccacctgcccaacacagctgtcttcaccgaccaaaacctggtctcaaatgtccacctcaagtctcctctgtagcccccctgccacgcccgacactcccgtcaaggacagagacgtcttctagcaaaagaatgcagcttggtgtgtggcaatgtctagtgtttctccagcccttcacccccttttgccccaaattggctgtaagcctcttaggagccagactgctggcctccttcacacccagcatccccatggtcctctgcccaggagccgtgctgaggacatgaaggtaagcagagcccacctgacgccagctcatttctgaactgcttgtggaatttcaaaagctgcattttattaaactcgtgttaggtttacacatttacacaaagaatcagataactccatccaggccctgaactgctgtgattcaattcctctgatgctgtctataaacctgcagatgcaggagtcactggacagaccagatggaggcggcctctggtctcgcctcctcgcctcgggtttctccaggaagtttccatgagttcccgagcagcctgtggacgtctccgtccgtcactgggtgctcagaaaacgctgcacgaatgagcactttccagacctgactttatgcaccagcttcaagtgtttcctcccacaaccgttaattcgtggacctgttaacttttaccaagtttaatgtttggttacccaatttaattcaacaagtatgagttggatgcttgattccacttcttctatcatgccccattcacacactataagaagggtctaccaagtcaagaaacagcaaaaaaaaaaaaaaaaaaaaaaaaaaaaaagcagctaaaacgcagggctgcgggacagtgggtgccatttacctaagccaatcgccccggcagccaaaggccaagctgcatcacagcagcttacctctttctcccgcagactctctggaccatcacccaccttctctggagcccaaacatccaatcaaaccaggtcgtaaatatacaggtagtccccgcttatgatggggctatggcaggataaacctctttggagttgaaaatatcattaagtcaaaaatgcactttcaacttacgatgggtttgttgggacataacccaccatctgtcatactaaagatggtacaaactcttcctatagactcagccacttgtctcgctggggccagcatggcagcagggactggtcagattggggtcagagaatttttcctttaaacattaagtgctcaaggcagaaaagacaacatattgaaaacttggagagactgaaaaataaagcactagcatggctctagcattttaagcagcaaatcagatttttaaaaaataaaaagtcaaatcactccccctcccacaaaaaaatagagttccacaccctcaataaaggcggatcatggaagggacactctctgcctgtgtcacaacccaactatccacagagcgctgcaaggggcactgtggcggaggtgtgggggctgcaggggaaggccgtgatggccgctgaccaaggcacagctgctgcaggacgggcacacccacggcccgggcatcccagggaaatccagaaccagtggctgtgactgctcccccgacggagcccctgttccttgcacagccgctgctgcctccagcctctgtctgcgcccttcccaaggaccccctgcagacacccgcacccacagtaaaggaggtgggagcaggcggccaggctccagccaggaagtgtgagctgagctctagaaagtggtggtgtctaaagtggctcaccagcctctccgtcaggcctcgaaggttcgtcaccaactcgtgcagcagatagacggcagtccgggctgtggcaggtgacagcccagggcccagacaccggccagcctcatagtgctcgccgcacgctcagctcaccagtgcggggagactggagcttcccccgtgggactgtggctggaagaccaggggcctctcatgcgctacaagctaccagaaaacactggtgtgcatcaggcgtcggtccctgttacgggctgaaccattccctagaatccatgtgctgcctccctaatcccctccaggttaccccgcaacataacctcatttgcaggtggggcctttacagagatgatggagttaaaatgaggccactggggttggccccagaccaatctgagtgaggtcctgagaagacagagcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcaggccagggcaggcccctggaggtccacagacctcacatagccagcatacgcctctcccaggagccccattcttgcttcatcaattaaagcagcactctggctgggcgcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaacaaaaaacaaaagaaaacaaaacaaaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattgatgttgcgtggacgtgccacacttgcacttggcaggctttcgaggctgctggccttgctgccatgaggactgtgtccaaaaccactcttggaaggaaccataaacggctcccaaacatgagaaagtatgctcagtctcacgcaagccagagaaacagaagtgaaaaccacttggatgcagcccttcccacctaccagcggcaaagttcaaaggttcgctgatacctgaggctgggagacctgggacagaggtaccatgtctatggcactagggggacgccatcttggcaaagattattgcagggaatgtggcagtatctatcaaaataaacaataagcatccgcgatgactcaggatctggcttctaaaaactcacatttcacatggtccgtgtagtctggagtggcaaaagtttgaaattgcctacattgcccttactaggagacagtaaatttctgtgcgtccaataacaggagaacatatggctgttaggagggtggggccgggctgtacacactcatgcagggccctctcctgagagcggcgtcatgtgaggagctgctgtttacgcaccacatgaccacagcagcaccggctggccctggggagggggctgggccccagagtcccggtgtgggtgggcacccctgccgtggttaccttccccacaatgatgccgagtggctgtaatgtcttcatgaagcacgtcccagaccaaaccagcccgggacttgcttgctgggacacagtcccaccccttggtacaatatgacaaagaaaaccacgagtttagagcttaggtcactgtaaagctgcttttgaaaaaggtgcaagacgtaagggctaaaatctttcagtttagagattagcagatgaagggcctcctttcagggaagagagtggagcctgtaccccaaaaccccaaagtagcagaaccagggatcctgctgatcactgactgaatgccaactgtttgccaggcacacagtaggcgctgcctccgcatggccttgtgatgtggtttggatctgtgtcctggccagtctcatgttgaaatgtagccccagggctggaggtggggcctggtgggaagtggctgggtcacagggtggtttctcatgggtggtttagaccatccccttggcgctgtcctcaggatagtgagcaggctttcctgagatggtgttgttaaaagtgtgcggcactccccatctgttctctccctcctgcacctgccatgtgacgtcttggctcccctttgccttccgccatgactggatacttcctgaggcctccccaggagcagaggccaccatgcttcctgtacagcctacagaaccctgagccaattcaacctcttttctttatgaattacccagcctcaggtatttctgtatagcagtgtgacaacagcctaacacacctgtctaatgaacccgggtctaattaacagcccatgtcctcccacccaggggaggcccttgcacaggggaggctgggtcccactggtaccgggccctgtgagagtctcaggtacagaacagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcagtgggtcggacccattcactgtgcaccgaactcggtgggtcagacccatccagtgtgcactgaactcggtgggtcagacccatccagggtgcactgaactcggtgggttggacccattcactgtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcggacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcagtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcagacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcggtgggtcggacccatccagcgtgcactgaactcggtgggtcggacccatccagcgtgcactgaactcggtgggtcagaccctttcactgtgcactgaactcggtgggtcagacccatccagcatgcactgaactcggtgggtcggacccatccagcgtgcactgaactcggtgggttggacccatccagcatgcactgaactcggtgggtcagaccctttcactgtgcactgaactcggtgggtcagacccattcactgtgcactgaactcggtgggtcggacccatccagtgtgcactgaactcggtgggtcggacccattcactgtgcactgaactcggtgggtcagacccatccagcgtgcactgaactcggtgggtcggacccatccagcgtgcactgaactcggtgggtcggacccatccagcgtgcactgaactcggtgggttggaccctttcactgtgcactgaacttggtgggtcagacccatccagtgtgcactgaactcggtgggtcggacccatccactgtgcactgaactcggtgggtcggatccattcactgtgcactgaactcggtgggttggacccatccagcgtgcactgaactcggtgggtcagacccattcactgtgcactgaactcggtgggtcggacccattcactgtgcactgaactcggtgggtcggacccatccagcgtgcactgaactcggtgggtcggacccattcgctgtgcactgaactcggtgggtcagacccatccagcgtgcactgaactcggtgggttggacccattcactgtgcactgaactcggtgggtcggacccatccagcgtgcactgaacttggtgggtcggacccattcactgtgcactgaactcagtgggtcagacccatccagcgtgcactgaactcggtgggtcggacccatccagcgtgcactgaactcggtgggtcagaccctttcactgtgcactgaactcggtgggtcagacccatctagcgtgcactgaactcggtgggtcggacccatccactgtgcactgaactcggtgggtcggacccattcactgtgcactgaactcggtgggtcggacccatccagcgtgcactgaactcggtgggtcggacccattcactgtgcactgaactcggtgggtccgatccattcactgtgcactgaactcggtgggtcggacccatccagcgtgcactgaactcggtgggtcggacccattcactgtgcactgaactcggtgggtcggacccattcactgtgcactgaactcggtgggtcagacccatccagtgtgcactgaacttggtgggtcggacccatccagcgtgcactgaactcggtgggtcggacccattcactgtgcactgaactcggtgggttggacccacccagggtgcactgaactcggtgggtcggacccatccagcgtgcactgaactcggtgggtcggacccatccagtgtgcactgaactcggtgggttggacccatccagcgtgcactgaactcggtgggtcggacccattcactgtgcactgaactcggtggacgcgtaaatggctctcaaaggagctccccaggcccgcaggagtgaggctgggaagtctcggggtctccagagccggctactatggcacctggacgctcctcctctcctggctctgcctcttgccccagctttccccttccctgctggtttaatgccgtctctggtcatggggctccgtgcctggtcctgtgtggcgtgaaggcttcccaaacctgcccgccggagagagacatcccccgcaggggctccccatcagggcagggcacacccccacccgccgtgctgggaaggggggactatgtacccctccatgtgcaggccttgcctatgccacgcagtcctcaatggtgagaaacagctttcctgcaaaaataggctcctccaaatgtgcgccacaaagccggcatcgtccagacagcagcaacggcctgccgtgtctgtgaacgcaggccccacaaagctggagagttcgccctgcggcctggtttactcatcaggcctccgcgccagcacccgagccagagcgagaacggccagcccagccgcgtggccccagagtgaaattctcggtggcccagtgcccctcatcctgggagagcagccatctgtgcccgtcaaccacgtgggaacgatggaatggaatcttccagaaatacagggcactgggtctgaaggtggagggactggggccaggggagcgcctgccaaggccccggcactggtggcgtggggtgcaggggaccccagcccctttctgctgcagctggtgacttgcagccttgggcagggacatctggcatggtttcgcgaggccctcctggttcggtgacttatcgctaagaactaagaagcctggagcctgacaagatcaaacaatgagagacagagatctctcaaggtgcacaggcagagacacgacgggcccagggaagactccaggcaggcaggagggccgaagttcagaggccgtgagccgtgtgggtctgaggaggtcacagcttgtgccggcatctgttggtcgccagcacagacacgcatcacgcgtctcacgctgggagttcagaaaccccacaggcaaatctgcggaaggtgcggcgcgactccacaggctggcagcaccccctccctcctcagcaaaattcatgaactttcctgttttctgtgatcatgggaaatctttggtcacttcctgcaatgcctaacttttcgtttttcacgtctctgtcactgcgcttggttttaatgtcgtcatctgtgaaatgggcctactcacagctcctgtgccctcagtgcctcaggactctccaaggatgagcgaactcaaagatcactgtccatatcctcatcttcaacactcaagaggatggattctgaaaagcacttactcagcacggctttcccaagttaagttctatattatttaagtcgaatggagaagtatgaagccaacttttttcttaacatccccactctccaaaaaacgttctctagcctttaaaggtggacgcggtggctcccggccgactcaggcgtaattagtcacatcgggacggtgacactcttctccacctcctcactcagagccagccaggcagaaatgtcacccttctgaaagcaaagtgatagggaaacagatcttgaaaaaactcgatgattctttatcttacaaaaggatgtgacaggatttcttgagaagccacgtccccgcagatgattaacacgcagccgctttgataaccgtcctgcgaagtcgccttcatcacgtccttgcttttcagagtcccgagccttgctctgagtgagcatctccgtgttgcctttcggccgtttccagagaaatgtaccggtttcttgatggaagtgtttccttcctgcctctccctcctctgagtgctccattcacccgcaggtgagcctcgactcagcttcttccagacagtccaaggcaggggcacggactgcaccttccctgcgcctgggaggcccattttccaggaacaagtgacattctgggctgggttttccctgcaaataaagccctttctccttagttcatcccagaagaaaactggaatttttaaaggacctttctaagaaaatgaaggcaaagcaacacaaaaaccagaatcaaagcccagagacagggatcaggcagagtgtagagaatgcaggcccagaggcccaaaccctaccaagcaaaggccccgccgggctctgttccttcagcacaaccccttcctctccagcccgacgcaccttcggcacaggtgaggtctcaggatgggcggcatctcagatgctcacccggttttaccctcacaggaaccccaggggaaaggcactgccatcaagcccgtctcacaggggagaagaaggttggaggtctgtcctgggacacagcacctgcaacagcaaagcgtctcagctctgacaccttgctgatggagcccagaatctgtgctccacatctagacctgaccacctgctgtcatggcagagcgggggacccagcggctgccccaatgacctgcccacccctgccccttcccatcaggctttcatgtggccccttccccgggggtccctgagacgtgtgctctccctcttgttccacctgctgggacaccttgaccaggtaactaagtccctccctgcagtcctgagacaccagcctcttcctggtgacacccagtggctgcacagccccatggatccccccatcggggcaggcacctgccgcctcctgtctcccagggaagcctccttctctcacaccctggcctgtctcctttataagagtgttgtatgctcccctctctagatggagtgctcatttctagagttctgttactccgggtctccagcacggaatcccagcctctgtgcagaaagcagcagcgtgagctccagtgggtagagtgccccagggcgggagggggctctcggggccaggaggcccttcctgtggggccacagccaggccagccccgcctgaaggtctgggctccggggcagtgtgcagcctccaccctgccacatgtgtcctttgtcacagaaagtctccgctcttggtgctgagcctgccccccagacggtgcagccggcctctcccacctgctggggctcctcacatctagcttggcctccagacatcaccaacctctgctgtttatttcatcggatcgtggggttcagatgccacgttttgtccaacgtgccccaggagtggctgcatgtcaggaacatgtcgctgggaatctctgtggcttatctgaccatcctgccatcctcaggtgaggggcactgaggtggccggttgggtgtctggcggaaacgaggctttgcgcacagagggctgggctgctggatcaccacggaattggctgccttgtagctgtgatgagtcggaaggtcggcgactctgatgcgttcctgcggcaccaacctgcatgtgctttctacagcctgtgtgtgccagggagggtggcggtcagtgccccgagattggctgtagcttccgagcctaaaaggctacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgccagggtccaaggcccacgtctggcccacttggttgctggactccacacgatgcccgctgctccccacacccaccccaactgcacacgacgcccgccactccccacacccaccccgactccacacgatgcccgctgatccccacacccaccccaactccacatgacgcccgtctctccccacacccaccccaactgcacacgatgcccgctgctccccacacccaccccgactccacaccatgcccgccgctccccacacccaccccgactccacacgacgcccgcctctccccacacccaccccaactccacacgatgcccgccgctccccacacccaccccgactccacaccatgcccgccgctccccacacccaccccaactccacactgcccgccactccccacacccaccccgactccgcacgatgcccacctctccccacacccaccccaactccacacgacgcctgccgcttcccactcccaccccgactccgcacgatgcccaccactccccacacccaccccaattccacaccatgcccgccgctccccacaccctccccaactccacactgtgcccgccgctccccacacccaccctgactcccaccagcacctgctggcatcgtggagtcagggaaatatctcagtaacattcattttcaaaacagcattggttgatgaggaagatccagtttccctgagtttacaatctgtacgcacagagtctaagtcagccggactcatacttggcctgagtgtgtttctcgtttcggccctgcagttgtgggcggtggtgagacgcgttccgaaacaggaccccgtcacggtgtgtggccctcgatgaccccccaacagggtgtctggagtcaggctttgcagggtttccgccaggtggaggctgagtctgtccttgcggtttaggcattccagcagaagtggtgcttgctgtcagagctgccattacatatgtgaatgccaaacacaattctctgagaaatacagtatttccaggtaccaatagagcttgagatatcatcaaattgttactcaagcaccttgaaatgtggaaatatcagaacacaatgagagctcgctaagcggctctcctcttggctgacctgtcagatgaatgtctttggctgatgggtttggccctaataccaaatctcatcacaaatatgaactcctggtctctgctccttttctaaaagggacaaatgtcaaaacagcctcagaaaagtcagatctaaagtaacaaaaccacagtccatcaagggaggaggttctgccaaagtcgatgacaggtctgccgagtgaactccacgagctgtctgctcccgggt[450 bp omitted]tggtacggcgaagaatgtttccctgacccgtaagtgcagccgctgcttcggccaagcagcgtaacaggctctgccctttcaccccagaggctccgtctccagtgcgggaaacagcacagccaggcacggtcacccaccaggacgacgcctacggcctggagatccaggaggcagccagcaggacgtgctgcgctattgacagctgtcctaataacacccggacattcattatgtatggagtggcaatgcacggccacacacgcgtgatcactccagcgaggaccctggaaaaggccgctgaagccgcgtcgccgtgagcctctggccggcgccaccaggaaggctcctgtgaagagccgagcacccagcccacacctcctcctgccttgctgtcacagcagtgacatttatttacccaaatgacgcttgctggccttgagtgccaaggagacagcagctgcttccgagtcagaggcccaaaacggcagcgcacatggtaggcactaacagacgtgtattccactgaaaactaaatagcgggtgctcactcttacacaccagggactgtgtgtgggggctgcacgttccaggcagaagcacggcaaagatctcaggaagtaaatattcttgtttatctaaattaagaagactccctgcagaaagagccctgcctgtcagcctctgcagcgggcagggtgcagccatcatcgcccagtccccgagggtcagcgggcgcagatgctgggtgttgcaggggccgaggaaggagggccctggtgtttgtgtggcagggagtgcaaagactgggcttaccaggatcatgtggccggtggagatgtccatgttggactgcacaggctcctcggaccaggatgaggcgctgctgcgtgcggaggggctggggatcggcccgtcgctgaactgggatgagacgctgctgatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaaccccttctcctgctaagatccaaggttcaggcaggcgagagtttaccccagggcaggccagcgcaacatgacggtcaacgcaccccaaagcacgcgcccagcacggtgacccgagaagacttcaggcttgtgcaggaaaagagaggccttgctctcagaatctgagaatacaaacacacatacacacacacatatacacacacacaccacacacacacacacatcacacatatatacacacatacaccacacacaccacacacatcacacatatacacacacacacgccacacacacacaccacacacatcacacatatacacacacatacaccacacacaccacacacatcacacatatacacacacatacgccacacacacaccacacacatcacacatatacacacacatacaccacacacaccacacacgtcacacatatacacacacatacgccacacacacacaccacacacatcacacatatacacacacatacgccacacacacacaccacacacatcacatatacacacacatatgccacacacacaccacacacatcacacatatacacacacatacgccacacacacacaccacacacatcacacatatacacacacatacaccacacacacaccacacacatcacacatatacacacacacaccacacacatcacacatatacacacacatacaccacacacaccacacacatcacacatatacacacacaaacgccacacacacaccacacacatcacacatatacacacacatacgccacacacacacaccacacacatcacacatatacacacacatacaccacacacaccacacacatcacatatacacacacatacaccacacaaaccacacacatcacacatatacacacacaccacacacacaccacacacatcacacatatacacacacatacaccacacacacaccacacacatcacacatatacacacacacaccacacacatcacacatatacacacacatacaccccacacacacaccacacacatcacacatatacacacacatacaccccacacacacaccacacacatcacacatatacacacacatacaccacacacaccacacacatcacacatatacacacacaaacgccacacacaccacacacatcacacatatacacacacatacaccacacacaccacacacatcacacatatacacacacaccacacacacacaccacacacatcacagacacacacacaccacacacatcgcagacacaccacacacacacaccacacacatatgtaacagacacacacacaccacacacacgtcacagacacacacaccacacacacatacacacatcacagacacacacacactgcacacgccacaaacactcactcctatagattcaagaaagcatccactggatcctcctctgtcatcaacgtggaatattctgggataacgccacagtagccttcgttgggtggcttctcattctatcagaatataagccacaggggaggccgggggcggtttgcactgtggactgagatacagaaactggtaccacaatcaaagagtctgcagaaaaaagaagaacctcattctgacgtttctttctctttccaaagcaatgtccaagagcccatgcaagagaaggcaaatggagccgtgcgggagacagaaggcacaggggagggagaaaggcctgtgctgctgagtagacaccaaagcagaagttcccgtatttaaaggaaactctcaacattacaccccaagacagcttctgagggatcactgcagggtcttcgaccctccttccccaggcaaagctcaaccacacacgcggtgggcatcccgagcacctgcccggccgtatgggacccgcctgcaggcaggacacggccacgcagcctcaggtgctcagaacacgccgggaccccgctgctgccgctcaccttcagggtgcagcctgggtgcccccctgacgtctgaccaacaatctcgttttgaaagtgttctaaccactgtgttaggatagcccgtcctattgcctgatgaaaatatacctgtaccctgagtctgcaaagtgaaatgatacccagaaaaagtttataagagaactggagctcaacagaagaggtgaaaatgcattcgtgagaaaaagaaaggctccggggaacctcgtgggctgctgctgccttggtttcattttggtggtgtccgggggaggccaagccacccactcgctccccacagccgtgtgcgtcaaaggccttgcactccccaaggcaatcgccaaagctcaggaaacactccatgtgtcccttctcccttcaccccggggtgccggcttccttgtgtccattctcccttcaccccgggctgccggcttccttggctttaaagatgtctgccaagcccaccggcaccacaccatctagaaaacatttccctccacctggctctctgggatgagcaattcatgctcccgggctctctgcttcggactcatagcgagatacaggtgctgtgggaaggggccctgcggcccccactctccaggagcctgcagcccctgtgagagcagctggggacaaggaggatgaccgcggggactgggaggatgactgcggggacggggggggatgaccccggggactggggggggacgactgcggggatggggggggacgactgtggggaagggggggacggccgcggggatgggggggatggctggggggactgggcgggaggtggatagccgcagggacaggggtgggaggatggtcacagggatggggggggcgggggggatgactatggggaccgggcagagacgcacaggggaaggtggactttaccaagggcctctggtgagggtaaggggtctctaagaaaagggagagttccagttccttctttcccatacatcttcaggtacttgttagtttatagacagttttaaaatagtgagtgtgtttaaaaaaatccacccacgttttctcagaatctcaaaaacaaagcaaaataaacaaacaaaaaaaaccccacaaaggataattctttattttttatttttatttttatttttgatatggagcctcactctgtctcccaggctggagtggagaggcacgatctcggctcactgcagcctccacctcctgggttcaaacgattctcctgcctcactcccctgattagctgggattacaggcgcctgccaccacgcccggctaatttttctatttttagtagagacagggtttcaccatattggccaggctggtctcgaactcctgacctgaggtgatccacccaatgagggatgattttaataaggtagatgataccagtaaccaacctgagtatacatctcatttatttctcaattgtgcacatgaattttgcttgacgtgggggaaaagcacactgagaaatgtttctgaagtaacttctatctcttcacacaatttctccagaaaaataacgtccaaccaaagcatgagaacagctacagctcagggaacccagagggtccgagaatgtgaccctctggggaagaggatttgaaacgctggagatttactcacataaaaataaaaaatcaagctagttccatgcccatcctgtgatttgccacccatgggagagctacagtgaggtctgagctctgttatttcctgagtgccatggagggtgaagccaccaagaggccccacaggactgaggtccctgctgcaccacaaacttccgtttttattgtatttatttttctcccaaagtcaccaatagcaaacaaccacaaacttttcatgtgaacttgggaaaacctctaaaggtctctaagcctattttttcactttataaatggagataatcctatagttactgtgaagattaaaatagatggtttcctgtatattcagtgcttagcatggaggcagctacagagaaagcctcaagcattcatgagtaagagagacgtattagtgaatagaagttagggccgttctctaagccagagccaaactcttgacggcttggcaaatgtaaagatatttctgaagaagttacagaatttattattactattattatgagacagagtctcgctctgtcgcccaggctggagtgcagtggtgtaatctcagctcactgcagcctccgcctcccgggttcaagcgattctgctgcctcagcctcccgagtagctggaattataggcgtgcaccaccacacccagctaatttttgtatttttagtagagacgggcttcaccacgttggccaggctgatcttgaactcctgaccttaggtgatccacccgccttggcctcgcaaagtgttgggattacaggcgtgagccactgcaccgggccaaagtcgcagaatttagagctggacaagccgacatcgcctcctccggcgggtggctcagtgcccagtggctcagtgctggtgcacggtgagggagacccagggttcggtgcctctcagcggggacccgcggctctcaccagtggtctcgcgtcactgcgcagcgcagggtcttcttgaaggtcttaactttttcaaaggagggaaactgcgataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagaggcaacggggccaccatggacgcctcctagaaaccaggacccagaaaacaggtatgtcttcagaggagcaggatgagaactgcaaaaacagacctaactttggttcttttccttgacgtccagggcagtcattgactcattcactcatagcacctgcagtcagagggcctgattttgaatctgggcttcaggtcttactgactgtgtggccttgggaaaacactaatctctgtgtgcctcagtttccccatctgtgaagtggtgataatggtaccgacttcaccgctgggaggattaaataagataacatgcttagagtgaggctttgggcctgtgcctgacacacaccaggtgattatttgctgttcctactacgatgattattagtttattcaaaatcaggtttgctatggtcccttgccgagtcagcactgcacagggtgccaggaacaccaggctgagccaggctgggtcagactcgccgggccctgacccccgagcactcccacgccacccagagctgggcacgagtgaccgcaagaagcgatgggaatgacagcaacagcacgtgttgggcgttcgtgggaaggggtgccgtggggccgggaggaggggaccctccctgaacttgaggtcaaagaaagctttaggcaggagaggctcaggccccaaggctaggccgcaatggcacctgcagagatggggaggtgtgagcaggcatggggcctggaggtgcgtaagagcttccacggggcgaggaaggaggaggaggagagagaaggggccgccactccctacagcctcctgggtgggcagtgctgcgggcacagcgctctgcatccatgccgcgactgctttcggaatgtgcttttccagggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgtatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcactgagcaagggctgtgcgcgtggaaaccgtgatgacatcacactgacaagttaaaccctggagtcccagcggcactggctgtcggccgtcctgcacgtgcccctgggaagacgtggctgcaggcccaactcctggtgtctcccttggcgataaacacaagaaagccacatctatctactggagacagaaacagaaattcctcacaagtgagctggaaatgcgccagtctgctgcgctcacggggaacggggtcgggccagctccctccaaggacgggggctgggacgtttggccgctgcctctcccactcactgtggcctgcccctgccagcgtcccttccccttgctgtgtggcccctttctgggccacctgccagagctcctcacagtggggaccggcccctccctctccacccttccctggacactcttgggaatctccagacgtgggggaagccaggaaggagcctggattctgcctcatggcttgctggagaaagcactgaggggcatctcatgtggtctcattcactggtcctttaggctgattatagtttccaaattcataatggaaattctatagtctgtccattctcagtcctttaccttaacatttaaaaattttgtaaggaaaaacacacttcttactagaatggaataagaaatgtagaacgctacttgacttagtaatggtttagccagtgccaacgagacaaacctcacagcatttgaaatcgctctaggttataatttgggacatttccaccctgcatgaggtgactctaaccctctaagcaaggctgccagtgtgggctcactggagatgccactgggagctgtttttcccctcccaagactagaaagtgactggctacagcgggggagggggccacactcctcactcttcattgaaaagtagcatccacacctgaaaaggcagtcgcatccacggtgctgaacggaggcgtgagcttgctgaccgctgaggcgatgactgaatggacagcgtggcacacatacttctttaaaacctcagttgaaggttacagcatcagctgccatcacaccagaactgccatcagacgagagcagccgctgcccgtatcacctgcgttcattatcagacttctgtgggggcccagggcacagagcgggggctcctgtcagccagtgacagaaatggccatcgccactacgaatactctaagtaccattctgtgtggtgagtttaaaatacagaacggtagtcgggcgtggtggctcacgcctgtaatcccagcactttgggaagtaggtgggaggatcccttgagcccaggagtttgagaccagcctgggcaacatagtgagaccccatctccaaaaaaataattagctaggtgtggtggcgtgcacctgtactcccagctacttgagaggccgaggtgggaggatcacttgagcccaggaggatgaggctgcagtgagctatgattgcaccaatgcactccaaccctggtgacagagcaagaccctgtccgcctacacccgccaaaaatacagagctatgatctcgagagcattttatttgagcaaaagataatttataaagcaaaatcaacaacatgagcctcctctgagagaaagctggaggccagccccatcatgttttgaaatttccctgatttataatcctcggtaaacacaaagggtgcatcctcacccggaacaaaactctcctggtcagacggtgaacaccccagagtgaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgactatgcaccttcagccacagcggcccagtgtgtgcagcttggcgaccttgagtttgtaaggatgagtaagaccttgtggcatttgcgtgactcaataaccaacaggtaattaaatatgaatgaagaagaaaggtagatgtaaccacataactcttttgattgtagatttagctgcgatgtcggcggcacttgcgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggaggggtagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaaagaaaaaaaattccaggtacaaaggggaagtcatttatttttgtgccatgctgccttgcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagtattccagagccattagtgtgttagaaaaaaaaaaaaccccacagtagaaaatgaaatccattattggcaaaaaaagcaagccaagacagagctgagatctgcacggtgtggccgtgtaaggcagaggctgaggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctgacttgcacactcggcccgtgggacactgatctcaggtgggtgcaacgagtacacagcctggcttgcacgctcagcctgtgggacactgatctctggtgggtgcaatgagtacacagcctggcttgcacgctcagcctgtgggacactgatctctggtgtgtgcaatgagtacacagcctggcttgcacgctcagcctgtgggacactgatctctggtgtgtgcaatgagtacacagcctggcttgcacactcggcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgaccctctggccactctgtcctgctgatgagaccctctccctgcctcctccctctcagtaaaactagagtaactaggcatttttaaagaagatggtggcgtcttccactgttgccctaaatggaaatgctccaccgcaaaactcaatgtgatgctagtgcctcacgacctaacaccctccccacggggcagcgtttgtcaggaacggtaaacccagcgcgtccgcacccaggcgcagaaactctccatcagggaaatgtgaaaaattgatctttttgcagctcggtgctgcctccaacacatccagagccaactggaactgtgagtgtgagcccagtggcactgcaagcgcccacaccagcaccctgccctgggcagagtcacgtgggaccatccccgcaggacagtgctgcacccagagcccccaccctgaaagcttcccgtgctctgagcagctcctcaggtgtgagcacacaaacagaggaggccatggtcagcacggcacattcggacaccacagtcctcgctcgccgtagagccgcctgctcctctgctgtgcccaggccggggccctgggcgtgtccgcagagtcctcaaagtatcttatacttctctataacacaatgtgcaaaataagctgaagaggattctgggggcagaaattcatccatacacatcacaaggcaaatgtctcatctcttaactcagcatctgatggagaaaattacagagtggaaatcactcagagaagagacctgtcattcttgaattctgccaaaagaagaccaggacaacaaaggtttcaggaaaacctctctgcacgcttccgggagccaactgaatgaagccgtgttgcccgagtgtgcgcacagagagccttgggtttttagggttatttcgagagtgtaatcactagtaacaggacaacactaaggaattaaacgtacaaagctgggcaggaaaaagtgggttcactgggctctgctggggaggaataaaggccactctccagactggacgtggcaccaagagaacgtggtgaacgggaaccggctctgtttggggagggccctggccttcagctcagagggcaacacacagcagaagccgcggggcccggtgcaaccacaggtggctcgaatgtaaaacggttaaggaaaaagcctgcgctctgtcagtttgacactgaggctgcagggcacgtgacgacaggaaatctaaacaggaaggtgaaatgttgagaaagcgtgtgcagggaaaaggccggggaaaaatattccaggttgttaaacggggtcatgtgtcatagtggggaaaaaaagaaaaaaaggtttcttgtataatcacctctccccgatcatgacacagttttacttgattttatttcatcataaaactcagagggactcagaaggaaccgcctcacatgctaggccagcaaggccagctgggagcagaggagcagtaaccaatgatttcgttgaggagagcgactttacacaaacactccaccatgctaggtctctgatcggcaccgctacaaggtgctccggggtctgggtgcatctggggcagccctgtgagacctcagggaacacagggccacgctcacttctggagagcaaatggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccagggccacagagctctgcaggcccctccccgctcctgacacacgacgacacccagtcaggggctgtaagcacagctcctgcaggaaggggttccacgcacgggcaaacaagccgagtcagcccacgatgagcgatgttggccaagcaatatggagtgagttcttcccatttcgcaagatgttttctcaaaacaaaaattaaagatatagacatgtttcatgtaagtgaaaaataattttcaacactcttctaaatgtggaacagtcttggaacagcctaagatcagtaggaaaaaagcggcctctccgctcgctcagcccccatccctgcggcgcccagagcaccagccctttctcgagtccccacacaacctcgaggccgggctccgggcatccaggcgtgtgctgtttcctagttattttcacgtccatacccctgcctcccacactcaagagcagaagtccttctgtctgctttctgtacccacagcatctacgtggtgcagaggggccctcgctgagcccctgcacactggtcagcatccctggcctccagatcacggctcgctcagggaccgagtgtcccacaccaaggcagccctgggggagcagcaaggggcacggctggagcagctgcatcgagcccccgccggccgacagctgcggcttcctgctctggggaggtgagggctgtgtttgaatctcctgaagcccctggtgggtggctgggaaacgcaggtgctccacgtgaagcacagaaggcacgtacgggctcacgggacccgcggtcagctgcatccgagagtgaccgacgtgctgaaacccgacctcctgcctccctttttcttagggactgcctctcccctaagactaaagacattcattttcttcatttgctctgctcctgataacatcagattgaaaccaggaaacagttgtgaaaataaagacattggaaggaaacacagaattttaatgagcatcttctctctggaacagcccatgtctaagaccggcttctgtgatggtctttaatgcttccataaaggtggcatcttagatgtgagagggagcacctttaacccacgatgcctgcaacccttcccgttgtcatgggagaccccagtcacaccgcagcaaagcccctccagccagactgccgttggtgagacaaatccctcccttcccggctcccacggaggatgactcaccgggcaattaagttctaagggcttccaaaaaagtcagtggtgccttcaaagttcacagatccaacacgacctctgtgagcaaagccagccttgagaggccccacaggctgaaccttgcttttcagtttcatagtcagacaatttaaaatagccagtcagtaagaaacaagtcatccgccttcagagcagcccaggcctgacgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgtcccctgcccacagacctgctcttaccacatcaagatcttagttcaatgtatcgattcattcttatcgagcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggacgggggtctgcacagggctggacagatgggagggtctgcagggataaagtgggagggggggcggtgcaacggagggagccgggcaaacaaaggctcagaagcagaggagcccagcccagggacacaaaaggtattcacatccttccattcggtggccaccacagcttaattaagccaaaggaagggcaggggcatgcgggctgggggcggagcggctactggagcagctgcttctccattttcggaactgcacgtcgttctggggcccaattattctacctaaaactgatctgagtgacacctgaactgcacaaggcctgaaggacgccctgaagagcttcttcctaccagacccccgaaggccagggtctgggggcctgctgggaatcccggtctcagaggtctcagctctgaccgaagggtgctgagccctaaggtctgtacggggagtttctaaaagtctacgctgtaccccaagaaggggacgggtggggcagcagccctggaggaaaacccgtgagcgagtcgtggagggagtgtgagggtttttggggagtgaactttgcagagggtgctgggagcagccggcccgaggacaccgctgactggggtacaggggccacgggtcgcacgtggggtgtcagctctgccgcctcacttggggttgatttgaaatctcaagatgtgtctgaaaaccccccctggagaagcgaggggcccactgggaacgggaaggcctgagcaagacagacgcatgcccggggcgaggaaggggagcctggaaatccaccctcagaagaatcagacacgttttctagactttccccttcacatttcagcttcacgtttggggctcacttaacaatttgtatatttgttctccttgaatctggtagagaataagaaatccctgggatggggacagaaataattctgaaactcacacaccagctccagtttccatccaatttagtattttgttttgcaaaaaaaatctgcattgtatttcctcccactcaggaacatccgatctctggtttcagggtgcgttttacaggccaggaaaggtgattccaggtcgggaaaggccattccaggaagattgcgttattgtccactctcctgcatcatcgtcttcaccaaaaaagctgaaagcgacgaaacgcctacccagagggcaaatccagcttccgctctcctcagaggtactcagtccagttatacatcaatgtgagaatagtcccagcacttatcacttgtaaactcttttaattgattagctattaaatggcataagatcaatccaagtttaaacctgtatatcaaatccacattccacaaactctgtagtgaattatgtattttaaaacatgtagctttactggctaatgtaatcgtctgcgaatcttcccatctgttcttcaagtcactgtacctggaggcgcacactagcacagacccagacactcaattctggggctgcattattatcctgtacattaaaaaatcttgaaagggtgcttgttcacacctgccacctttctagtgagtctcttgtacttgctaatagagaaataacatacccaggttccatcctttttttttgagatgaagttttgatttcggctcaccgcaacgtctgcctcccaggttcaagcaattttcctgcctcagcctcccgagtagctgggatgacacgtgcacgccaccacacctggctaatttttgtatttttaatagagacggggtttcgccatgttggccaggctggtctcaaattcctgacctcaggtgatctgcctgcctcggcctcccaaagtgctgggattacaggtgagcccctgtgccagtcccaagatttcattcttaaccatcagtaattctcccaaagcagaaaagccacggagacgttacattttgagcaacaaagtttcagaacagctggctggatgaagaagggagcactattctgcagcccccatggaacaggaaaagccgctgttcagacacctgcagaaatgcctgactctgcccacctcacgtccacataaacctgaaaaaatgggagaggagtagctagctgtctgcccctggaagcccctccatttcccttgtgcatcctggcccctctctctctgagctcaggcccttccatgctcctctcccgccccacagaggccccctctgtcctggcccctctctctctgagctcaggcccttccatgctcctctcccgccccacagaggccccctctgccgttgcctttttcttcctctcccacgttctgttctcacgtactctgaaccccacgcggcacccagggctccccgcgttctctgagccccatgcccgccccacccggcacccagggctcccctagggtcacagtgttgtctgtttccgggttcacactggggagtccttcacaaaggcagactgggccgactctgatgtaagatcaagttctctgctgtccccgttgttccagaatatgggattctacccttagaagcgataagctttctgagaaaacgccttctgggtcagctccaagttcagctatcccgaggttccaaggctgtctgcccacccagacccaaggtgtccaatccttaggggtgaccctcgggccaacaccaatcacagctctggggacccccacgtgtcagccatggcaaaatgaacccccaacacagcaggggagggaaggaggaggcggggctcacagagcagagagccatggagagctccgggccgaaggggacttgggcctgggagagaagagacagccaggcggcgagggacttgtcctgtggaggcctccccaggaggcgagggtggggggactcctgctggaggcggccggcagatcagccttccttatccacgtcctcgaagtgatccccgtttgacatttggaaatgactttcatctgctgggtcctcctcggtttgacgtgcaattgcttttcccgaagctttctcctcttgtaacacccagctcctgcatgccgtggcggctccagccatcattcctcatcccaccaccccgcgcagcgtcttgcctccttttatgccggtgtacgtgttgtgttaagagctgggctttgccatttttgacaggctaatgcatttcaccacagataatgccattcaccacagaggcgcattctctctcgtgcccatcaaggcagaggctgagaagaaggtctgctttacagcaacggcctgaggaccctcggccccaaggtgaggccccgcgcaggtacctctgtacacgcctgtggagtcccaccctgtcgtgtgcacgaggctgtcacctggagattccggccctgccgggcgtctcctcccacgccgagctcctcctgccgggggggtctgcacagttctgggtgggggaggctccaggagctacccgaggcttcttctccttgccaacaacgatgccctcctcccgagggacggtggccccaaggggagccgggagagcagaggctacaggcagggagtggggagacccagccttcaagcacagcgccccttgggtgggacttgcctcttgctcacacccactcctacctcctggtacccgcctgctggaatctcctccccaccgcctactgtttcttttgaaatcccagtttaatccacttttttacacttccctttactccctcaagtgtctcctcccaacacccactttatttcacagcggctcgcgtccttcggagagcctgcctcccgccatgggcagcagggttcccgctgagctgggcccacctgaccagggcttccctcctgccgagccctcacctcgatgtgagccctgaagccccttgggctgggaggtgaggtgttcagagcacagatgcccgaggctgcacctgcaccaagacctgaccttaccccccagggccccggaccacacaggggctcacccgggtgttggctcacccgggcgccttctccgaacaccttccatcaagtgtcttgaattctgcagagcagcccaggtttcagggctttgcttctgttttcttctctggaagtgcatgctttgcagacaccaatgtcctcagttttagttcagaaaatgtgtcccgcctctctaatcaggtctaagggaggggagcagctcatgccgaggaggaagtgtgcggaaacgggtaccctggaaacgggaggagcaggcaggaatccaacacccatcccagccccgcgggcactgacagtcgctgcagaccgggcaagtcaccctcgggcagcgcttcagagctgacgtggcacccgcacccacagggctgccctcatccgcatggcggcccaagaggaggccccagttcatagatgaggaaggcggccttcgggagggaggggctgggcctcgcaccccagggaatggaagggcaatggcacctttcttccatgaatttcaccattggagaaaaagttaaaagatgaaaagtgtggcaagaggggaataagataagaaggaagaaacggaggggggtgaaagcaggcagaatgtgcctcttctgatcctcttggggtcactcagccacaccgagccatggaccgtcccttggagcgccacagactgcagggtttgtccttgtcacgaactcaaagagctgacctctctgggccggcacacaacttgcagccgagtcctttccacgacaccccagctccctgtctaaactcttggcctgactgggaggacctcttccctctagcccagttcctcctggcagccctgcaaatgcccaccctcttgggtctgtccctaccctgcagatggctccagcacctgccccagccacgcctccatctcccgccagccgccaagagctccacccaccacctggcccagcccctcctctgtcatctccaaggatttgatttcagtttcacacgaatcacctcctagtgatgcgtggactaatgctgtttaccgccggttcactttcattgcaaactcctcatctccaagaaatcatcaaccgagaaaagaaaggatgtcaccttttcccaaatctcccacagtgcctcacactacgagggaagatggtggaggagctgtccagacccacgggacagaaaagcccgggccagcccctcaacaccctgcagtggggacagcgcagctggggaccgcccagtgcagctctgccactggccctgtgggctggggcgcctctcagtttatctgctgctgactttgcccccttgtaaaacagggttgggagataatgagatgcctggggaaggtgtcctgggtccctttccacagggtccctttccacggggtgggtgactgatgaggacagggggtgcctaggaacaggggctcggaaggacctgctgtgcatgcaggggtcaccccaggagcgaccctggctttgacgagaaggaagtgttctctggttctggcagagaaatgtgtgaggcggactggtacacaacacaagcctaagggaagcagcacccgctccacagacaccacgcacaccgcccctcccctggtgctgtgtgagcacccatcctcctcccggggcccagccctcttccttggctgctggagtgcagggtgagcacgtctggaagaagcctgcagcccccacctcctttcctgcgcccctccttgtgtgtagcaggaagtggcttccttaggaagcagttattcgagtcatacccaggtgtgaaaagctaccaaggtcaaggcaaacataggaatggcctagtgccaaaatgaagccacagaattcagccctccacattttatgtctcagactttccaattttttttttatttccaaatatctcactgcgtggtctctgtgattttaattaagtctgatctaatgactactgtctgatggggggagtggcttgctgtaccccaacgagcagcatgcttctgttttatgtttagaggtttctctggccacctttcgagacttcattgttctctgaagatcgagctctatctctcaggagctgtatctgaggaagcattttgggcaaaacggcaggatgtacactgcttttggaaactgcatctgtgaacacttcagatttatgagaaaaatgcacttcaaaggggcactttccagaaaaacgttcagactcatggtgaaaaggtatctagaagattccatggagcctgcagaaaccaagccggctgaccccacatactgatgatctatactgaacacacaggcaaacaaaaacaggttcttcccacactggggacgacacgtaccctttaccctcatcatcctggctaaattctgcaggtttccttccgatttccttcacatcagaaaccatgggatttggcaccagcgtgacaaccatttagcatttgctgattcctagttagtccagggaagttctgtgccgccatggagtatgggaggagggaggcacggccttgccctcccggggcctggagtctgttcccggacaatctgcaaaaccgaatccacgtctcgaaagtttcaagagaattctactgtagacatctgtactatcagctacatttggaaaggattataaaattagaaaaatttccattttcaggcttgactttacaataaaatgttctctaatcataattatttcataacaaatgatctttaatgttgtatttttatacttgtaaactatttggcacagttttcacagggtgcccttcatttttgaagcagcataggttttgcttatttgagttttgcaaaaaatatattattttgacctggaaatttaaatatatagtgaggaaagccattctaagatacagagctgattgaaaaggctttgttaaaaacttctggtggggtcaagtaaacctcagtaaaagtcactgttttccaatttaattgtgaacatcctacttctattactcgtgattacaccaatgcctgaagattaaactcacctagagaaagaacggtctcttaaagccccagagaatgaaccaaggcgtgacctgtgctctttgtcagaactcagctttctgcaccgggggtaagaagtcagggtgcatttgggacttgcagacacgccagccccagtcaactgagcaccctcagatcgcagcaattgccaccacactgtcactgcctttgtaatcacttgctaatgggagcagcagcagcgaccgagacgtgcacttagccgctgtgtttacaggaggtccccgtggcccggatgcatgctttcctctgggtttggttccaaaggcctccaagtacacaaggaaacctgctgggtattgtgaaataaaccatcaaaagagaacttgctgaaaattctgcaggagtctctgccctcatgtcggggaagggagagtgggctggcagaatactaaacttgctgctcaaagatgatcaaagcctcaaggaaatggatgcaacattcaaagagactccgagagaaaaggaggagaatgtcttctaatcatctaacaacttatttttggcacagtttttacccaatcaccttccatagaaataggacacctacatgaaaaaagaatgcataaagtatactggtaccaaaaatcacaattcttccatgtcttcacattatccttagtgtgtgtgtgtgtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccaatttttgctccagtctgagcaaattaaacttggctggattatctgatggggttgatatcctggtaagtgtcaaaaatatgagagtctgtcaaaaaagatttgcttttccaataggtaaggcaaacaaaaatatcacactcatgtaaatgaagaaagctctaacatcctgaccctgtccatgaaatagttctattttgaggaaaaacaggtaaacatgtttgaaggtgtttgcattagaagctagtaattcaatctccttactgcttcaaaactattttaagaaaagctctcttactccccaggagcacaacgtgggccccctgtggtcccaagcccaggctctgactcacacacacaggggtcggggctggggggttctgtacaagcactaatgatgtgcgtgcattatcagggctgaggcggacaaatgctttagcagaggttggcaacatgagggccccccaggtcacgcgggaagtgccttgccaggacactaacccagctgctgtttaacagaggacatgaggattcaccttttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggcaaacccccactttaatcaaagtacttccctaaagggcattttgtggtgatttcaaagctaaaccaaccagaaagtctttacactcatttcatttccaaattttcctagatcacatttttaaagaaaaaaagttttttttcctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagtttttttttcaaattagtcatttctgcatgcaagtccaacctttccattctatcaatattttatatttgaatttcaaagtatatcaaagggcgccacgctttctaaaaatctctgcctgtatgatcttccgtctctcacgcatggaacagaactggtgtgataatttatttatgtactgacacagacttggcctgaagacctggcatcctacattgaaggtcttgctcaatggaatttctggataaattcttactagtttatgtgacatttttttcaggctgcttcttcaaacgtgattttccttttgctttgaagcaaagctatgcactgcaactgaaatgccagcctcaacacatttgaagttgccatttctttgtaagaaaaagatcgtcctgaccgggctggtgaccctctccagaaaactggaggcttcctccattcaatggcaataccaggaattttgaaatgggaggaaaagctgtcttgtggtcaatctcttttaagcatagagattgtgtaaattccttatgtgggggagggtcctgagagctcacagagtatagaaaagctagctccaaggagctcaggcagcaggagggtatggtgctggagggcgctttgtggagagagcttgagagcccacccatgtaactctgatgatggaataataatatttactttacatacgactgtaaaaatgatgaattatttacaagacgtattgcacactgtaatcatgtgactagagaaaacaaaggatccagtccaatgaggaaatcttacacatgtactgaccaaacttttaaaacagtggttaaggagtcatcctaccttcccagatgggaatatcttctcggaattaaatgatattttatatgcaaaggaatcaaacgccttgactggtgtaagtattctgggcttatgctgctgttaaaaccgaaggcctatgttcattacaggacaatactaaatacgaaatgtgcgccatagaacttccagaaactctgtggttttttaaaaatgcccgacttggtctgaacttgccttcctcgcatcctccccggtttccagctcatttccaggggtgtctgtggtgcctctagagaaggtgtccctcatggggacgcgtgtgggtcaccttcccctggtcagcgttaggcttcactggaccggacaacagcacagggtggcaactgggcaggtcaaaggatcttttcacagaagaccccgaggaagccgatgatttttgagacatcttcaaacacctacacgccaaatgatctcgcaactctggcacttttcagtagtagtggccaaactaagataacagataatacatcattcatgtactgtactttttccacacttctaattaacaacattcttccagagttaacacgaggctatccaagaagagcagacggatacagagctgcacaactgtggctgcaacgtatttgcacgaatgctgatgagaagttccaaactgtcctcataaaagaccccaaactatgatacaggaacaactgctgggaatggaggaggggccagagaggaacgccatcatctgcctgttcaacagataaatccgatataccactttttaaaaagtctcctcttacctggtaggcggcagtggcatctgcacctgggtcgccccctagtcccgagagcttctccttcagcctgtgctgagagctatggcggaggcagtagatgaggccagaggccaggaggacgcccaggatgcaggcgagggagaccagggtgagcgcgatgaacttggtggagtcttcttgctccgcctgaggaggcaggaacttgagtttgcttttctgcagaacaaggagagaggggtgtgttagctcctgacaaagcatgacctcctaaaaacacacgtctccaaatgcaacttgaaagtggaaagctcagccccacaggacgctgtgctggccctggagccacaacgggagggccctgcggaacaacccccgtcaaaggagaagcagaaatcatttgaaaatagcacatcgcagattgcagcgtgctcaagaggacagtcagaggcatcactttttccttcagtggtggctgtttttcaaatttatgtaacgtatttggcagctaatttgctgccttaagtaaagtatccatcccttcttctaaccgggcacagcagtttgtccagagcttgcacaatgattgtcgggggtgctggggggaggccaggcttggcggtggaggagggtgggcaggcccggagccttctgcagcttcaagtagccaccaagtccagcacatcttcagcaacaaaggaacgtgggactggctctgtgcatcttcacagaacattctccctcccaggtcaggggatttggatccacctgtcttgaaaggcgagcgctggtcgaatcccacctgactccagtcactctccaggagtggcctggtgcagaccacaacacttgccacctatgcacctacgtatttttccttgaaaggagctgcagagcctttggaacttcacttctcagcgaggaaaacccttcagattctcactgcttcttggagggcgggggtagggctggtgaaaatatgagaaagccctttcggtgcatttcacttgtctccacgtgcaaatagttgcacggctctcccctcattaacttcattagaaggtatattagcaacaattaaggacgccacaggaaaatgggaaggccgccccgcagaccgcgcgccctgcacaatgactcggggagtgaatgggggagcacgcccggccttggtcctggctgctacaagatgagaacaattagcaaacccctttccaccacctaatttcgcgtggtaacaaaatggatttttccccatgaatgcctggccggcctattcattatctctcttctattagtaattttctgctccgtattcagcctcccaactcttcatttcctcccgtctcccagcgtacacagtgcctcttatgtcaggccgggcccgtttttatcttgtaatcataaaggccaccaaagcaattatcgccggtcttgactggaaaagctggtcattaattagcctccttttgccttcggtgcagcggattagctggtgccgggactgagttaatggaaacgcgggttaaatgagaaaagacgcccggattttcctgcctggatgcgcggctcggaggaggaccgcgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctcggtccccgcgcgggcgctggttctcccgggtgggcggcagccccgccctgtgccctcctgggccggcgcgagggaccctagagcgcgcggggggccccaggcggggaggagcggccgcgaccccggatgcgagaggcgtgtgggtccaagcggcgccgggacaggggccgggtcctctgcccaccccagggtccatgttcgcctgcggggccgcgtcccccggagccatacctgggcgggagggcttttcccgggggcccggcctgcgcccctcgccgcccctcgcccctcgcctctcgcctcccgcgggtcccgcctggccttggccgacggaacaagaacaacaaaggaagcggcgcgaccggcggagggggcgcccgccgccctcccacccctcatcccggccgggccgatggcccccgcgcgcctccatccgccccagcgcggaggcgaccccggccccgctgccccggcgtcgggaggacaccgcgcgctcacgtggatgactgcgcccgggaacagggacttcccgaaccttcctgccccgcgccgtgaggcccacacgcgcgcggtgaccaccctggttctgagggggcggcggggccacggcgtgtggcggacccggcagtggcacccaggctgtgcgcgcgggtgtgtggggttccgaggcgcagggcgaccgccggctccggctccccgaggaaggggcacaggcgctgcccgcggtcactcgggccaggtgagggcaggggacgcgcgggggccggaggaggaggcctggtctgcgggcggcaggagggacccggggccagccgaggctgttcccagggaggcagacacctgctgtcgccgggaccctcgacacgctccgcacgcgcgggagcggaaccgggcctgctttggaggcctcccttggcgcgcttggatttactcaaaggtcaaagaaaaatgtcaaggagagcgattgcctggagagctcctggctctcctcccgggtccccgctgggtcccaggagtccccggaggggaagcaaggagccccagtgccctggagtcctgtctccaccaacctcgcccggctccctgctgcctaggcccgcgctgtcccagcagaggaggggtgggagccgccccaggcccacctccccgcgccggtccacaaggaggcccctcctgcaacctgggagaggccgggggaggcccggagggcgaccgcgcggggccgcgggacctggacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccgcagaagaaaccgaagaaagaggtcttccctccacgcccaggacggtttcaagtgtcccacccagcgctgagcaggagggtgatgcggagggaaaaactgttggctgcaagtcaggtcttaggaatcccggaagaaacgaagatttaaagaatttttttctaagtgattgagttccaataactttacaatgacttgactccctttttgtggagttaaaaaaaatcttcaaactcctgctagccatggcctttaagagaaagaaatgagtttaaaagtgagtttgaggcacagtcttgacccaggtgtggctttggtggtcctcagcgccatctcccccatgggcaccgaccccccaaggctgcaccacggcgggtggaccccaaagagagcccagactaattagaggcatcttatcagtcttgacttgaaattgaaagaaaattatgtttaaatatttatgactttgacatttacagtcaggcgtttttgaaaagcggaacacccccttctgtacagcggcagctcaatgactgaaagtttggaacagagaagaagtgaggaggaggaggagggagaaggaggcctggtaacacagcggcaggggtgcgtcccgggtgggggagatgcacagataggcacacttcagtgctgagttctcagaggcaggaatagtataatttaaaaaaataatcaggaatgattaagttaattttatcccaggttagatctatcttgagaataagatgaagtacaatatcgcatatttcttcctctcaaccgtctgcacctgcaactcctcaaatttagaatagacagtattgcaaaagttgtgattcaaaataagtgtatgaccacagagacaatttgtggagctgtcttagaacttagcatctgcagacactgtcctgaccaatttaaattattttgaccgtgcccctgagtggaggtgcatgaggcttccaccccatgcccttgtgagccatttacgggaaaatgccttcagaacttttttagctgtccatgtggtaagcttaaaagaaaagaaaaaaggacatgttatgcccaaactcaattgtgagagctgatacagccacacaaatacaaaactttatggtaaatatgtgttgacgggtagccagatttagtccttttccaaggttgtgtgatataaccagttaacaggagcagttcattctctgagtcacgatgtgcagtattaaaatatgcttgcatcataaagacgtagggatacaggtgctcggtgccagttaatgttaaacttctaacattgttgatgctttcatttgtatcatttctaaggaatcagatttcagtcccagcctcatcctatctttgtgtgcatttaaattactaaattataaatacctttttctcttaaaacttagaagtcagttttagagaccattaatgagttgctgtaacaagtttatctttggtttgctggatgaatcctcttagaattattaggaaatttcattctaaatttactaaaaggcattactaaaatataatactcactttagggctgatgaacattttaagttttcaggccatagcaagtgatccaacttgaaaacacgggggaaggggtgtcttaaaatattttaaaagtattttttaaagctgttaacggaactacttttaatttggaatttgccacagaattctaataaatgagagaagtcaggcggaaataatcatgtattaattctctgcattacaaaatcttttcagaagctattatcagagcaagaggcactgcggtctgaattcagggtgggagaagccctttgtgcaactgaaagctattgttcctccgtgcagatgaaattgtacttgcaaatctgccattcaagtggccaaaaaacccaaaaaagcaaaagaaaagaatcttcaaggaaaaattattcttaaatgtaaactttaatgaaaataagttgggatatactgttttaaaatgggctatttgttgagtttttccaggcatacacttaaaagtgaatatacaagaaaggcaataaattgtctatttgccatctttaagcactcctaaaacatcagttttaaagaaatactgtgttttaagacatcagggaagatttatgatactgatgtccaaagggggaagcacccttgtgcaaactaattctaaccagcagattgcctccggtgggagagagggacccagaggctgagcaggggaaggatgcccctgagaaagccgcccccagcctctttcagactctccgctggcgttttcatgacacccaaactcagactcagcggatcacacttaaggcaccggctcctgacccctatttttggcccgcccgcctggtccccaggcctgcctggacgcacgcgcgccttccacaccaggtgcttctcgggacggggcctggcctccccaccccgcaagaaccagaccctcttcaggactgggggggttaccgcttcgcctcctctacccggactcagaagccccaacccaagacccgcctagcgtcgcttgtcagaacccctctgtggcacgactttgagcagagggcgagggaaaggagggtcagcgttcggccccgtcccctgcctgggctttctcccccgcttccccgtccctcccccctcgccggttcaccgcatccccacaggagtcataaagatcaggccccagcgccggacacaaaggccaagggttcccgggagccgcgggtattcagagccaggagaggggtcccggcgcggagggtgctgcggcccagcctcctggccacagagcgcgccggccgcgagggaggaccaaggtccccaaccacgcccgcgtccacccgtgaatcccggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccccggggccgctgtccgaggacggaggtcggtgacttgaaccgcgtcgtcctcagggctgtggcggggcccctctcccagccgtccagcccgcagcgcccagctcagcgcactgaggaccaaaaagggcgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcccgggatgccctcccagggaccttctcgggcaaagagtcgagtggtagcggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggagcgccctagggtctggctgcgccgcgctggcgacggggtaggctcggggaacgcgcgcaggccccgggatcggccgctggggcattggggcatcctgccctcgctgccccgaccctcccgctgcggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctggcgcaccctccccgcccgcggcgacctcgcaccaccttccccgccagcccgcggctctcctcgccctggatcgccggagcctcatccaggctggggtctccagcaggcggccgggagctctccgaggtggccaggagtggccggtagccgtctccctcggccaggccgtgtccagcccctcagtctccacggcggcgcagaccgcacgcggccaccctgggcctcggacagggctagggggacgcagaccctgccgtctgggggtcctggggcggccacggggccggcgaccccagagcaaggcggagcctagtacaggccagagagctggttttgctttcttcacagacatgacctgacagtgaatacacaaataaatacaattcttttcgttagtcccttcttccgttgtctcagtgtttcacttccaacatcaaagcaccgcattcctgatttgatcttaatttaatgacctgtctttctagtgctttgaggaaagatgggtgggaggtggcaccaattcagttcaatttgggtcactttaaaaatcgtgagagggcctgaaaggttccatgcgggttcaccagcagaacagcacacttcctcgtccacgccttggtgcacctgcggcaatatattctgggtggcagacggttatttatgtctgagagcctccaactcactccccttcctcccaccacccctcctctaaggtgcggcctgacctcagtggggctgcagaactggcctcgccaaagctgaaggcggacccacactctaagccctagagtctaggggggtcatgagaagaacgcgtttgtatttgaggtgctggttcttttagtctattgcttcagaaactggtaagttactcgccagatttccattctatttttctttattttaaattccctttttatttccagggcaggaaaatgtatcttctaattcttgaaaatactttagaaaagtgtctcggcaataatgtgagactagattcagctaatttgaagaatgaataatgatgtgaggattttttcttttttcttttttttttggtcatgagatcttagacttcatttaataataaatttcaatttacatgatttcaataacattttcagagaaaacttttaaacatgacacaaaatatttttgagagacatgttgattgaaatcatttatatatgacaaatgagtacattattcatatagaagttagggttgtttggctgatgaataaaaaatataatatatgtaaaattctccaagacctacaaaatagctacacaatataaatagtttaaaaatgatttgttgatcctgccaatacttcttttaaagtgcatttcacatttgttatgtgtaaaacctaatgttctgtgataagaatctcattttcaatttaaggaacaccaaattgttatagattacacatttaagtgattagaataaatatcccatgcactaaattatcaaagaaaatgtatttttaaacaaaatagagaaagactgttatgggaaacatgattattataaagcaaaacacatatttcaggaatttaaaataatatggtaaggtagaaaatgatttaaaaaacacctgagactcttgatttcagaagtctaaatcaattttgttttttaaactaagacagtaatttataattttacagtacacaaatagtatttaaaatacttttgatttctaaatccatttttaaaaagtatttactattataatataaaaataaaaatagatccttaaaaatattgtaggtatgtgtataaggcatttcttcatgcatatatttaaagaaaacaacattttaaagtaacaatgagtgcattttgaaaacaagatgttttgagaggtcagcctcctagtaaagcatagtagttggcattgagataatttaagaacaaagacacttccacagacaaatatggatgactctgagttgaaatgtattaaccaccagtagttattttttcaaggacaatatttggaagagcatcagacactagtgagaagtccttattcatcataaaagaaggtaagtccattgcaacaatagggcagtgaaacaactgcatcttagtagagccctcaccgtctacccgtgcatactggatcttagtagagccctcaccatctacccatgcatactgggtcttggcagagccctcaccatctacccatgcatactggatcttagtagagccctcaccatctacccatgcatactgggtcttggcagagccctcaccatctacccatgcatactgggtcttggcagagccctcaccatctacccatgcatactgggtcttggaagagccctcaccatctacccatgcatactgggtcttggcagagccctcaccatctacccatgcatactgggtcttggcagagccctcaccatctacccatgcatactgggtcttgggagagccctcaccatctacccatgcacactgggtcttggcagagccctcaccatctacccatgcatactggatcttagtagagccctcaccatctacccatgcatactggatcttagtagagccctcaccatctacccatgcatactgggtcttagtagagccctcaccatctactcatgcatactggatcttagtagagccctcaccatctacccatgcatactgggtcttagtagagccctcaccatctacccatgcatactggatcttagtagagccctcaccatctacccatgcatactggatcttggcagagccctcaccatctacccatgcatactgggtcttggcagagccctcaccatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccatctacacatgcatactgggtcttggcagagccctcaccgtctacacatgcatactgggtcttggcagagccctcaccgtctacccatgcatactgggtcttggcagagccctcaccgtctactcatgcatactgggtcttggcagagccctcaccgtctacccatgcatactgggtcttggcagagccctcaccatctacccatgcatactggttcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgtgtcttggcagattcctcaccatctacccatgcatactgggtcttggcagagccctcaccatctacccatgcatactggatcttagtagagccctcaccatctacccatgcatactgggtcttagtagagccctcaccatctacccatgcatactggatcttagtagagccctcaccatctacccatgcatactgggtcttagtagagccctcaccatctactcatgcatactggatcttagtagagccctcaccatctacccatgcatactggatcttggcagagccctcaccatctacccatgcatactgggtcttggcagagccctcaccatctacccatgcatactgggtcttagtagagccctcaccgtctacccatgcatactggatctcggcagagccctcaccgtctacccatgcatactgggtcttagcagagccctcaccgtctacccatgcatactggatcttggcagagccctcaccgtctacccatgcatactggatcttggcagagccctcaccatctacccatgcatactgggtcttcgcagagccctcactgtctacccatgcatactggatcttggcagagccctcaccatctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagatttttaagataagattttgccacattgcttatgttagatataacataagcaatgcaaatgtaagcagtgcaaatgtaagatatagctataaaatcaatgcccttattttaaaattgagaaatgctaaaattattttttcaaattatttcactttatttcaagaaaaatatgaattctttacttaaagcagaacaatgcaagtcattttttgttttgaaaaataaatcaccaacacaactcagcttttattattaattctcatgctggctcatatgccgatgaatctgaagcttttgaaatccaaaaataggaactcaatgatgagatagacttgatatcccaccaatggcttgacatgcttacatgaaaccacgtgcttataaaccaagtatgtgtttcagcaaacatttctgcttgaaggattggctgacaaatatgtcgggatgtttagacttttcttccccaaacttcaaagttataattcaaagaatagaaaaagcctcaaggcttcattattactattattagttttgtccattaaaagtagcattttgaaaaaatactgttcataagcacaggtacttataaacagtgcagtctccctagaggtgaatccggttttcactgtctagattctagtatagaggatctattacttttaatcaacgtatttgtaaagatctaatattttattatttacagaataatgccataaggcacgtatttaatagttgatgttcagtatagtatatatattgtattttcataactagattatattcttttcaaaactgagctaaaattccttagattgaatgtttgtaagaaagactcattaccacatgaacaagaatctaacttttttgaaaatggctaaatagtgccattatgttcagatgaaaggaaacaagataattctgtgaagaataaccaggtcatctctatttttgtttaaaatctctttcacatattttgtcagttacatactacacatccattacaatatttggaaacttttcctcgggttgctttggaattaaaagtagaacaataattcaggtaattcaggtaaatgtttgtttcacaattatataacttagccatgtcctgttcacatattctttaagaaaagtgcctatgtatattttaatgtatgaaaataggctccaattaaatgaaagaacagcaacagcctgacaaagctcacctttgtacctggattctactgagaaggaaaatcaaatgatcaccatcaagtgacattttttgattttatattgcaaatatgtctatacatatttagatctaatgtgaacaaaaattcaggaagcagccagttgcttttcttttcttttttttctttttactgagacggagtcttgctctgtcacccaggctggagtgcagtggcgtgatcctggctcactgccaaccgccgacacccaggttcaaatgattctgctgccagtagctgggattacaggtgtctgccaccaggcccagtgaatttttttttgtatttttagtaaagacagggttttgccatcttggccaggctgttcttgagctcccaacctcgggtggtctgcccaccttgagcctcccaaagtgctggaattacaggcgggagccaccgcaccctgcccagttgcttttcattctgacacagtgcggagcaggttcagggtaagctgtcactgagacggagcattggtggtgcaggattccatgtgactcaccctcagctgccaagtggccaactgcatggagccgccgcatgtcctcggtcagtgcggtgggatgcacgctggcattctagcaagtctggcacattagcatataatctgcaacagggtgctgtcaggtactgagaccacttttaaaaccctcatgaatctgccacatgtaactatatgtctccctaatatgtttccattcacacactttaggaagtgatatacctacttcgaccttgctcagtcatttctgaaattcccatttggaattgtcttcagaaatatgcccaaagaaaaccagaaatctagtcttacgttttctaagctttttcacttgtgattctccacaccttaacctcatcactcctccagttgactgtccttgtctccaaatggctttagagtattaaaaaagaaacaaatctgaaatatcacttccaccattaagagtgcatttgaaaaggccatttcaaaagagtagtgccccagacatggtgagcactaagacagacagcacctctgagtgacactgcggaaaaaccaggctcacttgtccaagcacgttcgcaacagagtcagttacttttcctccactgggtttcccagtttccatgacgacagcctgtcctgaatgtccatctttggggtgaggcttgaggcttccttgtcttttgtcctccccacaatcagatcccattacttttttcgggtcatcccttatctgaccttattccccatccccctatgctgatggcggctggcctcctgcagtcctggggtctggtcccctccatccaccaccctcagcctcggccatctctaccttgtccactggaacagcttcctgtccctccctgaaaattccaccaacccttcctcacacccatcagaggctggctccctttcatctgatcaaccaaggacacacaggggcgcctccagacctcccctgcatgccttccccacaccaggagcccctggtcagcggccgcgagggcaccctcaccctctcctgcacactctctccccatcgaggaaccctggctggctcagcggtgggctcggggcctttcatttgtttgaggtcgaatgctgagtccctcaccttcagaacatgtgagtgctacggactgctcatcatttcacgcatgtgcacatgcactgtctctcacacacgcacgctttcgcacacgtggagacaggcgagtactttctagtcagcatgacagcagcggctccatcctgtcaagctactttcccatattttatttcctttcactcccagagaaaccgtggaattcatgcatttttttttccagttttacagatgagaaaaccaaagtactgagaggtaaatgaagtatccgaagctggtcagtggcagaatctcaatcaacacacaggctcctatgcgaacccacacactgagggcatgtttcacaggggagagctccgttcttagctacagactcaggcaggcttggagtcactcctctctgcagtctgagctccgcgggtctccgccagagcctccaagcctccccccagtaataatattaataatagttactattctttgaatagtaattcaataatagtatcagtctttcaaaaagatggtggtctttattctctattttccatagaatgtggtcacaggcatcgtgtgagcactgccatttctgtgcttctaccacacacactctaagaggccagggggtgtctgctccggcagctccagatgcaccttccaggggcgtctcctcctgtcactcagcgctgcccccagacccttcctacccgaagttctgtggccacagccatgcagactttatcctacactctgacccactcacaaagcactgcggttctaggtatgaaagcttctcactcttaactgacgtgggctgtgcgtttataagagagccgggtcaatgctggtgtaactgacacgggctgtgggtttgtaagagagccgggtaggtgctggtgtaactgacgcgggctgtgcatttataagaaagcccggtcggtgctggtgtaactgacacgggctgtgggtttgtaagagagccgggtaggtgctggtgtaactgacgcgggctgtgcatttataagaaagcccggtcggtgctggtgtaactgacgcgggctgtgggtttgtaagagagccgggtaggtgctggtgtaactgacgcgggctgtgcatttataagaaagcccggtcggtgctggtgtaactgacgtgggctgtgcatttataagaaagcctggtcggtcctggtgtaactgttgcgggctctgcctttgtgtgaaagcccggtcggtcctggtgtaactgacacgggctgtgggtttgtaagagagccgggtaggtgctggtgtaactgacgtgggctgtgcatttatgagaaagcctggtcggtcctggtgtaactgacgtgggctgtgcatttataagaaagcctggtcggtcctggtgtaactgttgcgggctctgcctttgtgagaaagcccggtcggtgctggtgtaactatgagaaagcctggtaggtgctggtgtaactgacacgggctctgagtttatgagaaagcctggtcggtgctggtgaacatgggtgtctcccctcagagaagtaagctgaggtgtgtgcacctctcacagcccagtggggagcacagggctgcctgcccacgctcactggctggctcagtgccctccataggctcctgtccaccggcaggcgtgctgcggcgttggtgagagccccggggcggaggctcaccatcaggcttccagcatatggtggataataatctctggcaacacaaaaaggcaggcagcagctcagctcactgtttcatctgttgatcagtctacaggtccagggttttaaaaatggatttttgctaaatgaataccacaacatatgccaccagaaaagtgcgtgtgtgccatttcaaacacccgccgtcctgctgctccgcgctgccgaatctgctcctctctcctctggccccgcgtccctcagaaggagctgaggtcagaaggaggtgtctccaggaaacactaggggaccttcatacctgaggggccaaaatagctgttttcaagctgctgctgttggagaccggtcttaggaaggggctgtgatagagctctttgtggaaagccttaaattaagatgaaggggagaaaaggaagtatcgaaagtttggaaaaatagagaaataagaagagctcctaaactgagcctgtggcaaagggagtatcctgaaattgaacgggctcattcttgaaatgtcagtgtggccggcagcctctgagacggcccagggcctccgtcctcctggaattctctttcctgagcgccactggacctggtgactccactccgatgcctggaggacagcaaaggcagcagagatggctgctaaggacgcacactggggtccccgaccgactttcgagctccgagggatgtctgctgccaggtggtggcggctgatggggaaacctggtggacagggcccatggacaggggctaacagcacagagggcctggggctgccgctgctgagctgagaggacaccctcagcacagcctatagggacgcagctggaacccccagctggtccacaccaggaccccaggcccacagaaactgtaagataaaacatggttgtgttaagctaagtttcgggataactcgctgtgcagtggagggtaactactggagctagcaacgtcaagccgtccaggagagaaccagatgggaacacccagcgtgggtcttccacaaaagaacttcttctcagccaggcagaggcacctgcaggaggtgaaaggcaagttcccggccagcctggtggggttcctgcggtccaacccccacctcagcacgctcccctcactccccgcggccgcttgtcctctgccgctgctctggatttgggattccgagactggcaggtcaggaggcccggaaaactacatttgcctcactctggttctccggggctgtggtgaggctgcctctcccctgccctccactttctctttccctgtaatatttatgtagctgagtgcagcaaacattttgaatgcgtgatcaccgtggggctcagggccctctgaagctctcactcgcccaaagctgacggcctctgttttttccagctgcagctccgggtgccatcctccgcggggtgaggtgccaccaggaatccctttccttagattgtctgatgctgtgagttagaagattcctgtttctactcacacgattgggtgcccagtatacactgccatggtttagaggaagctctgccactaactgtgtgactgaggcaagtggcttcactgccctgtgcctcagtttctctccctgaaaatgggaataaaatgtacttgactcatgggcttaatgaactgatcccgggagctcttggctgtaaggtgctcaggacagggtggcatccacaccctcaggggccctgctactttttattaccatcttgactctaggagctccgaccttggttttcatggatgccaatggaaattctgttttcagacaaatgtggaaggcatccttaaagataataggattaagtaacacaaatataaagaggaaaaatgatcaccgatgaagagtgcaagagaccacgtgtgtgtgcttgggaatggagggcctgaaggtcccaccctcggctgggcccgccctgccccatgctgctcccgctctcctgggcaccctaccacctcctggctccccacattcgcttctgggcacacgtggagggagggcaggtgcccctcaggtgttccctttctttccttctcagcacctcctgaggaagccccaggacagaacaggaaccactggagtcagaagcagaatgaggggcatctgtattcactgcagtttacggcggccattctattgctctcgtaacttgcaaagcagacttttaacttagaattgacatatactaaatatttaaagtaatcttcataagccccagagtgtgtgtctgtaactaaggacaattttttcacaattaaaaaaccctcatgaaatgacagtgactgttatcaaatgtctaactctgtgctcgagcactaacctccatgcttgcaggaaggctctttgtgaaactgacaataatcctgtgaggtgagcaccattaaaacctgtacttggccgggcgtggtggctcacgcctgtaatccagcactttgggaggcccagggggcggatcacgaggtcaggagttcgagaccagcctggccaatatggtgaaaccccgtctctactaaaaatacaaaaaaattagctgggcatggtggcatgcgcctgtagtcccagctactcaggaggctgaggcagaagaattgcttgaacccaggaggtggaggttgcagtgagccgagattgtaccactgcactccagcctgggtgacagagtgagactccaaaacaaaacaaaacacaacaaaacaaaaccctccattttccagacaggcaaatgaagcccagagtgacaaggtaacctgcttaaggtcacacagcaggaggcgaggcagggtatgaattgagtgaatctgacgccagagccttctggatcaacatgggccacattcccccagaatgccaggaactgagtgaatgtgaccccagtgccttccagatcaacgcggatcacatcccccagaatgctgggaattgagtgaatctgacccaggtgccttccggatcaatgcggatcacatcccccagaatgctgggaattgagtgaatctgacctcagtgccttccagataaatgcggatcacatcccccagaatgctgggaattgagtgaatctgacccaggtgccttctggataaacgcggatcacatcccccagaatgctgggaattcagtgaatctgacccaggtgccttccggataaacgcggaccatatcccccagaatgctgggaattgaatgaatctgacccaggtgccttccagatcaatgcggatcacatcccccagaatgctgggaattgagtgaatctgacccaggtgccttctggataaaggcggaccacatccttccagaatgctgggaactgggtgaatctgacgccagtgccttccagatcaatgtgaccacatccctccagaatgccaggaactgagtgaatctcaccccagtgccttccaaatcaacgtggaccacatccccctagaatgccgggaactgagccaatctgtcccaggtgccttccggattaacgtggaccacattcctccagaatgctgggaattgagcaaatctgaccccagcaccttccagatcaatgtgcactacacccctcccaatgccaggaactgaccaaatctgactccagtgccttctggattagcgggaaccccattcctccagatggtgggaactgcgtgaatctgacgcagtgctgtctggattagcgtgaaccccattcctccagatggcgggaactgagtgaatctgacccagtgccttccggatcaacatgcactacatccctccacgatgtgggaactgggcgaatgtgaccccagtgccttccagatcaatgtggaccacatccctccagaatgttaggaactgagcaaatctcatgccagtgctttccggatcaacagggaccacatccctctagaatgccgggaactgagcgaatctgacccaggtgccttctggataaacgtggaccacatccttccagaatgctgggaactgggtgaatctgaccccagtgccttccagatcaacgtgaccacatccttccagaatgctgggaattgagtgaatctgacccaggtgccttctggataaaggcggatcacatcccccagaatgctgggaattgagtgaatctgacccaggtgccttctggataaacgtggaccacatccttccagaatgctgggaactgggtgaatctgaccccagtgccttccagatcaacgtgaccacatccctcctgattgccagcaaatgagcgaatctgaccccagtatcttccagatcaatgtggaccacatccctccagaatgccgggaactgagcaaatctgacccaggtgccttctggatcaaggtggaacacatccttccagaatgccgggaactgagtgaatctgaccccggtgccttccggatcaaggtggaccacatccctccagaatgccagacagatgaaggacacagaaaacttaatagtaaaacatattttctgatacgcaggtacctgggaatctatagattcaggtttagtgctgtgggttgtccttttatacacagcacacataccacaaacacacacagatacagcatacacgcacacacacaaccacattcacatagacaagtacctcgcacacacatacacagaaacacacacaccacacatacacacagacacatacccagcatacttacacacacagcacacacacaaccacattcacacacacataggcatatagtaaacaccaactcaagcacacatcacacgtgcatggacaccccccccacacacgtggagatagagtcgacactatattagcttcccatgaattgatgtcataagctcagttaacatacgtgcccgctaagtacccttcagggatggcaatgctaacccgctgtagtttaaaagcttcagggaagacttgatcagtctcggcaggtattacaggcagaggcagatttctttttcctttttttttctttttttttgagacagagtctcactctgtcactaggctggactggagtgcagtgacacgatctctgctcactgcaacctccgcctcctgggttcaagtgattctcctgcctcagcctcccataatcccaattgggattacagttgggattacaggcacgcaccactacgcccagctaatttttgtatttttagtagagacggggtttcaccatgttagccaggatggtcttgaccttgtgatccactcgccttggcccccaaagtgctgggattacaggcgtgagccactgcgcccagccagaggaagatttcttatgctgcttttaaaacaaaagtagccacaagagttaacatttctagttttaactctcaaaaataaagtccttgtggattttatgatctcatttcagcaaatgtcactgcaaagtggagatgctatcatcccttagcagtgtgcatctgccttgggccgctggggccagccgctggctgctctgcaaggaagggtccctgtaagcaggacagtggccttccagggctgaggctggagaaaggtgctttgcctcggatgggcaccctttcttttagctctgattctgccccgtgccgtgtgcctctgagtgttgccttcccttctgaagctcaggcacatcctctcctctgctgccagctccctggtgccagttccctcctgcttccattccctgccttccaggcggggtgccaccctgtgtccccttacgattatctctctgcttgtgcaagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacatgcatagtcacaagcggctccctgctttatgcattctaaagcaattcagcattccacatgaaaacgcagccgtgacggcactgtgtgattgataatgctctccgtgagacttacgggtccataaaccaaagaatggctataatcacccacaggtccatcatttctttatcctttacatcaaacatgagatggtcatagtcacaattcaataacaagccacgtatggctccatgaaagccaccagtgagagctgaacgtgctctcccagctactcttctctactagagcctgcaccccaccgactttgaaaagagataactgtcacctgggaaccgacactcctgctggggaggggaagccacctggggctggagactacagtctggaccctcaggcggcagaggagcgagccgagagagacaactgtggcttctgcctctcccagtgggagtgaggcccctggtcagagggcctgggtcgggggctgtgctgcccatggctgggtgggattttaatctaggctctcacaggtggtcacacagagcggccctgctgactcccatcaggggagatggaggccatacgtgccacagatcaatacgatgcccttccatgcacagctctggacaaaagctcctcctgggcatagtgtctgaaatgagctgcttacttttatttccaagaaaatgacaaagacgattttgacccctgacaattctttcagtcctggtcctcctgcgggtagctgagagcctaagtgaggtgtgtgggacagaatgaggtgctgggaaattactggcagtggacatttaccactgggttactcggacatctagagcacgaagtgagtgacacagaggccggggaccctccttccctcccaagtgggcacccctctgagaaattccctgcgagccccccagctctgtcttctatggggacttcgacctcgctccacgttgtgcagccacatggcccacaggaatgggcggtcctgctacatgggaaggagcttagggtttaacacgcctgctccaggagctgcgccacacacccgccttcagattcagcccggcgtgcctgggcttctgaagtcccagagcactcagcccggcccatccacggatggctgggacagagatttacacatacaagtcggatattctggggagctggaattcaaggatggacaatgaaagcccagagacagaatcctcatcagtgagcagacaaggctctggcagggatgttttgggggagcagtggttccttacaacgtgagcctgaaggagtttccctcacttagccctcagctgggggcaaaccgtggatgctggagagaggagcgtgaggcatacagaggcccaggtggctctgtgggggtcggacgcatgggtgtgtccccaccacccacagaagggtgctcgcctgagacacagggtcggccgtgaggacacagtttcaggaagcatccacacaaggggaacccacagggcacttgggttatacgaacctaacaaagagctaaaatctgagctctctccctcctgcgtccattcgatccccttggacgaggctttctggaacgtccagaataaagagaatcctcatttctcagcacacggacttctgatgtgagaagacagtgactgtgtgctcattaaaactcactcttggccaggtgtggtggctcatgtctgtaatctcagcactttgggaggccgaggcgggaggattacttgggcctagagtttcagaccaggtggccaacacagtgagaccccatctctacaaacaataaaaaaatcacccaagctgcctaaccgcccccacccccccgccccgtggcacaggatgtttcccagggcagagagtgacatggctgcggggtcccgctgcagaagaaccctgtgcagtgagggccacaggcctgggaccccaagccgctcaggaccgtgcacagctcccagatgtcccctggggggacatctcttccggaggatctttagggtccctttcagccctgccatctgtacgcccaccatggactggtgcctactgcctgccgcctgggcacaggtgcccttgcgcctggccctcagcccgcccatgtgcaggaggggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagcccggttacacgcgagagccccacgcgccggaggttccggggcagccgggttacacgcgagagccccacgcgccggaggttccggggcagccgggttacacgcgagagccccacgcgccggaggttccggggcagccgggttacacgcagagccccacgcgccggaggttccggggcagccgggttacacgcgagagccccacgcgccggaggttccggggcagccgggttacacgcgagagccccacgcgccagaggttccggggcagccgggttacacgcgagagccccacgcgccggaggttccggggcagccgggttacacgcgagagccccacgcgccggaggtccggtttgtgcacctgcacacgggtcctgtctgtgctcccctgcagcccgggggagtcctggcccttcaccacgtgggaggctgtcctgggacctgaggactccgcccacactccatgccctccttcccttcctcaggcccacctgaccccggcagacctcctgctctcctctttgtcttctggccttgcaggcagctgtctaatgcagggcctaggcctgaggacaagcccccggggtggccaagctggctgcatccctgggaccctggtctccgtcactgggacgcagcagttctgccgggttaacctcagggggcatatgtgtctctcccatggccgtcattttctaccgactttgttatttcagcattcatttagtgcatatattccttttaagaggtgtctaaatccttcgtgggccacaacagggtagacatcaggggctgtagcctccagtgtctggggggccatgcaggccacatgagtggggggaggggctgcgtggtggaaggggggccgggcagctgggggcaccatgagtggggggaggggctgcgtggtggaaggggggccgggcaggccacatgagtggggggaggggctgcgtggtggaaggggggccgggcagctgggggcaccatgagtggggggaggggctgcgtcgtggaaggggggctgggtggctgggggcggccagtcctaccccaaggggagagcacacaggtactgctggctgggaatgcgggtctggggttgctcagatctttgattaagaaaatagaaatcaggcatttgtattatttatgtaaaatttctcaattttgaaaaccctcattgagctcttagagtacaaactgtgtcccctcaagaggatatgttgagtcttaaccccaggacctcagcatgttatgtaacttggaaaaaggaccttcacagatgtaatcaagtgaccacgaagtctctggggtaggccatgaatccagtaggactggtgtcctgatcaaaaacggaaatttgaggctgggcagggtggctcacgcctgtaatcccagcactttgggaggctgaggcgggcggatcacctgaggtcaggagtttaagaccagcctgaccaacatagtgaaaccccgtctctacttaaaatgtaaaaattagccaggcgtggtggtgggcacctgtaatctcagctacttgggaggctgaggcaggagaattgcttgaacggaggaggtggaggttgcggctacccaagattgcgccattgcactccagcctgggctgtgagagtgaaactccatctcaaaaaaaaaaaaaaaaaaaaaaagggaaattcagacacagacagacgtgcacagggagcgggtcacacacagaggcagggactggagtggggcagccacaagccgagggacactgggagctgtcaggtgctggcagaggctggaggaggagggagcacagcttcagacatgctctcagacttctggctcccagcactgtgggagaataaacgcctgttgtttgaaggcccctaggttcatggtacttggtgagggcggcctcgggcagctcacacatgggccacacagaacgtggctgtgggcgggattgttctgggtgagccatgcgcatcccctgctatcagcaacacagtggactcacactggctctaaaacccctgaggtcgtttccatctgatggtcgcacttgggcagggctcttctggtgccagcgggagaccttactcagaccctcatctccatccacccctcctcctcctagcactgcatggtccaaaagtttactcaacccaatgacgcatctttaattctattattgacaacatcgtggaatataacagaattgaggaatagccccacggcacgtttctagagaacccctttgcacttaatctattttctcctcattaagtaattatttaattaatagcctgtaagaatagtgtacgtaggtagaaatttatctaacggcatgatcgttccaagtctctatcttttcttttggatactttgtaaaaaaaaaaatcattaaaatctatacttgtgatgtcaacagccgttcctccatctctcagcaagaaatgccatcagcaaagagacggtgtgacgcccggctccctccccgtcactgatacggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagccccacgaagcagctctcgtgggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcatctttgatgagttactacctgtggggtggcacctgacccaggccaggacagtctgagtggtccttcctttcgccctgtgcagggctgggcttgcgacctcagtctttcccggcagctctgcttggcagaattgagggatgtctccattttatccagggcgagctactataggaataacaatggaggcttaagatctgtagaaaaatctatgagtttaggaattgtgattcctgatttttattgagtaaaatgctcaccctaatttcttcaacagaaaatcaatattccaaaccctccagaaatctggtatttgcaggaatcccgacactcactaacagaggtggcacaaaaggccctgaagtcagggatccctggggaacgatgcccagtccgacgtgcttctcctgagccgattttgggtttcccgttttctaaagccagctccccagggaacggcgcccagtccgacatgcttctgaaaggattctaggtctcccgctttctgaagccaactccctggggaacggcactgagcttgaggcgcttctcctgagcagattctaggtctcccgctttctgaggccatttccccagggaatggctccaagcccgatcacttctcctgaatgtattctgggtctcccgctttccgaggccagctccccagggaacggcgcccagccccatgtgcttttcctgaatggattctccgtctcctgcttttggaggccagcttcctggggaagagctctgagcccgacgcgcttgtcctgctttctgagcacttgaatctggtggcttctgtgtcatcttcactctgaatgagtgaaatgtgtgcttaaaatggccttgagaaaagcaccccctgcagggtgggagagaaataccgacaggtggggagggctggaggcgggagtccaggccgtgcgcccaagaggagggtcgtggtgggaatgaatgaggcccagggagtgttgggagacaggccggcggccgcgggaaacccctcagcaacctaccagcacagatgcaaggacactggggtgccagtccccccgctaccataaaggaagaagaggaaaacagaatgaggcaaagtgataggggatgaagggcatgaggaggctgctgtgtgctcgcagaggaggggaggcccccggttctgcttggcgctggctactcttcttggttgttgttttctaagtgctgttgactgctggctggacctcagtgaatgacccttctgctaaagctgccaggcactgcgctggtgtaagctgatcatagctccatcatcccaaatctaaaccactccagaaacaggccggcccctgctgcaacagcaagttgatctgtgactttgggcaaatccactcagcgccagactgccaagagaaaacggcggtctccgccgtccaagcagcacatcgtggagggcctacacaccccgatgttctgggggagcacttacatcttcagcaatgcctgtcaagatggagacagactcctgtgctgaggttgcagggttgcactctgaaaagacacccagggcagcactccaggcaggctgcatgctccggggagacacagatggcaaggagcagggcagcgggcggcctggaggtacagctacaccagctctggggttccacgctctgatctgacttagctgttttccaccctaaccccatgtgagacagccactgccccaaaactagggatgggaaccaaaacctttgagaagcccacgtgggacatgggatggcctgtgacccatcagctcccgggccatccctttgggttcagccacaggctgggggtgggaggtggtgccaggacactgtgggcatcgccttgggctgaaaaagggggctgtgaggaactcatacacctgagtcctcgtcctaagaagtcgcagttgttgggtgggccatggccacgaagactctgcgggaacactgcctggtcacacagactctgcaggaacactgcctggccacgtagactctgcaggaacactgcctggccacatagactctgcaggaacactgcctggtcacacagactctgcaggaacactgcctggccacacagactctgcaggaacactgcctggccacgtagactctgcaggaacactgcctggccacgtagactctgcaggaacactgcctggccacgtagactctgcgggaacactgcctggtcacacagactctgcaggaacactgcctggccacgtagactctgcaggaacactgcctggccacgtagactctgcgggaacactgcctggtcacacagactctgcaggaacactgcctggccacgtagactctgagggaacactgcctggccacgtagactctgcgggaacactgcctggtcacacagactctgcgggaacactgcctggccacgtagactctgcgggaacactgcctggtcacacagactctgcgggaacactgcctggccacgtagactctgcaggaacactgcctggccacgtagactctgcgggaacactgcctggccacgtagactctgcgggaacactgcctggccacgtagactctgcgggaacactgcctggccacgtagactctgcgggaacactgcctggccacgtagactctgcgggaacactgcctggccacgtagactctgagggaacactgcctggccacgtagactctgcgggaacactgcctggccacgtagactctgcgggaacactgcctggccacgtagactctgcaggaacactgcctggccacttagactctgcaggaacactgctgttacctctcactgcacggggactcacagacacaaagatggtcattcacagcatcaccaaaatcgatccacgaggctttgagaaaatgcatctctaaaaaaagcacatttggtgggtccaacaagcctcacttattcacggtcctgaactcagtgcatggaggcaagaggcatgtcggtgacccagtgagggaacaactgcacatctggggcaacagcctgatggtgccgtgggagccacgggtgggtatcctgcaaacatcagcttggacactcagcacctgcatgggacatgcatcgccacaaggtcacaggtgggcacctgggtgctgcagggtcagctgacttagtcaaaggctaagcctgcagtgagtgtccgagcctgcaattgaccgcggaagccagtgccctccctagttggcaacgttgttcagctgagctacagagaaagagctcggaggtctatggactccttcatggaaatcgctcccttgcgtctcctcatgtggacacagctccacgcctcacctctcaggccaggcagcggccaacccagcctcttcaccaggtatgggcaccggctgctccttgctgcaggaccgctggctggggtggccggggcacgcagcaggcacatcccgacctgcgggccagcacctgcgccccatccctgttacacctgttctgaagccttcaagagcaaagactgatgttcatcatggccaaagcagctgggctctttactacggaaggagattaattgctaccccgcgtacctttcagaggtttatatgaagccatttttcggtatttctctaagtgactgaaacatgcgcagccatttcatgtatttctacgcgtgtgggcaggcggccagggccctgggccacattccccagaaagccacgtctccactctggggaggggaatgcttcgtttttctgtgagtggtgaggtctctcttttaacctgttataaattaccttttgtaatctctcctaaaccattatatagaggagggaggggagacaaagaataaatacatctgtaataaatgtgggatttgggaaagatgataagatcagaacaatttgaatgaacgtggcaaatgaatttagagtttttgaactatcagctatttctgcaaataatgacttgtagaaggagaggctatttttaaaacaattcatgttctctgctttcatgtgaaggaaataaaacaaggcactcatgaatgagctcttcaagcacggactttcctggagctcacaggaaggggccagcacaggtcaggctggaggcacagtctgattctacggtggcttcacagggcgtgtttggagagcgccttcctcctcccaaccctgcagtccccggcctggctccaggtctgccccgcagccctgaggtgagtctcagcatgtccaggcgtctgaggtgacactgcagcctctctccgtggccctgtggtgagtctcagcatgtccaggcatctgaggtgacactgcagcctctctcggtggccccgtggtgagtctcagcatgtccaggcatccgcggtgacactgcagccactctccatggccccagggtgagtctcagcacgtccaggcgtccgcggtgacactgcagccactctccatggccccggggtgagtctcagcacgtccaggcgtccgcggtgacactgcagccactcttggtttctcagctgccgcaatcggtccttccagtgtccgacctctggggccctcagacccccaaacccaccttgtcgctgtggcctctccgcctcctgcaggtggcagcgctactgtagcctgccatgccccaccccttgcctccatccccacacattgccctgtttcttgggcagccatcttctggacctctccctcctgcaggcgtctctggccctgggggctccaggagggggtctccccaggagcgtgttccccagtgcatggcccctgtcctccaacacctgctcaggcctgcagccaaacccacatctcccattcctgcctctcctgagcaggaagccccatgagagggtccctttacaattcgtccaggctggccctgggccctgtgtggccgcaggtggtcacggaagccccacctgagcttccaggcccctcgtgccaggacttctgaaggttgtgcctgactcacgtctccattctcgacccattaaagggggagcggagatcgtgcttcccaagggaccctgaggccttctctctaggtctgagaagtgggaagtcccccattgggagtggaaggccaaggccacagcactgccgtcatgcgctccagagaaaggtcacctgccacccttctgtgtgcttacatgtctgtcaggacagcccggctccggccatgccctttgcacatcccggcctcctgggaacgcggagaacttcgtgcctgctgtccagttcttggcatccgggagctccagctggcatgaaggcagaaagaataacagccagtggcagtggaaggcatgagcgcccccggagagcagggccagaccatcagcagggcccctccaagaggagctctgtatgccgggggagtgggctcggcccgcgggacaaggctgaaagagctccccagacccctctctgaagacagcctctgcaatctccggccttcccgcagttgcccgcgtactttcttcattcctcaaaggtctcattaatttacagtctaagtggaccaagagagatgttacatatgttaccaggaagctagcatgttcattaattaatttctgtctagtcatccaatatttattgagtccttaagtctgaggcattataatagttactgctgtggggtcatacagataaataagacatggttcctatttctcagactcatcacccactggtaagacagccaccgatggaaacgactccaatcgactggaaaatagagaggaaattcctttggaatttaggggaaagaataagacttttggctggggtgtcagatattcgcttataggagcaatttcttctcagctgcatggcaccaccagggaccaggccccggggccagtccagatatctgcagtgttagcgagagacgctgttgacccttcttggcttatcatggaactgaatttccttaggttcagttggtagctaccctcgccccatcatgccgcggtgacactgcagccactcttggtttctcggctgccgcaatcggtcattccaatgtccgacctctggggccctcagacccccaaacccaccttgtcactctggcttctccgcctcctgcagctcctgctctgtgtttgggaacgcgtgcggcccacaggacaaagccttgttgcacacccgggtcaagggcaaatcccagctgcacagccgggtgatccagcggccgaccctgcttccctgcgtaggaggcctgagccaaggacactgcggccccggctgcaccgatgcatgggtgtgcacgcggggaccgagggagtcacgtgaatcatgtggcttccacgagctacctcttcccacaccaggagcaggtgccctcgtctccatcaagcgctttctggggagaaactccttcaaggataacggcaaatggtgagcgtgcctcactctttataatagaaattacaaaaagatggagaaacaggcagaatcccacccattcctgtggcaaagccgagaccctcatttccagtctttctgggacagcggagccctgggcaggggacaccgtgtgactggctctagctctcctaaaacacgggacgcaggagtgtttcttaagtgtgacaaggtgaaagcccctcgcgagttgaggaaggtctcattacttctgacagaggccccatgttggggaggtaggtgtgggggctcggggaggtgtcaggacagcgggatggacgtgggtccacagagctgactatcacagccgctcaggatgcagccgtggtgtgtgtgctctggcctattttaggtacagatataaaacagaagacttcggggcaaaaggaagtcttagaaaaatataaaggaatagaaagaaacagctgttccccggcacagaaaattcctgctaagaacacacaacgggcacggtgtaggcccattagtgttgctctgggtgctgcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtgtgtctcgacactgtggctgcagcacggtttcctcacagatgtttggggagaggctgagaggacctgcctgccctggagagccgggtttctgcctagggctcctcctgtgctcctgctcccaccccaggggcctggggctcccgctggaggatggtggctttgcagacccttccattttattcatcgtgttacagagcattctaaacctccttccttctagagtagaggctcaggggttaagggatatgtgtcttcaaacgagaacacttcattcaacagacttttcccgaagaccacgtgctgtgcgcagcctgacatgtggtgctcggccgcaaaagcgcttcagtctcgccccccacccccggagcagccaccaaccaagaaacattgtctgtatctggcagcatttggtccctgtcatgaggttacagtgagcccctggcccccaccctcacgtgtctgtgaggtcagctccccacgccctggtcctccccacctgcgaggaggctcgtggcacccacttcacggctggtgggaagacgggtgagaccacgtgtgccatgtgcctcatatgctgcctggcatattttgggtgctcacgaatgctgactgcagcctggcattgggaagggagtgatcccgccagggaggggaggcctgacagaagacatggtctctcagggggggtcctgatgtcatgtcagatggagccagggccaggggcagggcgggggtgcaggggctctcgaggcagaacctgggacccagcgcccatgtcggtgcagttgggaaaggtgcgtggctcccgtgggtggtgcagacgagcagtgaatgaagatgaagctggagtggcagcttggcccagatcctggaggctttgcgtttgcactgaaatgtgtggacttgacgccagaagcaactcctgcgtggcccgagtgtgggcctgggcggccctccattcctcggcagggcactgcctatcgcagcatccaggtgcagccgggggggacaggggtgaggagggaaggaggcatgagtgccagcctccccacacctgggagagcagcctagagaggagtagagggcagcaggggcccagtctgtcatccagagaggcaagggagaaggcaggggtgagcgaggcggtgcagggtggggctctgctcccacgggttcgatgtggggccatgcttggtggtggggccaggctgtgtcacctgtgaggtcacccctgttcctggcacctggtaggtcactgaatcaacagcccaccgccagcagggcagggcgatgcattttgcgtccctggctcaactgcagagtttcgttaccatttcccggaaacccagactctcaccaatgcagatggtctcctagctatttttaatgagggaagatttgttggaagcacaaaattgaattaagtcacattcagaaattctccttcaaagaggaactcacacagtcaagctgagaaagccagcatctgaggatagcggagctgctctgtggtgaacatagaatgtggggccctgacggactgtccccttgccctgacgcctctcctggcctctgcccccacactctggcaccagaatgtccacggggacagctctggtctggcctggcctgagctgcaggctctcctgtcacagcactggctgaatgcctcccctggtgtcccctggcctttccccggctggccacctgtcccccactgagctcacggcttctccctgaaccagcttctactccagtcccaaaccagctccacactgtggctctcggccccgtgcccctctccccacaccagcatgtcactgcgctcgccggctgtgttcccaagcactttctccctcctctcctttctctaccacagcccaggccttcctcacctcatgctcttcacccatccacctgtccatccttgtccccggagacgctgtcatcccacccaagtgacctgccagccactgtggaagttctatgcactgcagatgttaaacgtgaggctttttcctactcagggatgtgcagtcaaattggtgctcagatggagtctgatgaaaggcaagctctggaaggaacacggaccctgagcaagtgtgagagacgtaagccagcaatgaagccatgccccaaagcgaatccaccaccatccaattcccgctcatacacagcaggccagaaagacttccacgctgcacacaacgctcagagcagaacgtctgggaatcaatctatccaaatttgatttaatttatgtggaatttagagacctgagacctgttgatttatgtagaatttaggcttcccccgtctgaatcgcgctggtgtatctggaatttaggcttcccccgtctgaattgtgctggtgtatctggaatttaggcttcccccgtctgaagtgtgctggtgtgggtggaatttaggcttcccccatctgaatcgcgctggtgtatctggaatttaggcttccctcgtctgaattgtgctggtgtgggtggaatttaggcttcccccgtctgaattgcgctggtttacgtgacatttaggctacccccacctgaaacacatttatttgcagacgcttgcttacaaatagcagcctgaaactgttcattttctcttgtaattcacaaataaaacaggaattacgaacataaaacttctataatcaaacgggtaaggatattagccatcaggtcactgaaagctttgtttgtctattattggagccaatttcctggttaaatttactttacattttgatatgtattcagttctcagataaacacactatggaggttcctcagtgtatgatggggttacatcatggggttacatcccaatgaacccggtgcaagtcgaaatgtgctaggttagagacgtactggatccatataacctgctgagcatcacagctcagcccagcctgccttacgtgtgctcagaacactcatgcaagcctgcagctgggcgaaaccatctctcacaaagcctgtttatgataaagtgctgaagatatcaggccatttcttgactactgccctgaaagtgaataacagcgtagttgggtgagcactcagagtacagtttcacaccactgtaaagtgagaaatactaagtccaaccatcctgaggcggggaccatctgtgtattgttgagtctgctttccatgaatcatgcttcttcttacatgataaatttaaagtaaattaaaaggcatgcattacatgttaaatgggacagagtcaatatctggcttgaaatattatcaatattttaaagataatattaactaaattttataaccttaaaaatgtactgatctgaaataaaattctcgtgtccttaaaaataacctgctttttcccatactaaacaaaaataaactgacttttaaaaaacctgtgggggaaaggacggtttcctcaacaggtggttctgggagaactggatatctacacgcagaggagtgagccagaccctcgcctcccaggagaactggatatccacacgcagaggactgcggccagaccctcgcctcccaggagaactggatatccacatgcagaggagtgagccagaccctggcctcccaggagaactggatacctacacccagaggagtgtggccagaccctcgcctcccaggagaactggatatctacacacagaggagtgtggccagaccctcgcctcccaggagaactggatatctacacacagaggagtgagccagaccctcgcctcccaggagaactggatatccacatgcagaggagtgagccagaccctcacctcccaggagaactggatatccacacgcagaggacggcggccagaccctcacctcccaggagaactggatatccacacgcagaggagtgagccagaccctcgcctcccaggagaactggatacctacacccagaggagtgtggccataccctcgcctcccaggagaactggatatctacacacagaggagtgagccagaccctcgcctcccaggagaactggatatccacatgcagaggagtgagccagaccctcacctcccaggagaactggatatccacacgcagaggactgcggccagaccctcacctcccaggagaactggatatccacacgcagaggagtgagccagaccctcgcctcccaggagaactggatatccacacgcagaggagtgaaccagaccctcgcctcccaggagaactggatatccacacgcagaggagtgagccagaccctcgcctcccaggagaactggatatccacatgcagaggagtgagccagaccctcgcctcccaggagaactggatatccacacgcagaggagtgtggccagaccctcgcctcccaggagaactggatatccacacgcagaggagtgtggccagaccctcacctcccaggaaaactggatatccacatgcagaggaatgagccagactctcgcctcccaggaaaactggatatccacatgcagaggaatgagccagactctcgcctcccaggagaactggatatccacacgcagaggagtgtggccagaccctcacctcccaggaaaactggatatccacatgcagaggaatgagccagaccctcgcctcccaggagaactggatatccacacgcagaggagtgtggccataccctcgcctcccaggagaactggatatccacacgcagaggagtgtggccagaccctcgcctcccaggaaaactggatatccacacgcagaggagtgagccagaccgtcacctcccacccgagcgtgcgctgactcacagcgaatagcagagtggctggacgcacacttggccagaacatacatgaactcagagctaaatgtgagacctaaaacatacagggcaagacctttatgacattggatttggccacgatttcctggatataacaccaaaaacacaggcacaaaagaaaaaaatagataaattgggtttgatgacactcaaaacgtttgtgcgtcaaagcgcaccatccagagagcgaaaagacaacccatataaagggggaaaagatttgcgaatcaaattgcagtgggggattaatatccagaacatgtaggaaacttccacaactcaactacaataacgatggaaaaccatctcgttcagaaaacacaaagtacttgaacacatgtttctccaaagaagacacacaaatgacctcaggcacaggcagaggcgcttggcgtcaccaaaatcattggggaagcatgattcctcagtgcaattccacctcatgccatgtgcgtgactcttaccgaaaaaaacagaaagtaacaggtgctggtgagaaggcagagagatgggaacactgcgctattgcagcagctagggagaacagggtggcggttcctcagagttagaaatggaattcccataggagccggcagccctatgtctgggtgtccatggagaacaactgaaagcagggtcttgaagaggtatttgcacgccaggttcacagcaactttatgacagcagccaaagggtggatgcaaggccagcatctgtggacggatggacagaggagcaaaatgtggtccatccacactgacagatgtcaccagccctaagaggagggggtgcagacatatggcataacatggggagtcctgaggacatgtgcccagtgaaataagccagtcaccaaaggacacatacagcacaacacagggaaccctggggacactgcccagtgaaagaagccatcactagaggacacagactgtgtgattccacttgtgtgaggtccctggagtcatcaaactcagagacagagggtagagtgggctgccggggtggggggaggaacaggggtcagtgtttactggggacagagttccagtttgggatgatggaaggttctggaaatgggtggtggagatgctcgcacaacgttgtgaacacatacaatgctaagaggcgtgcacctaaaaacggttaggacgatccattttctgttttgtgtcgtttacgtaactatgagattctgtattactgagaaaaaggcttgagagaaccagaagtgtcacgtaaagtgtgaggcgtgagccgtgagcagtgattgagcccagacccccgcgaccagctctgctgctggccctgcctgaagctgcagcagcccctgcccttggacccctgagtctgtggggcctgcactgctgcatctctggctgccctgtgcccagaaacccaccctccatccttccacactcagagcctcctcccagctgagcaccctcccctctgctatggggcatctgtgggccccccagctcccaccctgcagacgtctgtgggctctgcctctcccgtctacacctggaggcccagaggggctcctgagggccacctggtacccggtgggtacccagcgagggtctggcaaggaggtcagctcagctgggcagacacatgcagcccggaggcctggggtgtccgggtcccacgaagccaggagaacacagatggggccgactctgccgcgcggtctcctcactgtgcttcctgcaatcatgccttgtacagcctcctgacaggccaccctcagccccatgtggccagcagcaagggctgctgttgcaccccaagcctctccgtctaggggaagaaggcgcgtgaagatctttctcagaaaggacaagcccacagcatctgcgtcggtgcctcctgcctctgacagggctcctggcgcccatggcggctggggtttcacgggggcgaggggctgggccacacttgtctgcatcccggggcccttggctcagtggacaaaacagctttaaagttcaaggataactcaaattggattttagaaatacaaagtcttaaaacatttgtaccagactaagggattacactcttaacttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattggaacaaaaaggaatgaattcccaatcccagaccagaacctcaaatcccccagaagagacttccatgagccccactgagcccaggcatgaagaactctttctctgggtccaggagtggcaccaccttaatcagctctcctcataaatgtcccaaggagaccaggaaacagcctcgagggagacggcgctgacccggggccaggggagtttggctcacgtgatccagtcacacagaggtcggtcgttgtctggacacagacaatgggaatctgggctgataccgggcctttgaaaatagtcggggaggaaaacagaaaagatgcagaagttgataattgctttgatatacccatctctgtttttttttttggacagaattcctattaaatacaatatagagtatttcattttctgcatctgcccatctttgaatcttcatgtatttttaaaaaagaatgaatttaaaactctaatccacttggcccagatttgttttgggaggcaggtgggaacccatgagctgtcttgagcacagtggctggagtctgtgcggtggctggaaccctgggctctggagggctggatgccttcaggtcccggaccccccactctgctcccgtggacagctccatcttcagcagctccgtgcatagggactcctgggaagacttctctttgaggaaatgtttccgctgctaaaatgcaaagttccccgaaggcaggtgggcactgtgctggtgctgtccgagtggagcctctggtgagccggacaccatcaaacaacatcagagcttgcaaaaggagctctgcagtgcctgagacctgcaaagggccatcctggggtccgagggcttcctggtcctgacccagtcctgcagggaggtcctgggagggtcgctagggtgaggacgctgagagcccatgtgctggaaaggacccaggaagagggctgaggtctcacgcctggcagagatggtgcccaggtagtgactgcaccacacccataagggccacctgctggccacgtggaggacggggagcggcaggcggatgagggaaggaccgtccatttgactgggccacaggtgtttagattaaacctgatccacgtgtgtctgtgagtgtgactcggaggagtccagcattggattcagtgggccaggaacagggcattcttctctccagggagcagaaaccacaagatagacatggcccattgtgctcgagggtcactttcattggaagatttagagaaaatgatttttatacaataacgatatgggcttatagggtaaagtccacattcgcataaaattttaaccaagtagggacagagcctggcaattctgggttctgagacccctggggatggcacctgagtcccactcaggccaccacccctgcccccccccgggcactcggggtgaagctgtgtcactgtggctggacacatgtcctggaatcagagttgctctttaactgtgtctggctttaaggctcgtcttctacgccagacaaagtaaacttcctggaactgttttttgaaatgtggctactgtcctttcctcttctagaaaaacgaggatgaggagccaaaacagaggagggtgtcgcaagcggcagacatttgaaagcagcttaagcccctgagccccctttctggggttcctgggcaagaggtcgcacgcctggccgaggtggtgccccaggggtgacagcggttgccctcctgtatggcacaactgaaaataaaggctgggccatttccccctccatctgccaaaatcccattactgaggttgtcaaaatgcttcaacctctcttaaaatgcagtgagattgcttcacgatgaagggtatgaccaagtggaattgtacacggtatagttaggaggtgatgatgaccacagtggggtctttaaaacagtgcacggcccgcctaggggacagagccggccctcccaacacttccccgctacagaggcgttctgtggccccggggctgctccccgcctgggcacatggcggagacatgcaagccacaggggagggctctgacctcggcgtggctcccgccagggacctggcagctcttccgcttgttctctctctcattcctcatggggactgcactaggactttccccttctccccaactccccacccaatgccccctcttttgtggcaggtgagctcacgtcctgctctgaagagaaaatggaggtgccacacgtggtctcctgaactcccagccctggacgagggggtcctgtctcattcaagtaaaccccctgcagttcccagcagccttaggacagcaggctcctttacgacttcacctctgcgctgcccccactgagaagctcctgctaacctcgtccagttgtcaaatcacttcttagcatgcaaaaccttgcccgcatatcagctgctctgccaagcccaccctgagttccgaggaaggtaatcgaggtgccttcctgaaggtctgcaccaggcagaaagccctgttacagcctagttgcatcgtgtgacaactgcctgctcataatgtgaactctgcggtgactagaaccgtatctggcatatggcagacattcagtacaaaacccatggacagaacaaataagtaagtccagaggtctccctggggacagggcctgtgttactcttccttcccacgcgcccagcacagttaccctttcccgtcccatgcgcccagcacagttaccctttcccgtcccatgcgcccagcacagttaccctttcccgtcccatgcgcccagcacagttactcttttccaccccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccaccccatgcgcccagcacagttacccttttccgccccatgcgcccagcacagttacccttttccgccccatgcgcccagcacagttactcttttccgccccatgcgcccagcacagttactctttcccgtcccatgcgcccagcacagttaccctttcccgtcccatgcgcccagcacagttaccctttcccgtcccatgcgcccagcacagttaccctttcccgtcccatggcccagcacagttacccttttccgccccatggcccagcacagttactcttttccaccccatgcgcccagcacagttaccctttcccgtcccacgcgcccagcacagttactcttttccgccccatgcgcccagcacagttaccctttcccgtcccatgcgcccagcacagttacccttttccgccccacgcgcccagcacagttactctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacacgcccagcacagttacccttttccaccccacgcgcccagcacagttacccttttccgccccatgcgcccagcacagttacccttttccgccccatgcgcccagcacagttacccttttccgtcccatgcgcccagcacagttaccctttcccgtcccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccgtcccacgcgcccagcacagttactcttccgtcccacgcgcccagcacagttaccctttcccgtcccacgcgcccagcacagttactcttttccgtcccatgcgcccagcacagttactctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttacccttttccgtcccacgcgcccagcacagttactcttccgtcccatgcgcccagcacagttactctttcccgtcccaggcgcccagcacagttactctttcccgtcccaggcgcccagcacagttaccctttcccgtcccatgcgcccagcacagttaccctttcccgtcccacgcgcccagcacagttactcttttccgtcccacgcgcccagcacagttactcttccgtcccatgcgcccagcacagttaccctttcccgtcccacgcgcccagcacagttactcttttccgtcccatgcgcccagcacagttactcttttccgtcccatgcgcccagcacagttacccttccaccccatgcgcccagcacagttactcttttccgtcccatgcgcccagcacagttactcttttccgccccatgcgcccagcacagttactcttttccgtcccatgcgcccagcacagttactctttgccgtcccatgcgcccagcacagttactctttgccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttactcttttccgtcccacgcgcccagcacagttactcttccgtcccatgcgcccagcacagttactcttttccgtcccatgcgcccagcacagttacccttttccgtcccaggcgcccagcacagttaccctttcccgtcccatgcgcccagcacagttaccctttcccgtcccatgcgcccagcacagttacccttttccgtcccatgcgcccagcacagttaccctttcccgtcccatgcgcccagcacagttacccttttccgtcccatgcacccagcacagttaccctttcccgtcccatgcgcccagcacagttaccctttcccgtcccaggcgcccagcacagttactcttttccaccccatgcacccagcacagttactcttttccgtcccatgcgcccagcacagttactcttccaccccatgctcccagcacactcttccgtcccatgtgcccagtgcagtcttccgtcccatgcgcccagtgcagttactcttccgtcccatgcacccagcgcagttactcttttccattccatgcacccagcacagtcataggcttccagggtaggtactgtcaatgtttgttccaggaaaacccaattcagcttttcaaacaagatttatacacaccttcaggagcaagcatgcttgaatataatgagtctacctttaaggtaaatttcagctctttgggtttgtaatggatggaaaaaggcaggcaaagaaacaatttcaacatcttccagccccagagatgtacaaatattttagcaacatcccagtgactaaatggtgattcagccgagacgccccaaataaacagtctctattcttaactctgctcccatcttactgaagcgttacaaggctgtacttacatctggggtcaagccattctcatttggcttcgaaatgataacacaaaactgttacaataacctggaactgtaagggtcctggggatcccacattcagtcccacccgtgtcatggatgaacccgggaccagcagggcagccagccagaggcaaacccacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagagcacctggcctggtggacctgtctcccagacctgctggggagcgccgtgtgctcagctgaacacggctcctgtggccacagtcctgtgttgctcccgtggttcggccggcgaagctccgtgttcatgtgcacagccacattggccattttgacccaacagacactcaagcaactcttgcgtgaatttggtgggaagatccatcgaatgtattgtttttggactaacctgatgagtccctttggtaaagcagtcccactgactatgcctgtggacccagctgggtgcagccatctctgactgtatggtgtccatcctgagctccaagtcatcagagagcggccaggagtgcatctgactttgctggtgacctgcatcttatctgcgtccacactcaactgtgtgcagcggcccaggaaggtggagggctgctgagctgctttagaaaatgagggtttgaagctgccctttggaaatgattaggttgttcaaaagtaattgagctttctcaaaaggcagctggggctaaaataaatggaagtctacttaacatattgttaaaaatatgaaggggttgaatggcatcaaaacacattaaatgacagaacatgactcgcctccttggctggattctaaactcctcggggcaggcgctttctttagtgacactctcagtgttgtttgtgggagacgctccgcaaatgtggggagcaggtgggcgcctttggtccccgtcctcctggcaggcagtggctgagtaccttctcgggaaaggaggcccccgtgaggctgggtgggctctgaattcccggtgtgttgatagcgatcggcacatgcctcaagccacctggaagagaagctgccccaagattctccaggccctttctgagctgaaggtgacgtgacagacaggcttcaaagaagggtcagagacggccggtgggtgggccccgttcccaaacacccaccttggatctcatgccctggagcagagcatgtgtcctggtcctgcctgggcgaggccggcacccgctgccctagcttcaccactggtagccccaagcatctctggctggggatacatcacccgatcacaccagcccgagaaccttccctttcccaccaccattcaaaggaggctgctcttagccagaaggcctctgtgttccaggcttaaatctgggcgagattcagggtttaactctggccttgcagttttagaggttgttataggctgaattgtgaccccccaaatccatccattgaagctctgatccccatgtgcctatatttggagacaggacctccaaggagctaattaaggttcaatgaggccaaaagggcggccccgatcctacaggactggtgtccttacaagaagagtgagagacaccccgtgcctgcaccagggaaaggccgtgtgaggacatggggagaagatgctgtccacaagcccgggagagaggtcacaggaagaaccgcccccacccccgccgccccccacagcttggtctgggactgtcagagctgtgagaacagacgtgtcctgcagtttaatgcacccagtctgtggtcctgggcacggccacccgtgatgacttacacacagatgcacgcagacggcttggggagcatggccagtgcttgtcttagtgtgggaggcttggtgtccgcccctggccacggagtctcgtgtctcctgctctttcgtggacggcgctcacctacatcttacatgcaggtccctccatgttgagtgaaaaaatcagaggaggtacaatcccaccagtgcccggctggacacatattggttttggagccaaggggtaacagtttccctctacaaatgaaaagctcctctccgtcctggtgggatggggatgacatttttaaagggtagagtaaatgtgctcctgcttcaggtgccctttgcagaggcttcccgagtctcccgggggcaatgcatcttctcagtaagaagaaaccccagcaagaaatcacaccaggcgtcttggataaacagaagtgaactacgtcctggttgcagctgtatttatttcacacattcatttaaaaagttaatttgacatgtatttcatgaagcttcggtacacacgccacgttgctccccgattttatcttcatgcgtcttccttcaccagacggcctggcgagctcactctcctgtctgagggctgagaagcccaagctcgccccagactggggcctgtgtggacgcggcccccagcagtgttcctgtgtccgtggtttggaggctctgttcgctgagcctcagcacgacctcaacctgatctgggagtctgagtgcgctgggcttggagggcacgtgtgctgtgagtgagccctacatgcaggagcatggtgctctctggccgggcagcctcacctccagtggaagctaagcgttgtgcccgggcagggggcgcaggcaggagggctgagcttccctggttatcccctgaggcgaggacgcagcagcaagttcccatcccctggcctggcttctctgggcccaggcgctcccattcgtactcacggtcctgagttgagctccagagtgttcccctacagggaggggtttgctttccccagaatggggcctgggcgtggcagcccctccacagaggaagggccctggtcctcgggagcatttacagcatcgtgggtgccggctggggcgccagccaccaaggccacaaggccggcttagaaggtctggaagagcctgactaggaattaggatgctgtgcgttaatctgcaaataccacccccgatgcggggaggacctggtgtctgggcgggggaggaggctccgaggggctcttgctgccttggccagacctgcagcagcagggacagaggctcccgggaatgcctgggtcagaagagagggctctgccactcacccctcctctcttctcatccatctcctggtgccccaaagggcctcactgttcctgtggagagctgttattttgaaattatatcttgtcatgaaagtttcacttttaaacactattaaggcctctcggtattatacttcttttgaaacatctattagaataaggatctcacaggcagctgagaatcaacaggaatgtggccgtacacaataagctccacgtgacccagggggacgtatctgtgtgctctgggaaggctgacatttcaacattcctggcgtctgaattcgacatctctcccaccaccgggaaggaggcgccccagaggggagggaggtgctggggagcgggattgagagcctgatactggcgtgaagttcatcagcagaggagcgaagggaggagggcagggtcaagaccagggactcatggaagcatttggcatcctgtgaagtttctcagcctctggaggctcctctctgatgggagccttatccgagaggtgggtgggagggacgcaggctgccggtgctggtcccgggttgtttgtggtgcagccagcggctggtcactcacatgcagactgagctgacgcttaggacaaaatccatgttttttcattttgaataaaatcactcgatatttgacattttaggcattgaagtcgtcatcacggctcatcacaggagaaatcagagctctgtgctgttgtttctggatacgtgcttgttttagggttttgtatgtattatttcagagctccgtgctgtttctggacacgtgttttagggttttgtatgtattatttctagttccatgaaggggtaggggcatcatgtccttaggatgctcacaggtcaaattagggctgtcccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctaaaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgcggcccaggggcaccttcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaatttcagtcatcttgcacacagatcagccctggggtcaccatactgtgtttttgggacactccaagatggatgtgctttggttctgacggcagagaacaggacacctcccaaggtgaccgcaaggaggcctgagctcctgggccgctcattccaccccctctgcgtgctcacgcatggctccccagcaagacagagcagctttcctctgacctcttcctcttccagaagccagagccagccagggttcagggagagcggaatcactgggactgtatggagtttccacttttagcacagctggatcttttcattaatttttttatatctacatgggtttaactgtacattatattgtgcttttttattgctgattcggccagcaggaccccttcctccatatgccttttatcactttatttaaccgtgttgtacacatacacccactttgctttgtatatggtgagctaccttaatgccattgcccagatgcagatttgttattatgtatacattgttaaatttaacactttccttggtggatcaggttcctgtagggcacagaacactaacctatcaatgacccagactcagaaaagccaccagagaaccagcaaggtcaaattgcttcggcttcagctccggaacatcgtctccctccgtccacggcaacgcgggagcctgaccagctccggaacatcgtctccctccatccacggcaaggcagggggagcctcaccagctccggaaccccgtctccctccgtccacggcaacgcgggagcctgaccagctccggaaccctgtctccctctgtccacggggtgacttcatgctgccatggccatcacctgggttgggggtgggtagtgcccagggcaggggaaacacacagagcaactgaaatattgtcgtctttccccagagagggctccaaggagtggcgggagcttctcagaggctcctaatcaatgctttttcttttaaacaatccacgagctaatgagagggtggagaatcccatcccgatgggcactggcttctttccagcaagcctcggaatcacctcagtgcccctggcccacgggatcccaggaatcaagttctgatggatttgtaagcagattcgttcttcagattataattagagccgctctctctccccgcctttttgaaagttcccattagcctgagcaagggccaaaatattattggaaaacccatgggccactttgttccctctgtaccacaggttaaaaccctatttactttgtcagagaggaaaaaataatcaaataaactctccatttcagatgctactgaaacgagcaacaagggaaggggggagatgatgctcatgtgatttggaggccaaaggtgcttctaactcacagtcggagccaccccacgcctccttccacaggctccatgacggcaaaggccctgtccaccagccctatggaaaagagcctggctccagcacctttcctgggacttgatttcctcactttttaaaatgacttgccaatcaattatcaattgataatgactactgattgcaacatatctttagtaagtaaaatgaaaggtgtgtcttactactgctggctgtttccggccaacaagcccaagactgagaattggtgaaggaaggcattgcctgtggacctccctcccatgggtgcccggcctgctcttagtcccccactgaaggctcttcggcacctagagccccatcatcccttccccgtgtgtttgctaacgctgttcatcttgtctaggatgcttctcctccatcaaaaccacttcaagaatcagtccctcctggaaccctccccggagacgctctcttcctcacctctctctggacatttgcaggaagaagcaagacccgtccacatgacccatgcacgattcagtggctctcctccctctgggaggtcagttttactggttgtacgtggagtcctctaagctatgagggaagaaggggacaactgtttggccaaaccatagtctctgtggcccttgggaagaaggatgttgtggacactgcacctggcatctcctgggcttctgtcctctctcagctttgctcttcatgtccccggcatttttaactcctagctcagttacttctctgctcatctttcctcttagacttggggtccttgagggccagctctatgtctggttcatctttgcattctccatcagattgcagaagttgtgtcaacgacgaaccaataaatgaatgtgtgcagtcgggtgtggcagggaccaacaatctgaccagcgctctttctgtgtggatggtctggccctgtgttgacaaacacctaaataatccagcacgattcccttctagatgtatctctctacggtgactgagtgtgctcaatgcttacaactaggctttttccaatcacctgtaactcatgtgaatgtggtcactgatttgagcatcaaaagggccaaagttatcgagggcttttgcatatgtagatggagaacaggtgactggggtaacgcgttatttacctgtatttagatgggcagtctccagatgtttttaaacaggtgactggggtaaccagctacttaactgtatttagacggggcagtctccagagatttttgaaaaggaagaaggaagtaaattcagttacttggatacaagtaggacagaaaatattcctttgagattgtgagggtatttattcattgaacagttttagaggtacagagagactacttgatgagctgacttctgtttttttttttttttccagaagtgggtatctaggtttgctgattgctggagtaaacgatgaatgtggatggcagggcagcattttggaggtgaagccatctgcagatgcgtgtaccccacgagggtgagaagctccaagcacacccagaatctagggtgggggactgttcgcctgagcagcaccaactccatctcaagatgtgtgtctgctgtctgttgctgttctttgtttgagctttgaactcctcacataaccccttaactgtcctcttgatcttttattcatgagcttgacacattgggcagaaagacacagtctcagtgagatgataccaacttggagcttagtttcttcttcctaataccttttgcttgtaattccaaagtattgatattaaatactcataagtagccaaggaagaggaccatcccactactcagtttaatctgtcttgaaaatgcttcggtattgcatgaacgtgatgcatgatccaacccaatgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccacagcgaggtctggtaatgggcttggacctgcctgaatcctcctggctaagctgtggagtggagccaggagtgctgtctgctcacggtgggaccagcctgcaatcggtgcggcgggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggttggctgagctgggcttctggcaagtccgtggctgggatagctatctctgggttggctgagttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctccctgtgtcctctttgcacgttgcatgtgtcgtggtgggagctgtgaggcggtgccgtgacggggcgatgctgctgcaggagacgtgctccggggcacgactctgacgcagcttagaagagctaatgcttgacaccatctggatccccttcatgctttctgtttttatgggaagtcctaattcaacacatgtttcctgaggtgctactacgtgctaggttactgggtacagcaagaccatggaggaatcagagcgtaaacaagcgggcgcgaggtggtccaggcatggagggcacagaagccgtgatgctggggtgggctgggggtcagctggcctcaacggggtgaacacagcagctctcccagacatcgaaggagattcaaggagcctgaaactcaaacaagtggaagaggctggaacgtcacctaaggtgataggaactggggacccgacctggcgcccgttcaacagacccaagcctcccatcccagcatcgggccgtgatgtgccgtccattacacaacgatggaatctgctctgggaagaataaatggctctggtgagcatgctcagaattccattttaatattaaaaaatttaaaataattcttggtttaaaacacaaatagaggtataatatagtagccatctagaacctcaatttaagatatgagattgggtctgcttttgaattttagaaagtagtaagagtctgctgttttcatgtttaaatgtgtgaggcacttcagtaccatcagaacgtgtgcagaagacggaggatgtggaagggcccccaaggacaggtctgtctgcctggtggacactgagtgaggtggaggggaagccacagatccccactgtcctcatcactcaggcacatccaggctgatgaaaaagcaacagaatgggttcaaaggcctcttaccaaacgactcggggcttccctcagcccctgggtgttcacttcagccgcaccccagtcccccggcatctctgaggggccctgaggcgtgtcacctcactccccaccacccctcacttctgcctccatgaaatgtgggtccccttccaggcggcaccttccttacgaggactacgggtgtctgagaggcgcctctgagtccctatgccaccgcatctgggttgggtcacgatgctccccttgcacggagctaagatttatagaccgagacagctccaggagtggccaccccagcatttctcaggggaagaaatgaggatgaaagaggtggagctcgtacagtcagcaacggtggcccctgggcagaccctagagctcctggggccctgcccaggtccttctgtgtatgtctcagcccaggtcatcacagatccagccagtgatctgctggatgagaagcttctgcacggactcgtccaccctctcactgtaaacattgctccagacgaacgcaaggctgagagccgggggtggtctgcgggaggcaggcatgggggagaggacaggctgcgggaggcaggttgggggagaggacaggctgtgggaggcaggctcagggacagggcaggctcagggaggcaggctgggggagagggcaggctgcacaatgctgggctcctccgacaatgctcacctctcttctcccctccatttgcacctcagtcctgatatttatctccccaaaacgtctgggacactgggcagaggctgagtgagggtgccagcatctgcagggcaggctggaggccgctgctttgctctcaaatgtcagcatcttttgtaggctccagaaccgtgtggataaagcaaaacgctcacccaagaggaagctgatacagcagcaaagaccacccaacgatctggttcctacccatttccaggcagtcggtaaatgaaacctaacatgtttgacgcacgccctgatttgaccatcacaaagctccttctctggctgcaggatgcactcagcacgcacgccacaaacatggagatcacaggactccctacacaccatagtccatacagggccttgagtgtggagatcacaggcctcccctgcaccccacagtcctcacagggccctgagtgtggagatcacaggactccctgcaccccacagtcctcacagggccctgagtgtggagatcacaggactccctacaccccacagtcctccctacaccccacagtcctcacagggccaagagcatggagatcatgggcctccctacaccccacagtcctcatgggaccctgagcatgaagatcacgggcctcccctagaccccacagtcctcatgggaccctgagcatggagatcatgggcctccctacactccacagtccacatggggccaagagcatggagatcatgggcctcccctagaccctacagtcctcacggggccctgagcaaggagatcatgggattccctacaacccacagtcctcacggggccctgagcaaggagatcacgggactccccgcaccccacagtccacacggagccctgagtgtggagatcacgggactccctacaccctacagtactcacggggccctgagcaaggagatcacgggactccctgcaccccacagtccacacggggccctgagtgtgatcacgggactccctacaccccacagtcctcacggggccaagggcgtggagatcacgggcctccatacaccccacagtcctcacggtgccaacagcatagagatcacgggcctctatacaccccacagtcttcacggggccctgagtatggagatcacgggactgccctgcacccacagtcctcagcagtttctagagcagaagatgcccattaaaggcagatctcttccgttcagctgcctggtctgctgagcagttgagggggatggtgaggcagtgtgggaatccgcatgtgttgaggcctgcatccctgagctgcgggcagttgaggtgattctgaggcctgtgtccctgagctgtgggctgttgaggtgattctgaggcctgcgtccctgagctctgggctgtccgggtgattctgaggcctgcgtctctcagctgtgggctgttgaggcgattctgaggcctgtgtccctgagctgtgggctgttgaggtgattctgaggcctgcgtccctgagctgtggggtgtccgggtgattctgaggcctgcatctctgagctgtgggctgttgaggcgattctgaggcctgtgtccctgagctgtgggctgttgaggtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtccgggtgattctgaggcctgcgtccctgagctgtggggtgtccgggtgattctgaggcctgcgtccctgagctgtgggctgttgaggtgattctgaggcctgcgtccctgagctttgggctgtccgggtgattctgaggcctgcgtccctgagctgtggggtgtccgcgtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtgcgggtgattctgaggcctgcgtccctgagctgtgggctgttgaggtgattctgaggcctgcgtctctcagctgtgggctgttgaggtgattctgaggcctgcatctctgagctctgggctgtccgggtgattctgaggcctgcgtccctgagctgtgggctgttgaggtgattctgaggcctgcgtccctgagctttgggctgtccgggtgattctgaggcctgcgtccctgagctgtggggtgtccgggtgattctgaggcctgcgtccctgaggtgtggggtgtccgggcgattgtgaggcctgtgtccctgagctgcaggctgttgaggtgattctgaggcctgcgtctctgagctgtggggtgtccgggtgattctgaggcctgcgtccctgagctctgggctgtccgggtgattctgaggcctgcgtctctcagctgtgggctgttgaggtgattctgaggcctgcgtccctgagctgtctggtgtctgggtgattctgacccctgcgtctctgagctgtagggtgtctgggagattctgaggcctgcgtccctgagctgtgagctgttgaggtaattctgaggcctgcgtccctgaggtaggagctgcccgggtgattctgaggcctgcgtccctgagctgtggggtgtctgggggattctgaggcctgcatctctgagcagaggggtgtccgggcaattctgaggcctgcgtccctgagctgtgagctgcctgggtgattttgaggcctgcgtccctgagctgcggggtttctcggtaattctgaggcctgtgtccctgagctgtggggtgtctgggtgattctgaggcctgcgtccctgagctgcggagtgtctgggtgattcttaggtctgcgtctctgagctgtggggtgtccgggtgattctgaggcctgcgtccctgagctctggggtgtctgggtgattctgaggtctgcgtccctgagctgtgggctgttgacgtgattctgatgcctgcgtccctgagctgtgggctgttcaggtgattgtgaggcctgcgtctatgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcgtgcgtccctgagctgtgaactgcccgggtgattctgaggcctgcgtccctgaggtgcggggtgtctgggtgattctgaggcctgcgtccctgagctacaggctgttgaggtgattctgtggcctgtgtccctgagctgtggggtgtccgggtgattctgaggcctgcgtccctgagctacaggctgttgaggtgattctgtggcctgtgtccctgagctgtgggttgtctgggtgattctgaggcctgcgtccctgagctgcgggctgttgaggtgattctgaggcctgtgtccctgagctgcggggtgtctgggtgattctgaagcctgcggctgtgagctgtggggtgtctgagtgattctgcggcctgtgtctctgagctgtggggtgtccgggtgattctgaggcctgcgtccctgagctgcggggtgtcagggtgattctgaggcctgtgtccctgagctgtgagctgcccgggtgattctgaggcctgcgtccctgagctgcggggtgtgtgggtgattctgaggcctgcgtccctcagctgtggggtgcctgggtgattttgaggcctgcgtccctgagctgtgggctgttgaggtgattctgaggcctgtgtccctgcgctgtggggtgtctgggtgattctgaggcctgcatctctgagctgtggggtgtccgggtgattctgaggcctgtgtccccgagctgtgggctgttcacgtgattctgaggcctgtgtccctgagctgtagactgttcgggtgactctgaggcctgcttctctgtgctgtgggctccccaggggattctgagggctcttttgcttgtggcccttctgcttggcatgcatactcaggcctgcaacatagcacgtggtcctgatccttcttcgtaatgtgtattttactggttggttgcttgttgttcataatttttattatatcatcttttagagaatgctcgatttagagaaaaaaggatgagttttggaagcagccctaccaatgttctttctcttgtttcttgttgtgtggttttggccaaacgatcaaaacaatcaaatctctgggtcttggcttcccccacggcaatgaggctggccggatgtagggagtgaggcgtagaggatgagctgctactactgcacaggaatgtcccagcctgctgccagctccttggggaagcagcaagatgccacccaggtgagctgcttcctccgcacctatgagaggcaggaagtggcaggtaacatggagctgctggagacccagccccagggaccccctgccaatatctgagtgaacagttcttgcaagctaggaaggctggcccgaggatggcagttgtatctggcatttcttggagtgtctccagtttattttggaaataggttttggcaaaagttcaaaatgtcaaactcctgaggctttcagttgtcctctccctccggctccagtgtcgagtacccagtgagctgttgagagagaaattcttaaatgtaccgcagcgttcagctcctcagtgggttcggaaacagctggaaggaagggtgtaaagcccgcctgagatggcttcctcagggtttgcctcccagagacaccgtggcattggagcagggtgcagctgcattctggggtgggccagctcggcaccatcggccgatcttcctggacgagccagggctcgctggtaggccgtggaaccttctggccgcatctttagcttctctagaaagggctactcgaccgtgggctctaaagagcctcctcaccagtgagcgtcctgcccaactctgggaaaacctcccagatcctggcggggagctgctgtgagctgtggggccgaggaggctcccgacgcccagtagtaggctggggggacctgcagccgcaggaccaagggattgatttctttctcggttataaattgcaactggagacatgctgacatgtgaagggaagctcgtggatggggggcacaaggcaatatcccgaggagagagacaggctcaattccagtttgcgcgcactggacaaagtgaggatggggtcagcgagggagagcaggtggaaagaaaaaaatccatgcggcgaacgccctggctgtggcagcgggtttatttttgaatgaaggcaccatgcatttaaattaaatgtcagatgtaatttagcacccaggcatcaagaggctgagcgtgtgcagggaaagccggcagctcgcaggagtggctgagtgcctgctctccagcgcccacggagtgcgctcgctcgggaggtgtctctgtcctcggcgtgggagggtctttgagaaggtgaagcttggctgttgctaagacacacgagatcattgtttggaaggcgttttcccttctctctccctcaaatgactgtttaattgaggttactctgcaccgctgacacgcggtggaaagcccgacatcacttggagaacttaatcaaggctgatggagccgcgcgcacagaatcccaactgcccgcaccctttgtttcatgttcaccaagaccgaggggaccattcctacgggatgaggaaacacatctaacacaggccttctaaagagagaggagggagggagggagggatggaaagggggaaggacagagaccaccgtgaacacatctccgcttttcgctatgggcagatgcttccatagacatgggactttgcagccaagtgggacttgcagttgccctggacagcccggccttgcgagactcccattccgatttcttgacccctgagggtagatatgctcagaaaagctctggtcttcaggctgcaagctcccaagcaggatccacgagctcctgcaccccaaaccccaggctcctccacacgcactcacgaggggctcttcagagcccacctgcctgctgtgtctgcagctctggcctggctcggctgggttttctccagggtgggggcaccgagtggccagggcggctaagacaggtcggccatcacggatgtagcggggaacgtcgtaagtgctgcctcaacaacatggtgacttgtccgaacatgacctgactttgcatcccagggaaggcacagccacagcttcccatcctctgagagccccagagggggcaggcttcaggatgggtctgcagctgtgctctgggcgagcacgtgccctcgtccagtctcccttcctgggcagcccaggccagagctcccctggggtcgagctgggcgactggtgcgcggtgtggctgtcgcccttttgtgctggcctcagggtcaacgcgcactctctcttctgcttccctgtttccagctggcttcttcacccgaaagcccatcctcgtcttatcaaatctgatcctctccccagccacaagctcccacctaacctacagcccacctccaggtacagaggccaccctctctgtttccgtcttcctgccctgattgcagcttcctctcctacctggagtccagcatccatattttcatcttttagaacagaggacacccatcaaaggcagcaaaccactgactctggaaatctgtgattagagatggccagctccatctcagggatggcgagggccgccaagacaaggaacagccgtgggacagaccctcgcagcagccacgccgcctttcagaagggttcagggcttatgacaaacatctggcagcacccactcctgctggaagcccagacagtcagtgaccagatggttttgccatggccggcagtgctgataacagacggtcaggagatggatttctgtggtgtggctgttctccaaggggcaggaactaactgggaggaaaggcggggtgtcggcacaggcaccctctccaggcctgcgtgcagggggcaaggacagtgaagctactgacacttatgtctctgctcaaatcctaaacgcctccctctgctgacgtcggaacccacaccccgcgcagtgggcttctgtcccccgggcagtgccatgtgccaggcatgtctgctgtgctgtgggaggagacggtgctgttccctggccgatgcccactggaccccacagaggaactgtgctgtggggtgtggttcccacagacccttcatcgggaaagttgagaacttacaataggaagtgcagtttggtgcaagcttttcccttcctgccagcctcctgtgctatcagaacacagccccagacacaaagcccattacaaagtgaccagcacaggcaccagccaccactgcttctcctcccgtctgggcctcactccagccctagtggcctccgtctgggccgcagctcacagcatggcagtgacccttcctccaacacccccacctctgaaaatgtccatgtttctagtcgaagctccgttctctaccacgtgccaggccccacacctgccttaacgcctcccctccgttctctaccatgtgccaggccccacacctgccttaacgcctcccctccgttctctaccatgtgccaggccccacacctgccctaacgcttcccagatcgtggcatgcgtgcatggctgcaggtccctgctctcctggcatctgcaaccgtgccctgcccacctccccatcccccaccggttccttgccaggcaagaaccaaagccacctagcacagcacccccatccgcggccatggctgctgtccaggcatcacgcccacacctgccaccaggcccagcatcttgctccctcctcatcctggcaccagctgaccccatccttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgggagaagcaaactcaggcctggaggctgagtccgtgtggggaatgtggcctgtgctgctgctcctgtggactcacgagccgtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggctgtgtcagaggtgacagtgacagtggccttccattctctgcacccactgcactcacgggactccctctgcaactctgccagggtggcttcatcaccacctttggaggaggccgaggctccggctggaaaggtgcccagtctgggggggcccttctcaagggatctttgtgttttactgaagttcacggggtgcccccagccctacttggcatgcgtgttttctttgtagttagttttctttgtagttattgggatgccacgtcaagttggtcatttcaggtaaaaggtggcgtaaacactggagctgcagagaaaggaaggtgcttcatgaacactctgcagcggggtgtgcttcaaggggaggaagaacttagattataatgcttttgttgttgttgtttgagacagagtctcactctgtcgcccaggctggagtgcagtggtgcagtctgggatcactgaagcctcaccttccctgggctcaagccatcctcccacctcagcctcctgaggagctgggactatgggtgtgcgctgccacgcccggctaatttttataatttttgtagagacagggtttctccatgttgcccaggctggtctcaaactcctgggctcagcaatctgcctgccttggcctcccaaagcgctgggattacaggcgtgagccaccacacccagacaatattataattttactcttaaaaatctttatgaaagatgtaaatatgtaaatattgagatgtttagactattcaagctgtcaaagacaaaaactacccagaaacccagtactgtgccaaatgttgagaaaatctgtaattccaaacagtagcttctgatgatgtttgttattttaaaaattacaatttagtcctgggtacgaatgggagtatttcagcctttcttgagaagttcatcgaacttctagggcaggttcatgtttacagctgtgtcttcacgggggggtttgagaagttgagtcatcctcatttgattataagaaaatgtggtccatatacaccgtggaatactatgcaaccataaaaagaatgaaatcatgtcttttgcagcaacatgggtgcagctggaggccatgatcctaagcaagctaatgcagaaacagaaaaccaaatgccacatgttctcacttatgagtgggaggtaagcactgggtacccatggacacaaagatgggaatgacagacactggggacccccagagggagggggtaggaaggggagagggaaggagtgaaaaaaaaccaccccttggctactatgctcactgcctggagacggatccattcttactccaaacctcagcatcatgcaatacacccaggaagcaaacctgcacacgtacccccgattctaaaataaatttgaaaaaaagaagaatgcgagcatttcccattggtcacaggcccttcccacggcagcgtccagcacccaggttcccagccagggctgggcggggctggcattgtgtaggtaaatgctgcagtggtttacttggcatctgactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacaggatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcagtgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaagataaaagtttttttttaaaacctcccccaccccctaaagagatcattattgttacgacatagaaaaacctagccttgcagctgaggctgcaccgtgcaggcagagaccgtcgaggaacccacagcagaattggccatgggtgaaggctgagtctgcaccgtgcaggcagagaccgtcgaggaacccacagcagaagtggcccacggaggaggagcactgagccgcctcctatggcagcgacacagaagccaggcctggaaggcagagcgggagagcagagagacatgctccacgccgcaggcccagctcaccctccgactgaggcaggagtgctggagctctcggcggccggtggggacaaggaggaccccggcaggcgcgggcagggccggggcaactgggcaggaccccagggaactttggatacgggcagaggaaggtcttccagtcggggaaggcgggaggtgttaagatgcaagcacttggcagttagcgggctatgaggatcttttctatctcgaagccgtgcgtctttcacctgttgttcgactggtatgctctgtggctcacaagatacaagtttttttttttaaacctcccccaccccctaaataaattattattgcaatttaaaaacctagccttgcaaaacagcttttgaagaacaagggaaataattgctcaaagcccacttgctctacaaacaggtgatttcagagacctttgaaaagagccccagctgctgaacttaacctggggccccgcgaatgaaccaggctccgcccctgacgcccgagacaccgcgcacaagaaggcagtgctggatctcccgcagggccctgaagcagctctctggtgcactgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagctcccggcgtggctgcagtgggccggttgcggggaagaaaagggccggtgtcgtaattgactggacaggtactaatgccgaccacatccaaatatggatgatgacgagcgtggtgttgcccacagtccaggcctgtccaggcgccattccccgtggcctgcacgctcctgggtcatgctccgctcaggcggctccttcagtgaagttgcacagcagtcagggtaacctccatgtccccaaagggcaagaccggctcagaggcgaggtaggtggcacgaggccacacagctggtcagctcagccgggctgggacgcgggccccagaccgtggcccccgtgcagctctgggtccagctggccaaggtggactttgcacaaggtttgggaggctaaagggagccgaggcaggtggcagctgctgtgctgggaaggctgcgtgcgcggggcatcctctcttggcccgggtgggcggacgcaggggtccctggaggacgggactggcatgtctcctgcatcccgcggtgtccttgctttgtgtccaggtccctcctgacccccgcccatccaccctactggctcagagacgtggaggcagtggtcccttccccagctccccacgctaccccccaacccttgctgcacagcagaaggccctgctcagaaaatccctgatttcacgggactcctagtggctctgcctcccggatggagccctgcctgcgtggctgctctgtggctaacaaacagcgtgctcctggtttccctgccacggtacgcccctccagccacgtcaggccattgctcaactggaggagtgacatcgctccttaactttcatacctaggtttatgtcatactttccaagttacacaagtcacatcaaataattccgacgtttcaagaaaaaggcaagtgactctattattcctcgtttctcttgggtctgaaaaatcatgtcctgtgaagcccttcagacctgcctggggttcgagtccctggatctgccgctccccccttccctctcctgggagcatcggtgcctgggcgccgtgggcgcaggcggtcggcattgttacttaggtccgagctaagttacgtctcctctgcccaaatcctgtcaatgcagcaccgtgtccaccatgcgccaagggagcctgctgggctgagatgcacctgtttaggcagcatcggggagcgatgttcctgaggagctgggaggccctgcttcctggatggactggctcctgcgggaactccggcaggtgggagaacccgaggtggacagaggtctgctagtgtcagccgcttggcccaggagcctggcgtgtccagtgtcagctccttgtaagcccatcagggccgcttcattaaagttgaatttaaagccagactttaaagaatgaactgctgtcttttcaaaggcctccttcaaatggaagacggacacgtgtgactcagacatgtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggtcgcctgggcagcgattataatggaagttctttgtgttatatctttcaaaatgtgccagtccatgtggggtgctggtgctttggggcaccagcccctgcccctctcttggggaggagctggatggaacacaagtccagcactcacagaggctcatcctgagttgtctgcccagggaacatcagtgagaaccatagtgtaggaagagaccgggcgggcaaagtgggaccatccagcagcccctacctgtcagggggacccaccccttccttccagccttccctgttcacagagggtgctgcaggccgccagggtgctgtccccccaacgccatatcggcattcagaacagatgccatactctgctctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcctaaaggctcatgacgcaaataaaaccacaagtcctgccctcgagagatcattatctgggcccagagcagctgctccacagaagtgcgaaggagaatgagcagagccagtccttcctgtcctctccctgtcctccctcccatcctccccacctcccacatcttccctgtgctccccgagtcttctccatgcccctcagccctcttctggccagatccagcctcaccccatcaccattgctattcagcggtcacagtctccactgacacctgctggggtacttgccttttaacaaggcatccaaaataagaaaaaacttttcagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattaattgaataccctttatttccttctcctgcctaattgccctggccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaatcaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgcctcatatctacaactatctgatctttgacaaacctgagaaaaacaagcaatggggaaaggattccctatttaatgaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacgccaaaagcaatggcaacagaagacaaaattgaccaatgggatctaattaaactaaagagcttctgcacagcaaaagaaaccgccatcagagtgaacaggcaacctacagaatgggagaaaatttttgcaacctactcatctgacaaagggctaatatccagaatctacaatgaactcaaacaaatttacaagaaaaaaaccccatcaaaaagtgggcgaagaacatgaacagacacttctcaaaagaagacatttatgcagccaaaaaacacatgaaaaaaggctcatcatcactggccatcagagaaatgcaaatcaaaaccacaatgagataccatctcacaccagttagaatggcaatcattaaaaagtcaggaaacaacaggtgctggagagggtgtggagaaataggaacacttttacactgttggtgggactgcaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcagcattattcacgatagcaaagatttggaaccaacccaaatgtccaacaataatagactggattaagaaaatgtggcacatatacaccatggaatactatgcagccataaaaaatgatgagttcatgtcctttgtagggacatggatgaaattggaaatcatcattctcagtaaactatcgcaaaaacaaaaaaccgaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataataaaaaaaaaagagaaaaaagaaaaaacttttcagagccaaaggagagaggtgggagcatggtggccccaggcaccgcatgcagggaggggtatcagggccccccttgggaagtgtgtccctgcgtgtccaaggccctgcagccacaatccagccccgcccctgaaaagcatgttaggcccaggtgctggtgccggaggctaaccctccatcagagcccacagccgcccactcacggtcggtcacagggctaaccctccatcagagcccacagccgcccactcacagtcggtcacagggctaaccctccatcagagcccacggccgcccactcatggtcacagagctaaccatcagagcccacggccgcccactcatggtcggtcacagggttaaccctccatcagagcccatggctgcccactcacaggcacagagtccatcccaggccacagtgggaaggagagggagatgccctgaggtgtccagtccaactcaaatttccagccacatacaccatgacctctggcgtgatgtgccctcctcatttttctctcccttcccttttccaacaaaagctcagccctggtgatgacagcacagactccagctctccagaggcccaagacagcctgccccagtcactgtggccatggggcggccttcgctctgaggcacaggttggcggtggccctgagccaggctggtgtggcctcgagtcccttctcctagccccaaaccccacggcacagttggggatcctctcggctgggtccccaggggagctgcacactgagcctccacctccttttcagagttgggagcagctgcccccctggccatgggggaaggccacgcccctaacctgactgcagattaaattcttctggaaatcttagcctgcctcactgcttggtttcctcttcattcggaattaattcctcccttggatgctgagggctggtggctggtcctctcttcgcagtgcagtcacttgctggagtctcctgagggcaggagagccccggcagtggtaggaggaggctgcaccgggcagggttaggggctgctgggcctctgctgtgtggccactgccccatgtggctgccccatcccccagagcaccacggtgcccaccttttgttttcagagaagcaacaacacctcatattcagtctaacctgtgaccattttccaaacactctcatgttcgtttgatcttcatgatgtccgtgaacacagggaagctttagtcgcagccacatgagtggagcatgtggaggctaggagaggccatgcacgcaccctctaggatggccgtaactaaacacacacacacaacaaaaacgtgctggcgagaatgctgaggaatcgtaactggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggctacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttagaagcagatagtgatgatggttgcacagtattttgaatgtaaatactaccactaaattgtacatttaaaggttaaaaatcacaaatgttatatattttaccacaataaaaaattaaaaaataaaagagtgagagactgcgtgcctggcatacagcaggggacaggagccgattgtctgtcctacagctgggaaatgatccatcctgccattcatccatccatccatcaagcactcatccatccttccatccttcatccacccatccatctacccatccatccatccattgatccatccatatccatccatccatatccatccatccacccacccacccatccatctacccatccactttcatccatccaaccatccatcattcttccatccatccatccatcatgcactcatccatccctccatccttcctccatcatccatgcatccatacctccatccatccaaccacccatccttcccccatccatccactcactccccatccatccttcatccatccatccatccttcttttatccatccaaccatccatccatcattcctccatgcatccatccttcacccatccatccatccttctttcatccacccacccacctgtcattcatcatccattcttcctccattcatccacccatccaaccatccatccatctttccttcatccatccctccatcatccatccacccatccatcatcctttcacccatccatcatccactcttcttccatctatccaccatccctcatccgtacaacccatccatcatccattcttcctccatctgtccacccttcacccatccatccatccttctttcatccacccacacacccacccatccatccatccttcctccatccattcacccacccatccatcatccatcatccatttttcctccatccacccatccactcatccatccatccatcattgctccatccatccacccacctacccatccatcatccattcttcctccatccgtccacccttcacccatccatccatccttctttcatccacccacatacccatccacccatccatcatccattcttcatccattcacccttcacccatccatccatccttctttcatccacccaaactcccactcatccatccatccttcctccatccattcactcacccatccatcatccattcttcctccatccatccactcatccactcatccatccatccatccatcattactccatccatccatccatccacccacccatccatccatcatccattcttcctccatccatccacccttcacccatccatccatccttctttcatccacccacacacccatccatccatccaaccatccatccttccttcatccacccatccatccaaccaaccattcatccttcctccatccatccatccatctatccgcccacccatccatcatccattcttcttccattcatccatccatcatccatctacttatccatcatccactcttcttccatccatccaccatcccccatctgtccaccaatccatccatccatccatccatccatccacccacacacccatccatccatccaaccatccatccttcctccatccatccatccttccatccattcacccacacatccatcatccattcttcttacatccatccacccatccatccttccttcatccatccatccatcatccatctacccatccatcatccactcttcttccatccaaccaccatccctcatctgtcaaccaaaccatccatccatccatccatgcatccatccttctttcctccatccatctatccacccatccttcctccatccatccattgatccacccataaacaaacactttcactgaagagacacgggaggaatcagaaaaagctattctcagagcttctatcctagagaattgctggcacttgcagagtgtgtttggatgacttgggtgttcctcacaaatgcctgtgctgcgggtcctattcttttccccagtttatggaggagacactaaggtacccagaactgcaagaacttgctcaatgctccatagcatttggctgagacaccatttcttggaggacaggacattgaaatctcagaggctgggtgagacacagggccactttgcaggtggctctcgaaacacgtccccttggctacctccgttggggccttcaccctctacttgtagttgatggcaccagaaatggtcttttctgggcttatgtctctgtcttcctggccagctctcagcactggctcttgccgggtgggtggaatcctgtctgatgacccagctgggagtggcttgtccccctctggacactgccagccctcctcctggcaccacctagcaccatacaatagtcactccaggggctgccattgccacagctccccctgcagggtaggggccaggccttggcacgtcttgattcaaatcctggcacttgcagtgtagatgaggagctctgggcaaggtactgagcttccctggctgcagggaggttgacatgaagtagccaggctgtgctgggcacacagcactccacgtccatcatccatctgtggcttatgaacgccttgtaccagatttatccttggaccctaccaatttaaggggaccacggaagcttctgaacaagaaggaggggtttccctgttcctcctggcatcttggttttacaatgagactgactgccatgttatctgtgttcttaggataacccaatctttctctctccttctaccttgataatgatgcctgacactttgtacggtgtttgcctttgcgtacaaatggctgggaagtcctcacagtcacaccctgcagtaagaatgctcacgaatacagcagtaagaatgctcctgctctcccaggaaacactgcattggggaagtgagtgcccatgggtgcaagtcagcaactggccagggcgaccgctctttcactgccaggccagtctgccttccgtggtcacaggcgaacactgttctgtttggtgctgtgcctctgcagtgtggtgagaactgtctatactcctgctcctcttagaaacgctgtgtgtgtgtggaggcggtgggaaccagtggtcctggcaaggcctgccaggctcagacctggagcagagccaggccccagctgaagcagaaacttccagctctgtgctccttgctattttttgtttgtttgttttgttattgtttttaaactcaaaaggcaggtaggacttaggaggcaagaaagcccgcttgagggacattaaggacatgaaggcacagtcatgggacgcttccatacacgattcctgcttattgctgacaccgagcggtaaaaagagaattgccactgtgagtcacacactctgcagtgtggcgactaatattgatcttccaaacggtaaaaacaagaacaaactggaaagacaaactctacttcagattgcaactacttaagcatctttgtttaacaaaatcaataaaaaaagatttcactaacaagactgcaacctatatttgtggctatgaattccccagattgctggaatatcaaatccagagcacaggagatgcagagagagtgaggcccagcaagcctgttttacagtcaacggatcgtcctctgctcctccgagcagctcatctgcgttcggctgtgcgatctgagtgtgttcactgaagcacagcacacgggcagaaccgcacgctacatcctcaggctttgctttggggccaagaagcgacccccctacagtgacagagtgtggctccgggccggacgccccacgctggcctcccgttcccatatcccggccatgagagcacgcggccgcaacacttgtcttcaaggagccatgatggggatgacgtgaggctccccagctcctggagaggccaagggggctgcgacgccccagcccagccccagctccaccccagatgtttctgttcagaaacaaaatcagttacaaaaaaacctaaacacatcaccccacaagaaaagtcatttggaaaaatcatttggaaatcacactgatttccttaaaatataaaaaacattgatttatctcgatctcatccattctgcttaggggagcagtttctgctttaattgtagtgtctttctttagaaaataaggacaagtgattggggtgttttggcacccacagtgccatggcacctatggaggctttaaagaacaaacatgccctcggaagaagttactcggcgaagtcgacacacacatctctgagtcagacatttcctcacattgtcccctcatttgtcaacacataattactgtcaccgctgtgtgctgacgctggcatcaggttgcacgtgccagtcagcataaaaatatggccgtaatgttggcataatttttcatgatcatcttcattaaccacagcgaacgggaggagcgtttgcctgcacccagccatcgtcatgacaacgcctccaccgcggccagcccagtgtccaccgagggcagcggttgaatgtcctcattattccgccccccacacgctttgcccgtgccaagcaaggaccaacacatgccggtgatttatccccaggccactcccgacggcatccaggcttaaggcgctggtctgatttcacagtttaattactgctaatctgagaggccacagctaatgagctgccggcaaccagctcgccctgctggaattccacaccccttccctggatgactcccctcattgtcgggggggcagttaaggaaggtgtattgacttctaggtgtgacaggttgactaagcacctatggaaacatcacagcaatgtcaacaggcaaatggaacacagataggattttggaattcagccaccacaactccactgaagacagtatgggttgctgatacaccccagaccttctgcaggccttgggtagaagatgttgggcttggctttagccacgccacgggctcccttggtcctgcataaaacacacccacacatcttcaccaggatttgtaacagcacagcagacatgtcaccagcccctccacacggaactctcttccgcagctccctgtggctcagcgcgttcctgcctcccactccaccacagctccctcccagacctgcaggcttcacatctaaaacactatcccaggcgctcctcacctggattccctgggggctgccatgggcccctccctgccacccgcccctttgcacactttattcttcccaagacccggcagatggcctgaaagcacatgtggggctgtggcctctggtgcaggcatcatggcttactgggctttaggatacacaccccgacctcggctaccgcatccacgcttggccccagcagcccgtccggcctggggttctctgtggcttccttggtctccgagcctccccagcactttcacttcccgctgccaccggccccggtgaatgctgcttctgcttctagaacactgctctgcaatttagagatgaaattctggcacccttaattctatttgtttaatccagtgaatttaatttcaggaacatattggaaccatgcttagcttcagagcagagtttatgtagatagaatatgactggaggtttctgctggtttaagtgtgtcagtcacagaatgcatgatgtcagtataacaactacccttgcttaatgataacgctaattaaatattcttagcagcatcatgtggagaaactggattttcaattaagcactttctgaggtgagggtctcagcaggtcccacctctttacgttaaaccggaggctttctgctgttgtcaggccctgtgcacccagagaatgtaggaattatgaatgcgtgaagctaatttcttttcattttcattcaatggtatgtgagcttttccaaatacatgatcctactctctcctttggggagaaatctttgttaaaaattagcgctataggggagcttattttgcccaatgacagagcagatctgaaaaaagcatcaaatcttccttcgtatcctctaatacatccctccagctcgggtagacggacatcctcgggaagagcgttcagccagctccagacacagcaaggtcatgaggcgcctgcattcagattcattgctgggtgtgctgaagagggccacacattctctgacgcacttgcccccgaggtgagacctctgtcctccccacctgagtgtgggggctgtgggcccgcttggccagttgaggcagcagaatgcacctgcccccgaggtgagacctctgtcctccccacctgagtgcgggggctgtgggcccgcttggccggttgaggcagcagaagtaacgccctgccagtttctggcttctgggctcagactcgagagactggcagctcccatttcctctcttgggacacttgttcttgggaaactcgctgccattctgtgaggaagcccaagcagccttgtggaggctccacatgcagaggcccagagctcccagccacagccctggctgagctccacaactgccaccacaatgtgccagctatgtagacaagccctctttggggcgagccctccagcccccttggaccactccagctgatgccagtggagcagaaacaagacttccctgtcatgcctgaccagattatagagctgagagcaaaacagggctctccaatttgggataatttgctatgcagatatagattcctggggtacctgcccccccattccctgtctccatctctgatataaaactaatcccacctgctgccagttcatgcccttctgtggcttgcagcagctgacactgacacctctttgccaactcaatttaacagccacccaccatgtcacgggtgcagagtgctggatctgggactccacagagcagtgagacacagcccctgccctcagggagcttacaactgagtggaggagaaagacacacacggcacagggaaaatgtgctggcaaagcagtgcaaagggcagtgcacacacacagtcagagacacacaaacacacagacacacatgcagacacacaaacacacagacacacacgaacacacacagacgcacaaacagacgcagatacagacacaaacagacacacatgcagacacagacacacactcacagacacagacacaaacacacagacacagacacagaaacacacagacacaagacacaaacagacacacacggagacacaggcacacatgaacacacacagacacagacacaaacacacacagacaaacacacagagacacacacagacacatacaaagacacacatacagacagacacacacacatacacacggacacacatgaacacacacagatacatacacagacacacgcacacacagatgcacagacacccacacatagaaatacacacagatacacacacagaacacagacacaaacacacacatggatacacacacacagacatacacatacacagacagacacacacacagacacaaacacacacacaggcacagacatacacagacacagacacacatacatacacagagacacacatagacacagacacacacacatacacacagacacagacgcacacagacacccatacagacatacacagacacacaaacacacagacatacagacacacatagacacagacacacacatacacacagacatacacacacacacatacacacagacacagacacacacagatacacagacacaaacagagacacacatagacacaaacacagtttgtgagagccctggcccgcagaccatggtggctgcagtgtgagcccagcagagtcctgctcagtgctgcccagagacctggggcaggaagtggaaagaggcccctgatccaggtgcagctcctgctcccggaaccgcctgtgaacgactgtgacctgggcgaatcctgctgcgggcggcctcagctccacactctctctaggatgaatcaggtggagctggcacccagggcgaccccagaggacacacgaggctctcggcattgggtctcagcgttgggtctcttggccgggtctggggggacccctgtggggggtgggagaacatctttttgaacaaacacgtaaacacattgagtctttggtcgcttttgcatcttctttcttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactgggtactggcggggtcttcctgggccgcctgctcccctgtaaatgggcagtgatacaaccagcttcccagaactcccagaactggatccaggcctgggtgagaaggtgccttgcacagatgtccacacatcatcctcagtgctgggaccatcaagatgctacagtttccaaccagcagctcatcgcgaggacctcgttctaggcactcgcagcagacggaggcaggggtcctccacctccgcttttctgacccctctctcttcaggacaagcctccttggtcatgctccggctggcctttagctgaggtttagctctacgcggacattagaagcacaaaccaagcacagccccttctgtgagtgggagtcatgcctagaaaacaaacaggagagaggcggctcccaacctccaggagatgaaaacctgttcttacaatgcgtgggactcttaccctgacgagctctgcagtccccacagacgcctttgctcaagcccacctgcctcttcccagcaccacccgtgtcttcatctggggagaagagcccgtgctcagttttctccatcagcccgctgcgagggccaggggcccctatgcactcaacatcagcttcacaaagatgtagtgggctgtggggccaggcggcttgctgtacctcccacccaagcccagggccctctcacccagactttggcccagtgcctccctctgtctgtgttgcctctgttccttggagctgtatcttcctcagcctcaatttctctgcccattggtgtctttgttcccgaacctcagcccccaggtcctggttggtggggcttgtgtccgcctcatccagttctggactctttgtgatgatggtaacaataactggactgatccaagttgaagtcagttggtgaatgaatcaataaactccaactgagagctctacacagcacatcctaagtgtcatacagagcactaagtaatttgctttttcatttatacctcacttcattccagaaagatgcatacaagttagcaaagtaaacacatatttaaaaagaggtgacaaaaagaaaacatagggaaaacaagaatgggaaataagttggagcctagaatgaggttagtatgcaaaacccatgacacggacctacttactaggagctggctacggatggggctgtgagctccctagctgccacggggaagagaggaacaggatccacaatgtctatatgacaaaaacagacaatctattttttgaaaatcatagctattcttaaattaaaaaagaaatgttccaggagtcctcacagagatgcgctgaatagaatatgcaccatcctccatgatgtctttatacaacagggcaagggaatgcctagggttgctggcctcaggccaagtaaaaatggctatgcaggagcccagcatggcctgggcatcatgcctgtcaagcctggtgaatcctagggtgggcctgcgagggtttagaagggataaaccacgtcaatattattcttcccaaccaagatttcactggaagttgagctgcagtgagtttaagaaaatggtaagccccccatctctgcacgcagttcataatctaggttgtgagaccacacaccggctcatgtgcacaagacagtgtgcgtggagggtgacagtgtcggcaaaagtgggctcagggctcagagctgtaactgcggttaaggggttaggaagctggccttgggctggatccaggaccccagagtgactcagcctcatggtacagcagagggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttcttctgctacttacatgccagagtctctgaaagttcttgatgagaacagtgacacaatgaaagcaaagtcagggaagatgagaaggtggccttgcatcctaactgctgtcagcagagtctgagggcctgaaaacgtccacatgccagggagtccctcagtcctcaggaaggagaaacgtttcatgaaaacgcgaacagtctcggaacgcctcactccgtcacggcagtgtaggctcagatgtgacttgggaagatggcgccactctgcaggacgccgtgtgtggcaaccactcgctctcacccttcgggtctgcggcagctactgtcatatgagctgctctttagagggacagaaatccacaggaccccagtttccacccaaattcatgagccgcagtggccaggctacctcacctcaccctgctgggtctgggcagtccctattctcccataggcataacggggacagtgaaggtgcaaccagcatggacagggccgagggatggaaggaaaacaaacccttgcagttcaacccacagggcggaggcggcagcgtgagaagcttcctgaatacaggactcgatgcctcgaggagaggagcgtggagcacgcccggggcacatggggacacagcagcgctgggaaggcttcgtcctcgggagccggcgctcacatgcagggagtcgcccaggacagcaagcctgggtgtggggctgaggcgggcgcagcctcggggcagtccccacacaagggcaggacggagcctggacggaagctccacgccctggggtacctgctggggcatccagggtttcctgccccaggcccgggtcatggtgtcccccgcaggcctgcaggctgggttcctcacagggcatctgctcaccaagtaagcctggcgtggccagaactgtgtttcttgagttgtttgagccgtttctgttcatgacctacagtaacgccgctgtctctgtgatgctatagggatggtcagtgaggagaccgccgcaaaatgcagactcagaggtgtgcataggtgggctgggcccggggggatagccgcagccagctgtgtactcggaggtgggcaaggagtgaggcggagggggcgtcacctcctccctctcctcctcctcttcctccctcttctcttcctccctcctctccacctcctctctcctctcctttttcacctcctccctctcctcctccctcctctcctttttcacctcctccctgtcctccttctccctctccttcacttcctccctctcctcctccatctcctcctcctccttctcatcttcctccctcctctccctctcctcctccctcctcttcctcttcacctcctccctgtcctccttctccctctcctcttcctccctctcctcctcctccatctcctcctcctccttctcctcttcctccctcctctctcttcttcctcactctcctcctcctccatctcctcctcctcctcctcttcctccctcctctgtctctcctcttcctcactctcctcctcctccctctccttctccctctcctcctccctctccttctccctctcctcctccctctccttctccctctcctctctctccttctccctctcctcctctctctccttctccctctcctcctccctcttcttctccctctcctcctctctcctcctccctacctctccactcccctcctctggtgctgtggctttccctcttttcctcctctcttcctccctcctctgctcctccctcctcctgcctccctctcctccgcctccctctcctcctccctctcctcatgctctctcctccctctcctcctacctttcctcctcctcttcctccctctcctcctccctttcctcctccacttcctcctccctctcctccctctcttcctcctccctctcctcctcctccctctcctcctcctccctctcctcctccatctcctcctccttctccccctcctcctcgctcttctcctcgtccttcctctcctcttcctcttccctctcctcctcctccatcttctccttctcctcctccctctcctcctcttccctctcctcctcttccctctcctcctcctccctacctctccactcccctcctctggtgctgtggctttccctcttttcctcctctcttcctttccctcattttctttctccgcttttcctgttctcttttcaacacttttatcctcagtatcattttctccacacacaattcaattttagagaatgcttgcatttttttcacattcaaacagatccacaaattcttgttagatacacaagaaacacatacaagtggaattggaaacacgcccatgtcggtcgctgagttacagaaggggccatgcactgtgacttcctgatgccagaggacacgcagtgccccacactgctaagctcagggacgcagccttcctgatgccggaggacacgcagtgccccacactgctaagctcagggatgcagccttcttgatgccggaggacacgcagtgccccacactgctaagctcagggacgcagccttcctgatgccggaggacacgcagtgccccacactgctaagctcagggatgcagcaaggctctggcagatcctgcctgtcatgtcctgtcccccggacactatgaaagggcagtcccgctgcatcagggacatgcatgctcctctcacacatgtggattcagagctagggccagaaggtgtgcttaggcacagcagtcattcctgggctgctgacataattcagcgaacttcacatcccagtgggaagggcaggctcgctcatttataatcagtctgcatgcaatgcctacagtaaaactttgaaatagaaatgaaaatttctttattgttatttactttaaaagcactgaaagatccaccagaataagatgtctgctgaaaagctagtttctttcaaccactgctgaggaaaatggtttaatccataatattgatgcataattgacttgtataacattaaaggacctttagaaaaatctttacaccacagcaaaaaaaaaaaaaaaaataccccaattcaaaccaaacgagagcaaaaaccaattcagacaggaaccactgaaggaattaaaagttacagaaccagagtctaaagtgagcacagcaaactccgcggtgacaccagagctccaagaacacacagactccctgttttcctccctggggacaggctaggaagtgaggaaggcaactgaccttctcaaaagccaacgctccgcctgcatggctcaggctgacgactaaacatgtccacgtgaatgcaggcgtcgaatgcccaagtacatgtgaatacaggtgtcgaatgcccacgtaaacatgtacatgtgaatacaggcatcaaatgcccacgtacatgtgattacagttgttgaatgcccacgtaaacatgtccacgtgaatacaggtgttgaatgcccacgtacatgtgaatacaggcatcaaatgcccacgtaaacatgtacacaggtgaatgaatacaggtgttgggtgcccatgtaaacatgtacacgtgaatacaggtatcgaatgcctatgtaaacatgtacatgtgaatacaggtgttggatgcccacatacatgtgcattcaggtgttgaatgtccacataaacatgtacatgtgaatacaggtatcgaatgcctatgtagacatgtacacatgaatacaggcactggatgcccacgtaaacatgtccatgtgaatacatgcactgaacgcccatgtaaacatgtccacctgaatacaggtgccgaatgcccacgtaaacatgtccacgtgaatacgggtgccgaatgcccacataaacatgtccacgtgaatacaggtgccgccgaatgcccacataaacatgtccacgtgaatacaggcgctgaatgcccacatatgcaacaagtcaatgtcttcctatgccactgctctctggacagaccacattctgaaaacaatgatgaagccacacagtgctcagctcaagtcccaggaacttcctgctttatgctggaaacgggccacagcgctcaagcagagctccgctcacagccaggtggccgtgttctctgaggggttgtgccggggtcttcagacagtgccctccctggggtcttgggaccctcaagcaaatgccacctagaagcaaaacctgacttaggtcaccaggtgcaggccttacatatagaggtagtagcgctacattgaggatgctggacacggcttatctcctggaggagggctgcctccttgccatgggagccccgccctggctgccaggcttccctgggcaaggtcagcaaggcatgtgctcggtggaggaggcctaactgttgctactcttggtgacctgaggtgaaaggtcacgtgctggtcgcttgtgctgagcaaggccttgcttctcatctgaccaaagaagaccgtgtttcctgggaccctgcaggctgccagaatgaccgcccacccgctgcccctcaccacacactgctgcactgtgctccacatcctgacaggcagcaggaacccccaaattccctcctcaggccagtgccctccacgttgtccccagcagggcgacggagggtgggggcggcaggctgtctccggtgcttgccttctctgtctaaataacttgcttctcaccctgctgcaggagtctccgaagcacaaaggctgaccctagactctggccaggacgagctggggtgaggggccccggccagaaggatgtcctgatgaggggtcctgagggtctggggaaggcgctgtggcctgaatgctcaccctatggctgggtcacccagggcaccccgaggtcatcagcctgaggaagagtgctgggtgatttcattctccctggttgctgaaaatgagcagtgtgtgtcctcccaagcagggctgggacgccactgataccatcgacgtacaacacgccgcaagcagccctcgaggaatggaaaactctcagactgctgtgtccacacgggttaataaaaatgctgaccccagttcccaaggtccacaatgtccatggagagtaggattttacacacttattgatgaactgctatgagtttttgatgatggcttggctagttgaattctgattcgatactttataattagggctcactagtgacgagcaaaagcccgtgaaactgtctttgtttatgatcccaccacgtatctctactattaaagaattagcctctgggccgtgtgtcctcctggtctacctccagcacaaggacgttcctcagagcaaggcatttgctcgctccccttgctccttacacacggccttcccactcccagctaacacctgaaataggatgggatagtgcacactctgaaggtgaagctttaggtgacgtcgaagcatccagccatatctgtcagtttatataaggggtggcggctgctcagcgaggcctcaggagtgtgaaggaggcttggctggcggaggggccgtgctgctggatcagatggcggaacacggcccagagcaactgaagttcgcttgtccccacaggcagctcgacatggtgcagaccgtggcagccaagtcaggcatacagcagccctcttgctggcttccagtactggctctgcacgccttcaccgtgagaggcccctggacaagggactgccttcctctgtgcctcagtttccctgtttgcacaatggggcttcacccatttcgcagggtggtcacgggtattccctatgttggaatgcatgatggggccacacccagcacggagagagcacttgacactgttgcttgcatgtgcccccgggccaaggtggacgagctctccaaactcgctttctctgcctcatccgtgatgagctgccccgcgggtccccacagatcaatcaggacagaatactcactaaccaaaggtcggtttcacttctctcctcagtgcacacctgaactctcaccacccccaccgaggcagtgggcagcccctgagccaggcagctccaggccaaaccttctctggcctcctgccgctcacggccacaatcaccccacatcctggtccactcacacccacgtcacccacatgcggctccttctagccatgctcactcccctctgcggaacaagacaagggctcccttcgcctggctgtggtagtgcttgcggtcctatggccagagcactgccctgccacagccctgaccccacagcaccaggccttttgatgaaaagtctgtccttcccaggtccacggctgcttttgatttgatatattacacatgggctagtgttattatcatctcctcaaagtggagggtctgctacattaccgcctggacatgtccggaccaaaacatattttcagaataacacacagttaaccctccctgtgccaagttgttgatgtcaagtctctttgaggacagtgcttacaacatgcgtgcccttcttctggtcccagcaaatgcagcaaacaccatcgaatcaggccagactcgaccactgcaatcaattcttctgggtctgctctcagacttcaaggtgagatgaatctgtactaagaaaacttccactttttcaatactatcccagagagcctggttttattgtcatgggttcccatctcatacaagttcgagtatgaagcgtgcagctgggagagctcctggatggtgcatggcggaagcttcctgactgaggacaagctgacccagcttcctcccaggttgctttcttgccctcagtcaaatcgttatttctgcatctttatcaagtcatctgacttcacagtacccaaaacgtatattacttcagcctcaataccctgccccagcctcccagccagctccaaatcacatcccactgctgtcgctgacttctgtggcaaaccacaccccactgactttggcagcagctgtcagccctttctgggctttcaggggtggatgtgaaatgcccacacagcagcttcaggcagatgcccatatgcctgagaagcttcctgcattttcagccaccactgtcctccaagcttgccacagacgggagtaggttcccaggtgcgggcacacaggtatggcctcgcctatgctatctctttcactgtccctagggaatagacctgggctggctttgccaaaggtgtgggtggatttgccctgatggcttacccaggcctcgcctgctctgcacaggaccgtagaccccatgctgaggggcggccacagaggtgtgcagtgcaaagccacagaccaaactgcaagtaatttgttcatgtaagaattcagctcatgagctcagccctggcacaggctccagtcaaccacgctaagtgggtctggactcaggcatccgagaattaatggggccccgggttgggatgcatgcagtgccaggcggaatcggttccagcaggcgtctgggagggccggtttggccccagtatctgaaaacggtgaatcagctctaagggtaggagctgcagcccgccctccacagagggggtccagggcttcttactgatcatccaggcatgggaagctgatcagggtcaacctatgaaatcacacatcccagttatgttgtctataatcttaacagaaacagcagaaataacctgagagagaggagccatctaaaaactcatacatgtataatataccaactgcccccaggggtccctgaaagaacgacgagtgtcggtactccaagaaattatttggaaaatgactacccaagagatgatcacacagcatcgcatcaacattcaggatttctttccagcacaaaaatgcccagtttggaaagaggaatcagaggaaaatggacaatgaaaataaaggctttgctctctttccttaaatagtagaggcgctgggatgacagaatgtgctggctgcttgactcggggagccttgagtgcactcggtgctggctggctaacatggtctgactgtgtccccacccaaatctcatcttgaattgtcccataatccccacatgttgggggagtgacctggtgggaggtaattgcatcacaggggtggataccccatgctgttctcatgatagtgaccgagttctcacaagatctgacggttttatcatgggcttttccccctttgctcggcacttctccttgctgccgccacgtgaagaagaacatgtttgcttccccttctgctgtgattgtaagtttcctgaggcctcctcagccctgcagaactgtgagtccattaaacctctttccttcataaattacccagtcttgggtgtgtctttattagcagcgtgagaacagacgaatacacctgccttggcggtgctgtgacacgtggcctgttactcacgttcccatctgaatatgtaatgcacaatggacactcccatgcacagcacaccgggagggtcctcaccacacagcctgggacatacgtccatccatacctaggaaggttcatcgaacgcatgtctgagcctgatgttcctcggcactgctggcccaagaggagctgacagcccacaatcctgaacattaccttgtgcttatttaatctagtatgaagtcatcttactaagaactccactaattctgagcatgcaggggccagcggagtccatactaaagttgaccgatcctggctataaaaagttctgcaaagaaaagtatggcagtaaacaagattccaggagccctcttgaaacagcagagaagacgccctggcaggaaggcctgtcccacctgtgggtcctggattcagcctcccgccccactcccacttactcggaacagggactttcccatgtggattcgtatgaccctacttttgagtgatttcctccggaggctgttcacatttcatctttgctccaggccctctgaggcttgaacactgccctgttttcattcaagaagaaaagtgaaaccaggaaggcaggtgtctttccagagggctgggaggctggttgaatggaggatattccatctcttactctttcaagcagagcgcagctgctgtcccacaggagtaaattcaggatgagtggctgaaacatttcccacatggttggagtttaagtctctcaaggtagagacactcatggtgtaagtgcagaggaggagaaggaagctgggatgggtgtgtttagttctgcttccagggactattcctaaattctgcttgtgggcagggcacaggcagctcaacgttaggccagggaccaatcttaccacgtggcttctggcccagagcagctcgtgagtcagcctggcctagttggaaaggcaccaactaggtctcaggaggccaagtggggggcctgcccccacctctggggtctcagcatctgcacagtgacggattaggggggcggttcagcagcccctcgaaccttcacccggggctcgtttgctgcttcacactggaggaggtgctcctagcaagatgccgacctgcagcagcgcccacaaggctcagggctgggtccagcctcacctgcaaaagctgtggctgcgggaaccttcctgccctgcaggaaccacctcagcctcagcctcagcgctggagagaaagccctatcccgctcggcctgaccctcctctccacaaagggcttgaagagcaactgacccatgaaacgggcaggggctgggctgatcccatatgaaacgggcaggggctgggctgatcccgtatgaaacgggcaggggctgggctgatcccgtatgaaacgggcaggggctgagctgatcccgtggcagtgcaaaccgagggccccctgggtctcgacatttcaccgcaaaccctgaccccacacccggcctctctgcagctaatggaaggaaatgaacccatcgtgtggggcgacataggggcccagggggcctggacaagtaataaggtcaagatatttttggacttgttcaaatgggtgggcagctgtttctctgaggaaacgcgcccctccccagtggccaggtgagcagtggggctggagaggagagcagagggagccgaggccctctgtccaggcggctgaggtcacgcggtctcttcagtttccatttttccacttgtaacggctgttacagccgctgtttcatcgcgtcgtcataggagttgaacaaagctgtgtgtgtgtttccagaatgttggcacagcggcgagaaggctgaccgaacaccgagaagcagccagcacaggctctccacaggggctctggcatggagcaggataacccgggcccacgtggggacacgccccgccccacaggcttgcaccggggtgcggcctgccctgtctggggcgccaaggccagtggtgtaaatccacactctatggtgacggtggatccacagctgccgcgggtccccccaaccccaaagccactgagtgaaaacagaccacggtgctccaaaacgaaatcgcccccgaggatgaaagggggtggtggaaaaggccttggagcctggggcagggctcagaggggccccaggccggccccactcccagactagagccagcactcgcgggcaggcctccccaggaccagagcgcctgcgacctgcctgggtgccatccgcaaacctggtctctgctgaaatctgaacagtctacactggacagacatggagggaagcttctcccaggaccagggtccctgctttctgcagacggtgggcagagggcagagacggagaccgtgggcacagcacaccaagggggagcctgctcagagatgggcatggggccggcctgggaagcatggcgggaggggagaagaatcgcgatcctttccaggtacacagtctagcagctgccacgcccggctgggagctgagacgcgcagggggcccagctgaagcctgcgttttcccttctgcacaacagcggaggttttcctggagttcataatcactggttttttttgtgtgcgtgttcaccagcctgctcacctgggtagcagggtgggagggccgggtggggatggctgcagggaccccctgggccggctctgggtgctgctgctcccaggagagatggtcccgtgcaagtgccaggcccctgctgtttggcctcctctgccccctgtggggcacgagcgttagccgcactccgagtgcgcgccaagggcttcagctggctgagcgcttttgctgtggggtggatcccaggccctcgggccagccctgcgtggggttctccctgctcacacaaaccacacggggaacggcacaggtaatattaaccaggactagcacctagggccccacaggtaccgttcacgtatcctggctttagtcttgctggttttctcaccagcatttagtgctagttcagtatttatttaaatcaacatgttttgaaaaactgcctaagtatctgaattgttataaagtttaaggaccatgaagtctaagaaggaagattatttattgtacttctgggaaaagcccccagaggtgggctcatttgctgtgatcttcgtcccattcacaaagcactcctgggcactgtcccagctgtggatggcactggaaactgggcttgtccacagcgtgagtcccttgaggctggaagcacagagtggctgtccccaggtagttggtgacggggtgaggaccgggctcgctcccactctcaggagcctcactatggtccccagagatagaggacggtgaggcgctgccggtgagggccacaccaggccacatccgtgcagaaagcaccctctcattgcaatgtgtttggaaacatgaattcatgtggcagcggtaacatttagaagagaaacagccacatttaaaaacgcgtaagactcacagaacctcagcctgctgtggtttcatcatcaggtgggtggcacattccagcggctttggccttgcctgcccagtgcccagagctcagtgcccactgtgggaagtgcagggagcagctctggcacatcccacagtgctgtctgcaccaccgcacacagagtgccagtgtcagctgtaggtcccatggcctgaggaagccactgagcctgggacagcttgaggggcaggaggcggacacaggtgcggcgggggacgcgggggtggctgcccgggaggcggacgcgggtgcggcgggggacgcgggggtggctgcccgggaggcggacgcgggtgcggcgggggacgcgggggtggctgcccgggaggcggacgcgggtgcggcgggggacgcgggggtggctgcccgggactggctcttctggaagcaattcgtgggaaacccacttggatgccacttatgacccccgcgtgccagtggatgcccacaacccctctggggtgtcggggatcaggtgagcaagggggctcatccgtggcctccaggccccaccttgatggaaactgcgacaggagggggtctggcctctgctgggagtgacatctgaagatgccatagaaagtctggcgcagcagccggtgggcctggggggcgcgtggactcccagctgttgctgtgcctgggtcaccccagtgggcagggcgggcagggggcttccccacagtctagggggccaggagagcccctgggcctcacgtcctgcttctctccttgtccttcatgtcttgtaggcgaccccacagagagagaggcagaggagagtggccgtgacctggaggacaaggacatgcatttcacactgaccggggcctccctgggacaccctgaacacctgctctgtgggagacggggtggtgtttgagctggtgccatctgggtcccctggggtggtggctgggtgagcccagccccatctttccctcggacttcatttgtgctcatggctgggggaggcacctgggggccccgtccaagctgccaagggctggggtgggctgttcccctcttggcatctccctcacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcatgcctgtaatcccagcactttgggaggctgaggcgggcggatcacgaggtcaggagatcgagatcatcccggctaacatggtgaaactccgtctctactaaaagtacaaaaaagtagccaggtgtggtagcatgagcctgtagtcccagctactggggaggctgaggcaggagattcacttgaacctgggaggcggaggttgcagtgagctgagattgcaccactgcactccagcctgggaaacagaatgagactccatctcaaaaaaaaaaaaaaaaaagaaagtacaggaagctttcagcctccttggcaagacactgctgtctggagaccctgggagaagtgtgccatcaaccaacgtgaccagaacccatcctggtttagggaggagctctccacaggcctccacggggctggagcagtccccaagctccaaagagtcccccacgacctcttagtcgtcacccctaggaagggcctagaaggcagatttcccaccatgagaagccacatggagcccagctcccaggcatgcagccctgctgggctatgcggggaagatgtgtgctctgaaggcctctggggccacccaactgccatgcaggaggcctccggggccaccccactgccacgcgggaggcctcgggggccacatctccgccataggggaggcttctggggccagccctctgccacacgtgaggctgccggcccacttctctgccatgtgggaggcagccggggccacatctctgctatgctggaggccgctggaaccacctctccaatgctggggatagctccctggagccatctcctttctcacagaggcgaaacccacaccttccccaaggaacggagctcacgccccttcctgcctccatttcccaagctgtcaccgtaacagtcactacaggacagtcagaatggtaggatttgagctaaattgctagaattagagagcgtcacaaaaattctaggaggtcagcaactttaggtaatgcccacacctgatgggggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccctgggacatccaggccccctgggcacagacatcttgtacaaggtcagagagactgggtttcgggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatgtgtgcatgtatgtgtgtgggggtatgtgtgtgtggtgtgtgtggtatggtgtgtgtgtctgtggggtacatgtgtggtgtgtgtggggtatatgtgtggtgtgtgtgtatatggtatgtgtgtggtgtgtgtgtgatgtgtgtagtatgtggtatgtttgtgtgtgtagtatatgtggtgtgatgtgtatgtggtgtgtgtagtatgtgtgcaggtatgtgtgtggtatgtgtggtgctgtgtgtgtggtatgttgtgtgtgtatggtatgtggtgtgtgtgtggtggtgacatgtgcgtatggtggtgtgtgtgtggtgggggtgtgtgtggtgtttgtgtggtgtgaatgtgtgtgtggtgggggtgtgtgtggtgtttgtgtggtgtgaatgtgtggtgtgtgtgtgtggtgtgtgtggtggtgacatgtgtgtatggtggtgtgtgtgtggtgtgtgtgtggtgggggtgtgtgtggtgtgaatgtggtgtgtgtggtgtgtgtatggtggtgtgtgtgtgtggtgcgtggggtggtgacgtgtgtgtatggtggtgtgtgtgtgtgtctgtggtgggggtgtgtgtgtggtgtttgtgtggtgtgaatgtgtgtggtgtgtgtatggtggtgtgtgtgtgtggtgcgggggtggcaggatgtcattaacttggttctaaaggtggtttgggttcaggtcctggagtacatgctcaggaactgtcaagcaatctgggggcacaggaaggagaccgggcgctcctgcaggtattaaatcgtgttttgcgtgaagatcagcgttcagaccagtagtacaaaacagatggtctaggaatgaacgtgacaacacaagggcctggagtgtatgacgaagggggcatttcaaacccgtgggtacagaaaaaatccacccgataaacacaagtgggaaattgtgtaagaaaatgaagtgagattccaatattaaaaagtcagataggtcaaaatctaaataataaacaatttaccataagataattagaagaaaatataaaatactttttaatcttgggttcaagttgtcacaaaacctaagctattttttttaatccagaagtattaaaagtttgctatttcctatagacaaatagctcctacaacttggtgaggaaacagggtccaggagcattttctctgctcgggtgaagctcaggggaagacataagtacatgaaagacattccgttctgtaatgattaaaaaatcaaaagttaacaccatcacattggtaaacgttaaaaggtttaataactttttttaatatactgctgttgcacatgcaaactgataaagcctttttggaaagtaatttggcaataaaaatgcacatactttatgagcaaaaaaaatcccgtttcttataatctaattgataagaattatagcataagtgcatgtatgtgtatgagaacagtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcacccacctgccccccctccctgcacccgccccccctccctgcacccacctgccctactcagggtggtgagagcggaggggctctggggcttcatccacacgtctcctagtcaccctctcgaccaagagcatcctctggattttacattcacttggcaacaaaaaaagtttgagagaggactttgaacatcaaaaatgcttacatttgttatgtcacaaacacaaagcgttctcctaggaggtttctggtacagaccatgtttcctgaggacctggagggtatcgcacctacagccagcaacgccgtgcagcacgctcggagcgcacccaagagggcagatcagaggggcgcacgcggatccccaaaatcctgaagatatgtacggaaaatatgtgcggcttttcctgccgaccaggcctccacgaagtgcttcgataaaataaaaccagcctgtcatggaggagtcccctttgcccggagagcctgtccttcccctctgggggtcacactgccagtttgtcaaagttgggcgaagtggcccctgcctggaactctctggccttatgaagccccctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggcggacattagccagcagtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggtacttcttattcatgagctgtacgttctacagcgtggctggtcatttaatgtgtgcaatcgatgggcactgcgcttcaacttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcacccagccgagagtcccctgctgttccctctgcagagcaaacacagtttctgctgaaaagaatgtggcagatgaacaaaaattgtaaggttttctaaaggtgtttcattacgtgagatggcagaggttggtctccatgtcacagatgaccctcgcggcggtgataacctttacattttggggtgctctgtggaccccctgtgtaccctgtgagtatgcacgtttctagaggtggagtttgacccttgaattgttcaaattataagtagaatcacagaaattgggggaggaaaggatctgaggggcctccagggcccgtggcttcaccctggggtgggggcaagggcggggcgtggtgcctcttccggggtgggatgggtggatgctcgtggttcattcccacgtgggattctcacatgctcgccctccggctgtcaggagcaatggtgagttctgccacacgtggaaaacacgttggcttctctgggttttaagtgtcctgtcagcagctcggagcctctaggagacaccgtcccccagggccacgtatagatccactggaggcctgaatggcataattcgtggcacccctggcaccacacaggggtgtttctgtccccttctcctcccatggcttagaagcagtaatctcctgacctccaggcagaagtcaatttcctcctttgcctcctccgccttgcagggaccccagggctgacctgcctccctcggccccctctctgccagagccaggtctgaggtcaaggctttcggtgtttctgaggccacgctgagggccccacagccccttcccgggtccccaccctccaggccaccttcgggcctcggcagcacacctcgaggggcccaggacaagctcggggcccaggtggccgggagggggccgcctgtgtctcgcccctcattctctgctctgacccgggctcgcacctcccctcgttctctgctctgacccgggctcgcacctctcctcgttctctgccctgacccgggatcacacctccgacccgggctcacacctcccctcgttctctgctccgacccgggctcacacctcccctcgttctctgctccgacccgggctcacacctcccctcgttctctgctctgacccgggctcacacctccctgctccacccaggctgcctgcacttccggttctgcgtctggccggcctacgggcactcgggcagtgcggtgaccaattatagcgtcgacgatggcagcttccctctgaaagcccattgtgtctgcccctattctttgaagcttcactgctttcggataagtatgaaaataggctctccctctctgagtcaaaggaggcaattatacaataggactatcaccctcactgtcactctccgctttgtttaaatgtggggatttcatttcttcatcgcctctgtgaacacccactaaaaccgtaagtgggaaaagtgggtgccttctgtattttacattttttattgtgtcacttactgcaaagcagctcaaggagcctgaagacacccagcctgaaaccacgataaatgtgtggagttgtggagacagctcaccagcagaacagtgagctaccttctctcccagtaaccttttccagaggaaacctctttgaaatatcacaagcaaaatttaaatcacaaaatacttcatatctgcctgcactcattgtcatgctaaagcacatcacctcggtcctcagagaggagggatttccatgtgaaagaggccagagtgcttccctcacttagcggggatgcaattataaagtattgaaacttcctctaagacatggatccctgtgcgtcgcagcccctcacctgtgcacctgggaggcacctggggatggggtgggggtgtcaagcttgaagcccctcacctgtgcacctgggaggctcctggggctcaagctcaaagccccctcacctgtgcatctaggaggcacttcggcggggtcgggggcggggggggctcaagctaaaagcccctcacctgtgcacctgggtggcacctgggagggggactcaagctcaaagccccctcacctgtgcatctagggggcactttggcaggagggagggtgctcaaactaaaagcccctcacctatgcacctgggaggcccccaggagctgcagcaaagctgggccccagccacagcctgcaaaatctccgactccacatggggcctcagcaccgtctgtttgctcaccctccccagggggctgaggctgggaaccactgctctttaactctcaacctcttcccaaggtgctgtctatctgtggcccttggagttctgtactcggcagtcatttatttacaagtcgcatgagaaagtccttccagccactttctgtgcttgctctgacatttgcccaaactaacgttgctgaggttgacctcatgtttattcagggaacttgattcattttcaagctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctgcccctgcggggtaaactggcagctctgagttcactgggtgctgtttactgaacgcctgcccatggaagccactgtcctcatcactgggaaaggcgcagagaagagaaggaaacgttaaaaatctggttggagagaggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcaaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaagcaaaaccaaaaacggacctcaggtttctctgcaatatgtaggatccgtgaaacctccaacgtgaaatgagaagtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgcttatgggctgaggtcgtgggaggcatcccgtgagggtcacaggctgaggtcgtgggaggcatcccgtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtcagttacattttcctatgtgtcctccttcctttctttggagcctgaatctttgtctttagcatcctttgtagtcttgaattctgagcccattcctgagacccctctgaacctccagaggccccgcagctctcaagctggaggactggggactatgctcatctttcctttgaccccaggtctgtcttcctacatttctttaacgattatttctctgggccaggcgtcgtggctcatgcctgtaatcccggcactttgggaggctgaggcgggtggatcacctgaggtcaggagttcgagaccagtctgtccaatatggtgaaatcccgtctctactaaaaatacaaaaattagctgggtgtggtggcgcacgcctgtaatccaagctgctcgggagactgaggcaggagaatcgtttgaacctgggaggcggaggttgcagtgagctgagatcgtgccactgcactccagcctcggtgacagagcgagactcagtcctaaaaaaataaataaaaataaaaatagaaaagaattatttctctaccttttggaatgtgaaattgcctctgagacgaacctgtgatttgtcacctctgggagatgacaaggatgcctctgtgacctttgtccccatgctaaatattttgtcaccatgctggctttcttgtttgcatcagtaacagaccggccatttctcccatttggctgtacagtcgttagcagtggcccctccacacacacagacacacacggacacacacagacacacacatggacacacacggacacacacacacacgtcgcttctggtctgagaatgtctgcctcctttccattcccctgggcaggttattttcttctcctaatcacaaaacccatccttcatcttaataattctcctgagagcgatatttacaccctataattagaactttatgttcgttttattaattacctcttttttgcctattgatgtgaaagaatctggggctaaaagtattacagatggctctacacattgaaccgttgatatttaaactcaatcagcagatgctggtgctgtggggtggggtggggcagggtgggcgtcccaccggctcctcaggccttcctccacatcccatcggctccactcagggactccacttcttctcagcacctgtgccctccagtccctctcccaggaaggcagcaggagaggagacccccgtgccatcttcaataccacccctgtgactagggtgctgccccctcctcctttcttctccaacttctagatttggcccctaaatgtgactgaataacgtggcaagcccttcagacatgacaaccccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgctgaacgtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctggaaatgtctgctggctttgcacccaccaaggacaagatccacagccttcaacacacggcatcacgaaccacctcccgagccggccccctccatccctcagagtcaccacaatcggcctaccccgtccctcagaggcaccacagccggccccctccatccctcagaggcaccacagccggccccctccatccctcagaggcaccacagccggccccctccatccctcagaggcaccacagccggccccctccatccctcagaggcaccacagccggcctcctttgtccctcagaggtaccacagccggcctcccccatacctcagaggcaccacaggcagcctcctctgtccctcagaggcaccacagccggcctcccccatcccttagaggtaccacaggcagcctcctccatccctgaggcaccacaggcggcctcctccatccctcagaggcaccacaggcggcctccccatccctcagaggtaccacagatgccctcctccatccctcagaggcaccacagccagcctgcgtggcctctgtgtttctccccggggtctttccaggctgggcttcttctcgtcctaacgctcagaggcctctgcttagccccaccttccatcactgtgccctcttctcctttcttcacatcacaccttactagaaattacccggtcactatagtgcctgtcccttctccgcgacaaggggacccctagcgtgcttccccgctgcgctcccagctcctacaacagtgtctggcccctcaaagcgactcaacgaccctctgctgatccaaagactcggcatccatgtgcctcccaggccgccgcactcctcctcctgggaacaccctcgtacggacgttctgtggaaatagatgttgtgttttcacctcttgtaccttgttcacttaaaatttaatcaacatcttattagagaaagaaagaggttctttgctttttttaacttttaaaatatgaatacctgccgggtgcggtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacgagagtgctgcgttaacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggcgtgcagctccttcgtccaccgtgaaacccgccccggcgtccctctccgactccgcttccttcatgggacttcacttccgtgtgctaagaacgtgtagcgaggcccaccgtgttgacacttccctgagtgtgcagcgtggtactgttggctctcaaccgtacggcagatgtcgagaccgcgttgaggccgcgtcgctgaaaccttgtgcccttggaacggccccttcccgtgcttcccccagcgccagacccggcagcctccatcctcctctcttcttcggtgcgttcaattgtcatagattccacgcttcagcgacgtcgtgcagcctctgtcctgggcctggcttttgtttcacttcacgtcatgtcatgcaggtttatccctgttgttgcagatggcaggttgtccgtcttgtcttaaggctgaagagcacccactgggtctatgcaccacgctttcctgcccgctcgtccctgggggacatgtgcttccatgtcttggctcctgtgaacaatgccgtgatgaactccggagcgcacccgtcacttcgaggtcctgatttaacttcctttggataaatatctggaagtgggattgctgaatcatatggtggctctatttttaattttttgagaaaacttcatactgttttccataatggttgcaccatttatattcccaccaacagcatgtaagtgttcagagtctacacatcctcaccaacacacgtctttttggtcacagcctcctgatgggtacagagacgtatctcatcgtggctctgatttgcatgttcctgatcattagtgatgttgagcatctttccatgtacagtgtgttggccatttgtatgccttctttggagaaatgtctactaaagtcctttgcccatttttaaatcaggttatcattattatttgctattgaattgtaggaagtccctatacattttattttattattattactttttggagatggagtcttgctctgtcatccaggctggaatgcagtggcaccatctcggctcactgcaacctccacctcccagattcaagtgattctcctgcctcagcctcccaagtagctgggattacgggtgcccgccatcacacccagctaatttttgtatttttagtagagacagggttttgccatgttagccaggctggtctcgaactcctgaccttaagtgatccacccacctttgcctcccaaagtgctgggattataggtgtgagccaccacacccagccacctatacattttaaatattaactccttatccgttatgtggtatgcaaatatttcctccccggtgaccagtaggggatgcagagaccacacacccaccactcaccctacctttcgtgggctgccctctggatttgctgattgtttccctgctgatgcaggagctcactggtttgatgttgtcctgcatgttcacatttgcttctgttgcttgtgcctttggtgtcagatccaagaaacctttgcctagatgaatgtcatcatgcttcccccgtgttttcttctagtacgtttatggtttccagtcttatgtctcagtctttagcccatgttgagtgggtttttgtggatgtgaggtgagggtccgatgccgttcttttgcatgtggacatccagtttccccagcacctgtgaagaggcgacccttccctatggtgtattctcctcatgcttatgaaggagcacttggcagtgtatgagttgtttctggactctctgttccattgatctataagtctgtttttatgccagtagtgtattgttttaataaccatagctttgtaatatattttggaattgggaactgttgcatgattttttgtggagctctgggcaggtttttcatgatggcaaaatatgtcaacttttctttttggtgtaatttcttcattgctaacattttccctagacagtgaaataataaacattttctaaaagttcctcaagaaaaactattgaaattatttagtagaaacatatgcaagagtagataatattgatgtatccttattatatttagaagttaaaattaaagaggatcttatgggaaatttaaaaattgcacagtaagggattccttaagaaacaggcgcaagcccttatttcgtagcatctaattcctcaccgggtgtggaggggcctgtttacccaatgcccccgcgaagtcatagtttggtggcatacagctcttaagaatgcttattagctcttaatatcagagaggattaacctcctacttcatgaaacaatttgctaaggctgggaatttttcttccatgtctgtgaggactgccttcccttctttccacacacttcttcattcgttgtgtacctgctgagcactcatgatatgtcagaccaagttctagggactgcagtggtgaacaactccagtgtctgtgcacggagcttccattctgtaaccatgcagctgctccagagaatgccaaggtcccagccaaaaagctctagatgattctagactgtgcacggagcttccattctgtaactgcagctgctccagagaatgccaaggtcccagccaaatagctctagatgaggggtgacacataaggtgaggacccacgcgtgcacacacatacacacacttgcacacacatgcacacagtctcccctctgacccttctcgccctactgggtgaccagtaggtgatgcagagaccacccacccaccattcagcaagatctgacaccttctgactcttgacagatgatttctgcagacagatccgatgtcatcttcctcccagccccccttctcccagtcctgcctcttcccaccctgcaggtctaggcctcactcacgagagaaggctggttttatccactgtgtgtggagcctggcaacaagcatcccacattggtgtgatccaggttaccctctcgccatgcagtgccctcactgcccttgctgcccctgagctctcagagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactcctgtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaacgttgtgtcgttatgtctagtgtcaggttatggctccacagcctgtttgccagttaagcggtgggggcagggcaggccttggtcaatatttgagtaaaagaagaatcttaataaacccaagaaagtaacttcaataataagaccaggcagtgttttgcaaagcagaacagaagcaattcaaaagggagagagacacagccagaggccccaggagcccccaccttggggacatggagtgtctgtgtgagcctggctttgttctgaggcaggagggacccgagtgcttggggccagccctgtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttacatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatatatgtatatgtgcaggtgtaaatgtgtgcaatagatgcatatacgtgtatatgtgtgtatgtatgtatacatagatgcatatgtgtgtatacatgtatatgcgtgtacatctgtgtgcccataaagatatatgcatgtgtatgtgcatacgcatgtatgtgtgtgtgtgtgtacatcttctgtctctgcattcttactggcaggattattgggaactattggatctttctgaggaggccaggatgatttccgtggcctgccagtttctcagagctatctgggttgaggcactgagaaccccctcagtccaggcagaccacggcccggtggtctgcatgaacaaagtgagtacttggagggccactggcatgggcccagcttcccgctctcctctgcatgcacagcctctatcccatcagacctgcacctcagcagcaccaagctcaggggctgccctgggctcccctctgagcatcagctcctctgttccagggagagcctctgctcccctcagggcccacctccttctagcagaaagctgattcttccccagactgggccctcagttctctgctaggtttggccaggctggtgtctttgacatgatcttctgggaggagaggcagaaatggggcccttccgatgtagctggcaaagctgtaggtgaacggtttgtaccaccagggaactgtgcccgagaacacatatgttcccacaacaatggggtttgtcagcttgcaggtgcccagccctttccgtgccctcttgagatgggttggggcagacagagtaggaatgcttcctggctgattacaaggaaatcccggcccattggatggggaagccacaagacggctgcttggagagatggtgctgcacacacatggcagccagaacgagtgtgggttcagagagcaggaatagcactccctgcccttgtcatgctgtggccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagctgacaaatccttcacatcctggagctttgtactgaacactgcagggttccatacagctgtcagctgcagagactaggcaccgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgtttgcccccaaactcacactctgtaaaagtccatgggcatcccagatctcccacccatgtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcgggagagtgagctgttgagtggccggtgagtggtgggtgagtgagtacgtgagtggcaggtaagcgggtgagtggcgggtgagtgagcgagtgaaactttgtcggtatttatagccagtccccatggctcacagtactgcctgggctccacctcctgtcagctcagcagtggcatcagattctcataggagcttgagccctgttgtgaactgtgcatgtgagggatccaggttgcacgctccttatgaaaatctaatgcctgatgatctgtcactgtctcccatcacccccagatgggaccagccagttgcaggaaaacaagctcagggcacccactgattctacatgatggtgggttttataattatttaattatatattacaatgtaataataacacaaattaagtgcacagtaaatgtaatgcgtttgaatcatcctgaaaccttcccccaaccttggtccatggaaaaaccgtcttccatggaacaggtccctggtgccaaaaagagtatggaccgctgtcctggacaaaccctgggcctggaattgaccttgttgaaaacactcttttggattaagcatctataagattcagttgttgccttggacgattcacatttcacatggtcagtccctgcagcacctcccgaagtgtggtgtgtcacttgcttttatgtggaatgtgggcagttcttaaaactttattttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaattttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacaggggagcttcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatcccccgtgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttccatgagaccctccccagccacatcgggggctctgaagactgagcactgagggtcagcagcaggtaggagatgtctttgaagtttcatctgttatcttaaaaactcgtggatttttggggcggggcgctgtggctcatgcctgtaatcctagcactttgggaggccaaggcaggcggatcacgaagtcaggagatcgagaccatcctggctaacacagtgaaaccccatctctactaaaaacacaaaaaattagccgggcgtggtggcgggcacctgtagtcccagctactcgggaggctgaggcaggagaatggcatgaacccgggaggtggagcttgcagtgagcggagatcgcaccactataccccagcctggatgacagagcgagactccatctcaaaaaaaaaaacccaaaaaaataaaacaaaaaaaactcatggatttttgtaatctactctattatatatatatatatatatatatatatgcacacacatgtatgttttagtatcaaaatgacttcaccccaaatctccacgtgaagtagatgcgtctcctctccatcgtggctgttggcacagtgctgtgtacctgagtgtgttcaacgtcttgagatttctaagcttaagggcaggagatagcccagggctggcacccaaatcctaagaaccctggccaaatatacaggatttaatgtcctcagcaccaggcatcacacaggaacgtgcgtgagcccatgaaatacttgctcaataataaatgctgccaagctgctaagcttggggaacctgatgagcactcggcttatgggagactgatgctccccacaggccggcccctgtgccgagactccacgcagtggcttcctcgctgtgacagcctcccctcatctgacgaggtccaaacagcgggtccaattctacccacacctctttgcatagggtgcttctctggattttagggtctagaccaaagctgaggctgttttatacattttggggtccctggaactcaggacaaggccatctgtatccccaatgctgaatgagtctccgacaggtgatagggcgatggggtcgctgtctaagtagggaaggaccaccctcgacttaagacatggctcagtgaaaaaagcctcgctctgaggacaggcagtgagaaatgaggaggttcagggcaggcggactccatgtgactgagggtttggccgggctccccttatcaacccggcatccctcgaccatgttctctggtgcacacaggtgagcagagggcagtgtctgctctggccaaggcaggggcaccccaacatcgcagccccttttggatgtgaggtccgctcattagatccgaggggccgtcctcctcccgtgctgggacccttggggcttgccgggagagacgcccagagggaaggggctttgtgggaggaggggttccgctgcccttcctggggcacctgtttcgctttttgtctttctttcctccctttccactccactccctttggggcatgagggaggtgagggaggagggtgggaagaacaaaggagagaattctgaggagggcgtcctgagttccagggacttctttcatcaagaggaaaaagaaaaactctttcaacactccctgtgcatagggtgctaatgagctgcaaattgaaattatttggagtttttcttaatggtgaaaagaaagaagttgtcagaggagaccagaaactctatgtcagctgagaaagctgtaagcgagagagatgaatggacggctcatctgtgctttggtgcatctttcatcagccggtgtcacccttggtagccgggtgctggccaatttccatttaacttccatttaacgtatagccaaggaggcccgtgatttcacctgtctgacccaccacagatgggtagctgggcttcacagaaatggaggttgagttcccggagcggtagcccagggctggtatgttgagaattccgtttggaaaccagcgttgtgcaaaccggggttaggatgtggaaaactcgccctccttccaaacccagaagccttcgtcttggtttagaagtccctaagccaagtccctacccacattccacgctgctccctaatttcacccggaccacagcctctggatgagcttctgttaaaaagagatgactcggtgacaaacaggaggacggtgctcaaatgactgtgacacgtgccgtgtatctgcaaagacctgtgccgtgctaaaaccacacgcatggcagcctcccccaagccaaccacccgggcccacagacaagcatctccagagcgcgtgggaccgtagagaaggcagtgacagggccagggcaagccggttggagaagtggaacttcagtggtaagcccagacctttgggacccctcaccctgcccggtcctcctgctgtggggtgtgagtccagccagtgctgggaagccggtgtggctaggacaacaaagaccaaggacagcggggaacggtggggagggaagagggtgggagaccagagtcagaggcggacaggggttcgatacgccattcaggtccccaaaacagcatgtgcagctctcgttaaatggaaaaggccctaatgtcatgggaaagtctaacaatttgttaaactttgttagtgtacaaaatgtggtgatcctactcgtataaaaaagaaagttcaaatgcgcagaagaaagatcagaggacaagatgcccacgaatgataagcgcctttgctgcctctgggcgggtccgggggagtcgcatttcttcctcactgcatcgctgtattttccagatgtccactgaggaatgagcattgctttttaattagcagctgccccgagtgctccagctgccctgcgtgtggctgtctacacagcacgcattccttaccccggtggttttcatctggaccctgagtcagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacactgccgtgctgcgcaggtgaggcctggtgcacggagcccctgggggacacggcgaagggccttctcctgccatctgctcaggaacccctccctgggcttggcctccatcttgacaggcaggcgaggaagcccctgctgacgccatttacaactgcaaacctcccatttcctcccaggtccttaaagctccacatcataaaacggatgtgcgcgtgaaggaaacgtgggtgtccacagagagctcccccggagaaggccacgtccacggtgccgcctgacagcaatggcttcctcagcgtttgacgggcagggagaagggtggggaggccacaaggacaggagaactggcgctcgacatggggcaggacgggagcaggatgggaacaggaggggacaggagggggcaggacagggacagaggagagacacggggcaggacggggcaggacggggacaggcgggggcaggacagagggaggacagggacggaggagagacggggggcaggagggggcaggagggggcagggagccacgtcttctccaatcccatatggggccatctgccaccctctgcccaaaatgtacgattcaccatggcaaggaggcgagaagcggggagatccctctaaacccaaatgaacacagagtgatggggccccagcaccccatccacaggctcattccattatttgaaaatgtttctaaaaactgagcttcttttcatctttgaattggcttcttgtcacagagcagctttgcaggcagcctgtttcaggtgtccacactttgcagagggcgcctctgcacagaagcgcacgagtcccagatggagggaagcaaatctcacccaactttaaatatttgtttctccaaagctacgtggtcacccgtgcatggtgacggtgatgtttgatttcaggtgactttgaggctgaccttccacacggggccctgcgtttctctcctctgcacctgaaccctcctagtctttattctgggagcagcgcgggaggcagtggagacgtggaagcaggctccggctgctgggcctgcatgaccggtttccctgcagaagattctgcgcccttcagcctcaccgtcctcacctggcctgggtgctgctgtgggcaggcgctgggcacgctgggaagagcagggccagccgtttgcaggacgggaggctgaggctgtgtgcacctcctgagggctgggccacaggtgggctcaggcctgcgccctcccatggccgtggcctcttcctcggtcctttgccctccagggtgccaggcctaggcctccgcgcatcagtgtggtcaaaaggcaggactggtgtgtggtgtttcctgacattttgttacctgtagagccacttagagaagcaccgctgccgaggtgggaaagccggagtcccagccagtgggctgagctcagggtgctggggtcctgggcccagactctgtgctgggaccttgtttggaaatagggtctttctagaggatcacatttagatgacgtcatgggagttggccctagtccagtgttgctggcatccttttaaagggacattcggatgcagacaggcactcatgggggtcgacgtgaaggagagagccacccacatccaaggactgttggaggccaccagaagctgtagagatcctgggacagaccacccttacagcctgccatgagctggggcgcgcgcacatgtgtgtaaagcagcacacatgcatgccacaaagcagaggctaagcagtgcacactgtgcacactctgcacacgctcaggcggtgacacgttgcagacatcgctgtgcttcagaaagagctgggcggcaagattcacacaagtaagcatgttgcagactccccagcacacgccctctctggcttgtgctcatatgaacatactgtcaccctcgtgcagatgtgaagatgtgctctcactcatgcacgtacagatcacgccctctcgctggtgtacatgtgaacacatgctcccctcatatatacaaatacactcactccttctccacccttgttcacagcagcagcctgagaagacacagaattccatgaattgcagcccagagaccccccagccctgccggctcgcctcctgcctcccgcctcctagcgtgctctgaggtggagaccagctgctgccccgtgcctgccccgcctccctgggccatgctgccttgcagactctgctgctcggtgtggtcgggggcctgggtcggccccagggtgaatgagtgatgggttccaccctaaactggctgtggagaccttccacacactttcctcccctccacgagctctagggcagggcaagcttggaagccaagggctggcagaggccgagccagcctggatctcagagtggccacacggagcagagccacactccacctcaggacgctgcactggatatgagtgagaaacaaactttcttgggttaagttgttaagatttcggggatgtgtttaaagtccctagtgttctttttactgtccactgcctgtctccaggaggggcccgggggcaggcactgaagcccccgcagtctacaggcctctggcactcagacaggagctctgctctcagaaaagcaggcaggctggcattcggcacatccttggaagcgggtggtgcgagactctgccctctaccctctgccctctgccctctgccctggcgttgagtgctttgctgggactgcggctccctggccccctctcttgccccacatgtggattcgcacagaccctgcagcatccccctccctttctcctcctcttttctctttactcaggaatatcccatcttagttacggggctgggcaccccaagacctctctctaacaggggtccccacatccagggcactgcagatgggctgccgaccacatgcctctggcctccggccagtctcgggccatttgctgacaccccggaggccgatgggccctctcgctgctcaaggtggagggaggctgtgcaccgggggtgtcggcatgggagcgctgtgttccgggggcgccgcgggtccctcctccccaggctgcttacgcgtcacaccagcagctctgatttaaacccaaatcctttcacataaaacccttcacttgtgctcttaggagagggttttgcacacgtctggctctgcttcccttctgctgcattttgctggtgcgctgggggtctgtgtgtcttattcggagaagacgttgctgctcccccaaacgaagaatcatgtcacaggaaaccatgacaaaccccccttttgactgtgcctcccagcaggagaacagggagctgagaagacaatgaggagcaggctgtggggaaaggagaggtcactgaggtcacatgagtatcaggcagatggtgccactgccggagccaccccagagccaccatcacggcaccgtttcatcccatccagtcctccccacgtcctcaggtggccaaagaccacattacaccacatctgtcctcagggaaaagaggagagaatgcatctgagaggacctgtcgaccagggacacacccgacctgcacaaagcagcatctggagctacggccggggccatcaatggggtgagggggccaaggagagccctggctgccctgcagagggtgtgtccgtgtggcctgtgtgcatgcacgtgtgtgtctatgtgtaatgtgtgagagacgtgtgtgatgtgtgcatgtgtacatgtctgtgtatgtgtgcatgtttggtgtgtgtgtgtagcgtatgtgtgtggtgcgtgtgtgtggtgagtgcacatgatgtttgtgtggtgtgtgtagtgagatgtgtgtatgtatcatgtgtgatgtgtatgtatggtgtatatgtgtgttatgtgcatggtgtgtgcctgtttgtacatgtgtgatatatgtgttgtgcgtggggcatgtgtgcggtgtgtgtatatatgtatatgtttgtgtctgtggatgtgtggcatgtgtggtgtgtgtggtgtgtgcatatgtggtatgtgtgttgtgtgtacagtgtgggtgtgtgtagtgtgtgtatatgtgtatgtgcatgtgtggtgtgtgtggtaggtgtgtggtgtgtgtgcattcatgtgaaagtgtgtgcacatgtgtgtttgcatgcatgtgtatgtgtgtgcccgtgcatgtgtggtgtatggtatgtgtgtggtagatgccggcagtgtgttggtcatagggagggaaggtggaggctgcggtctagcagcagagaaacagatgggtggttttttctaaagcgtgggaaatgacacgggggctgtgtggcctcagagatgggtggggtcattggggagctggatcaataatctggacatttgggaagatgtcttgggggccaggtgcccaagctacatcttcaacgatgaggaagacaggaaacggggagggacgtctcaagagagggcgtggcctgagccaaggagttcaggtggcagcttccagaagggcagaggccacgacaccgaggcccccagctggtgcctcctgtggctgagtgatgaggggcactggagtccaaggccctgggtgtgagtccctgggatgctaaaatttaatttcctcatgtgccaaatgaagacaatatagtatttacccctcaggcaattattaggaagattaaatgttaattttagagaaaatgtaaaacataaatgcttttgtgattaattaattcattaattacgtgtggagaacctcctgggtgccaggcacatggcactccagccacaaacaggagaagctggcccgccctcctccagcagccctcgcccaacacacccctcctctgaaaccagcaaggccaggcccaggcacccgtgacaactgcaccccgagccacctctcaggacaggccaggcccaggcacccatgaaatctgcaccctgagcctcctctcaggacagaggccatcagcccacgtgcctgtgggattcttcatttctgccactaagctgccctgtggacaccactggccccagccccccaaacacctgctgggcctgggtccacagtggcccacctgcacccgctcagggtggcctgggcagcccccttcggaagcccagggctctgctgcctgggagctccagcacccagggacgcgctcatttggcgctgggtcttccaaagtgagccctcacccccatgcctcatcagcatggccctgacagggacaggagtgtggtagaggacttgggttaataagtgagatttttaacaggctccgctcagctggctctgtcggctcgagtctgagcccatccgtcagcgtcaattaggaagcctcagctcagaacgcaacaccaggggctgcgcagaggaagaagcgcgagggcgccctgcaggctcacagcgcctgagcacacaccgagcggccgcagcacagccctccctcccgccccaagcacacaccgagcggccacggcacagccctccccgccccaagcacacaccgagtggccgcagcacagccctcccgccacaagggtacaccaagcggccacggcacagccctccccacccctacctccttttggcagcgcaggtgcattcaggggagcgtgctggatgggagggggctccctgtcacgtctcctggaaggatgggatccctctgcacgccccatcacccgcccacccactgccagccatgggcacacacacaatatttgtgtattcatgaacacgcaaaacacactcacacatgcgatcacactgcatgaccccccccacacccacacatgcagtcacacacacgcacacaacagacacatgcttatgtgcacacacacaacacacctgcactagcccaggcactcacacatacatgaacacagcagacccaaacacgttcacacgcacaacacacccacacacacagaggcactccacacacacatgcacacacacacccacagtcacacatgcaccaccacacacatacagcagatccacaatgtatatgcacacacacaacacatccacactcacacatgcactccacatacatgcacacagcagacccccacacacgcacacacatatagaacacccacacttatgcactcacatatatatgaacacagcagacccacacagtcacacaccaacacattcacacatgcaatccacacatgcagcagacacacacacgtgcacacaccacacccatgtcacacacagcagacccacacacgttcacacacacaacacagtcacatatgcactcaaacatacatgcacacagcagacccatatatatgcatattcaaacacacaacacatccacactcacacatgcactccacacacctgcacacagcagatccccacacacatgcacacaaacacccacactcatacacgcactcacagcagatccaacacacgcattcttacacatgcacacagcagacccacacacgtgcacacacacgcacacacactcatacatgcactcacagcagactcccccacacacgcattcttacacatgcacacagcagacccctacacacgtgcacacacacatgcacacacacatacacacaccttcacctgaggccaagccaagggggagtgatctgggaagtggcatctggaggctgaggaacctcagagcatttcttcttttgcatctgaggtttcaaaacccatgagaatgatcttggagttattccttattctctacatgccaggaaaggtgaaatcagaaaggagaggatttgacagcctcacccagagggaaagtgtcaggctggggctcactttttgccctttggagccgaggatgaaggaaacagtaactgccacagggcagcaggagtgcaccccgcagcctggtggagtctcccacgctggaggggaggcaagagtgcaccctgcagcctggtggagtctcccatgctggaggagaggaggatgaggccaggcatactggacagcttgtgtgaccccaaggcaggcatggcaggatctaggtgcagatgacacacccagcatccttgtgccaatgccactcgggtgtactttgctgcctctgctgaatgtaggtggaagaaggcaactcacctgtgaacagtgctgtcctctctcctgagaaccagcacaatcataagtttggagacaacaacaagaattcagttttagttatgagaggcctataagacctctgagtaaagacataactctaggatctggtcagagctataaattcagggtcaattcactccatggctgccatttggagttatacagatgaatgaggtcatggagggaggtggtgtctggagagaagtgtcctgaggaacccagcatttggagagcatgtggggaggccaccattgatgagcctgagaaagagcagccagagacatcggagatgaaggtgagcccagcatggttgacaccaagacaagaggaagttttgagaaggggcttattagctctcaaaagctgatggagagcccacagttgatgaggattgaagagtggccattggcttcagcaccatgaaatcacagctggccttggttggcatggtgggatagaagccactctgaatgagctggagtctgcacctgtggccggggcagaggcagtggctgaggtagatggaggattggggagaatgcaaacaggaagacaaataaaccagaggccagggaaaccaatggttgttgatgtcacagagaatgatgacataggttgtggtgaagataattgtgagagacgtgactaagggggaggagggacatgggttaggaagccattcatccatccaggcactcattcatccatctatatatacactatccatcatccatacacccactcatccacccatccatccatctgtacactatccatcatccatccatctactcatctatccatccctccctctatctatacaccatccaataaccatccattcactcatccatccatctatatactatccatcaatcacccatacactcatccatccactcatccactatccattgtgcattcatctacccactcatccattcatccatctatacactatccatcatccatccaaatactcatccatccatctatatacgatccattatccatctatacactcatccatccatccactcacccactatccatcatccatccataatacactcatgcatccatccacccatctgctatccatgagccatcctcccactcatccatccatccatccgtccatccatctatacactatccatccacctactcatctatccatctatatactatccattaactatccatccactcatctatccatctatatactatccatcatccatctatccactcatccacccatctatatgctatccatcatccatccacctatatattagccattatctatccataatacacttatccatccatccaatcatccgctatccattatctttccataatacacttatccattcatccaatcatccactatccatcatccatctaccctttcatccatccattcatctacccatccactcaccatgcatccatctacacactatccattatctatccatccactcttctatccacccatccactatccatctacccatccacatatcccatcatccatgcgtacatgcatccatccttcctcctatatatccatcagcccatccatccatccatccttatatccatccactatccatctatccatccacccatcatccatgcaggcatccatccttcctctcatccatcagccaatctgtcatccatccatccactcatccatccatttatctatatactatccatcacttatccatgtattcatccactatcaagcattcatccatccacccatgatccatacagacatacatgcacccatccatctttctatccttccatccttctatccactcatccattcacccactatccatcatccatccatgcatgcatccatctatccttccttccatccattctgtccatctacctatggaagcatatatccatccatccatccatccagatttctattgaggacccatattgttaaaaaatagagctaataatcacctaaaatatttaataaaaccttaaaacacataaatacctaaaatactaaagcctggcaaaataacaaattattagaataagttcaagaaattctaattaatgtttgcaagattatgttatcattagcttcaagacactcctagcctcaggctcagggtataggcaaaaaattaacacctagtacttgacaatgagcgtccgtacctgggctgtgattatgagcagctgcttctgattacaatcagtgaatcactaatctgcagtctgctacaaaacagctggactccatctattattcattcttgatgtggagatatccagaatggagagactagaattggactcctaggatccctgttgtcttcatcccccaaggatgttctggtttggaagttgtgtttctgaggcccctgacatccaagactacaggttagatcatcaagttcatatgacaggcaaggactggtgaagttttcagattttctcactcattggctagcattcctttgaactcttcaaaggcttgatatatatagtctaccttaaacatctggggatttgatgtcctgagacttaggttttgatcacatcaagcttttccctaagcatgaaaattttgctcaaataattcagataccctaaccagcctgtgtctctaaggggaatctggagggcaaagtggggaggaggttgaatcagtccttcgttccacagctgggtatgagacagacagagaaattagaagtgttttttcctttttcctccttactctagagatgagcagatggactggctcaaaagtggcctggacttcaagccctcatagagaactgatgcatctcaagtcaccttcgctctgccatcagtaacaatccccctgaacccagcgagagcacacggccccagagctcagaccgtcagtggggtttgtgcacagcctcctgtgaccctcctgaaggtaggagctgaccacaagtcctcctcccaaggcaggggcgagctcagcttgccgacggctgccagagagtcaccctcctgaaggtagaagctgaccacaggtcctcctcctagggcagggggcgagcttgttgtgccgaccgctgccagagaaccacaagagggccttcccctttgcacctgaagccttaattagcaggtttgtcttgggatgttaaggatgggaggcctctgtctggtgccccacctgtccaatgggcagcagcttcccgaggacaagtgcatgctgtccgtggattctctgtgcctgcatggcgtgaggtgtgtcactgacactcagggactctttgctgactcaaggctgccacacaggcccccggaagaactcggtaggaactctggactgttggcaactgagcctcccgcaaaatagggaatggaggctgccccattccggagggacatggtgagacctggctcgacaggaagttctagaggacaggcatgcttttgggtcactggctgtctgttggtgggcagaagagtctttgggtgtgaacctggatgctacactgcagtgacccccaactagtgctgtgccccaaatacttgggcagaaggcaacactcctcagagaaagggtgacctgtttcccgtgaggcagaacccgcctcgccttggctggagcagatgatggaaccacttccacatgctgaatgaagccacaaagcaggcggatcacgagcggcacccagggcccacattagggctgagtcatgctgggaaaactgagggcctggggagtcagccaatgtggccccaaggaccctgcagaccccaccccatctcaaggcagcttggctcagggcaaacgaggattcttcaccatcccaggcctgctggtcttcctctgcttccttggagcctctggtctgtagctggacacgtggatgaagtttctctttcccagcctttcttgaagctggacatgcgactcggttctggccaaggcaacccaagtgagagttgtgtgctgctttcagggagtgtctcatggtgggacgcgcgccctgctcctcttcttcccccttcctgctggctgaaatgagacctggatggtgggatctccagcagccatctgggatcatgaggagcagctcagggctgagggctggagcggcaggagtagaacaccttgtttctgggacctcagaggctgcaaggtcctcagactgcctcccccccagacttcttccacaggaaatgaaagtgcatttccagctcatttaagccacttttattttttattttctgtcacactcagtcacactaatcctgactaatacacacgtgtttgccagtgaacagattatcctctcaaaagtgtcaaaatgccacgtcagtgtatgaatcacacctttgaacaatgaaggctcccgtgttaagaggacgagtgagctctgctgcctggaccactgccctccacatttgttcatgtctgagttcacacctggggctcacacaggtatctctctcgaggcagacctcaggcgccttctctgcagatctgagaaaacctggctggatcccgggggagcagcagcgctggccccagccccattcagcttccaccactcagcttctctgccgagctcccaggcactgttctggagacctcaaggctccaggagacaaaaagtagcatcactgtagagagcttctggatgtctgtggcttaggggtgcttgaaaagttacagatgctcttttgtacactgagtcaaggctttggagaagcgcaagtgctttattcaccactttcactttgttcccccgtgcatgtaaggggtcaggcaatcccctctgctcaagccaccaccagtaaatagaacggcagcacaaccgtgatcaccacagtcatcacaatgagcgccatttccacgcgtgctgtgctgagatgacaacacaactgtgatgaccacaatcatcacaacgagcgccatttccacgcgtgctgtgcaaagacagcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagatggcagcacgaacacgatcgtcacaatcgtgagcgccatttccacgcgtgctgtgctaagctgtatttcaccctcacgccaggcaacaaggtgggcattactcttcccagttcacaggtgagggccctggtaatctcagcggagcctggcggggacttgggggtgtcacaggagcaagtgggagtcctgattgcagagggtggggaccatggcatcccagagggtgggcagaacatggctttaggatgtcaccgtcctcctgtgaggtcatggggcaatggggagccaggaaaggcgcccatatatcctgcgcacggggcagcgaattcatctgcccaggagcacgacttatcccacaggcaccagaggggtctatactgacccggctcctgcacaggaccctccaaatgtcttcaagttgtcctgcatctccgaccgtgtccccagcagacacattgcactagagatgatgcttccttggtcaaaacactaggttctctggtcctaacacaacactgccagacatctgaagttactatattttctaaccaagcagactggctatgagtttttctaactgaatgtcatccaaaacctaaccctaactcctgtataaacattgttttcaaactcatgaagcatcaaaggcccttgtggttttctggagtttccattctctagagcttttcgacaacaccctgcatttgggttttcatcttgagccctcatattatctcattcgattcctgcagcggttttgagaggtgggcacccatttatggatgaaggaagccagagaccacaacacaacacaacacaacacaacacaacacaacacaacacaacacagtgtgggccgtggctgtctggaggccaagctcgatcagaatgtccctgggcactgtctgggggcctgagaaagcgttcgggctgtgtgggtggtgggggttggacctaagacctccagtgaggcgtgacgtcctccattcaattcacttatttcccccatgggggctgagttgtccttcaaacccagtggcccagggagtgggcactgcgtccacaaaggacccctccggcatttgggggaacccagtgtgctctgcagatgttccttgagcgaggactgaggaccaggtgctggggtgccttggaggagggcggttggtggtgtctccactacgactcaccgtgccggggtggatgtggcccctgagctgccggccccgccctcgccggctgtgatgctttgactcagggacggccaccgtgtcacgggctgttcccagagtctcagtgccttcctcgggctgcacgttctgattttgtttttttttgaaaaggtaaacataaagaaaatgcttgaagccccaggacacagttgggctgacaggtctccgcaaggcagctgccctggagggtccctcagacggcagcttggggtgcagctctgggcgtccccaccgtgggacctgcctgccttcacggccacggaagtacatttcgtaagttctggttttcctccttcctgacattaattttccccacatgcagatggagctgggaccagcctctgggttaaaattcagcatcacgtcttactcagaggaagatggtgggaggtcctcatgcttctctgagccccttccacgcgtgtggtcaccacagtctcccttttccaacctgtccggatgcccctgctgtaggctgtagacagactgtccaccttgctacagactgtagatgctgagctgtgtcttcacgagcaaccacagaagaggccacgttgactacagagcccatggacggaacagcgatcggatacaagacttgcccccacttccgcaagccctcggcacccacagctgtgcccctcgggaccacttccctgccccagagccatccgtgtcatcagcaccaagactatatggtgaaggaagagtctggaaagtggcagcagctcacagcaagaccctgagagacgtcctggttactgcaggtatgatcacagcaagaccctgagagatgtcctggttactgcaggtatgatcacagcaagaccctgagagatgtcctggttactgcaggtacaaacagtcaaatcaagtatctgtttatgagacattcaacaaaaccaggtaaactgaaatctatggcaaagtaccaacttcctgccaaacagctgacaagtaagacagggtctgtctgtgttgccgactcccgaaaatgcccactttggctaaaaaggtccagtagtggagaattttaacaacgccactcagttttatttgcgtaaccccctataaaagtgacctccaagggcaagccgtttggagtcaccaattcaggaacgaagatggtgtcactgttttctccaactgtatttctttatgcatcatggtttttataattttctaagggaaattgatgacatccccatcttaaaaccaaacacaatttgaatttcaaatgcacttggagttcttccttccaggacacgtctgcgatgccagcgcggggcgcagccgggcgcgggatgctcgtgagccgtgagctttgattctgaaatatgtaatacatttttaataaggacaactaaatttgtttccctagaaatgtattttgaagagtccataataaactgtcttctacaatgaggagctatttaaagtcaaaaacaaaaaggcaagggtcccgtcttgctgcgagtgttggggcaggtgctatctgaacacggtggcgcaaaagagatgaggcctcgccactgatcaaacactcggctggtaagtagaagtccttaaaaaagacgaacatcaaacaggtcctcatctggggcgctctttttgtggggtcaccctgaccgtgaggccacagatgcgggcccgtgtgcaccgcaggccatacgtggggttaggtaagtttgaaagtctggacaaggctgtcattaaagcgtaggtgatgctaaacggcgtgaaagcctctgctttctagaggctccagcaagactgacacggaaaagctgaggacgaggatgttggtgaagactccttacaaaggcggaaggcgccacactgtgagctgagccatctctgcaatggaaggacagagcatgaccgtgcacccacctgctgagagcccaagtggctgccccagcaccaccccgtccagagggccgggagagcagccgcattgaaggtcgctccaggaaaagccctggcccgactcctcaggcatgatggtacagatgttgacttggcggcaacacgtttgtccctgggcaaactctgtttcaccctgaatctcatgatggtgatgtctcctctgccccatggcagctgcctgccctgcacctctgcagtggcagctccacctgtctgtgggccgtgcttctagctgcactgtccctccatgcttccaaagacattgtgtcctggtcaccagaactcctggtctgcagtatcctctctcccccgtgttaccaccccctcctgccccaccctccctcccactgtcctttctggatggtgtccttgacctcctgtcttcctgctcttggtcccatgggaagtgccaaccctggaagaaaggaggggctggcttctctgtgcctgctcactggcagctgagcacccccaggggcatctggggtccctgaattcacagtcctcatcctcagactcaggggcatccagcccacccttcttccctactcagcccttaaaaagaggcacatggtaaaaggctgctggtaacaagatacccctaagttctcaaggtatcatcctgcaaatcaacgatgaattaccaagggaagaatttacctttacaatggagtgatgtggcaggtgcctcttttaccaaagcgactgcacttggcattgtcccagcagggaggggctggccgtgcacccgctgtggctggaggcacacacatcaccacgcggggaggggttgaccgtgcacctgctgtggccggaggcacacacatcgccacgcggggaggggctgaccgtgcacccacagctgccggaggcacacacatcaccacatgctgaagacctgcatctgaatctagtagtgtggggcaatccaacaggcccaggccacaggatatcccacaggacaagcctggtttctctaacaattgcaatgctagaaaagaccaaaactaaaacgtaaaggtagaagtattctagaacaaagaaaatccgagatgtcacaacaaaacacagcattcacccttgattggaatctggattaaaaataaaaagcaagctattgggacaacgggaaaactggccacatacgaacgtgtgctaagtaacgtcactgcttccaggctgcacgctgggggatgatgcagacactcccttttctgcacctcacggggaagttttgtgatgtctgcagcaacctttgtgacttccatccagacacacaggtaaatgacagagttgcaggcatgactgagagctcaaagttggtgactctggaggaagagggtgcaggtgctcattttactcttctttcaacttgtttgacagtgtggagtttgcaaaataaaattctgggataaagggagaagcacaggaagagggactccttgctgtgagcccagctgtggggaggaactgctcgggccctgcagcatcttacaaggggtgcagggaagtccagagacagaagcccccatggtgcaggcctgtcccagcgacctgtagcctcatccagcactgcggccactcctcctccaggtgtcccgccatgtgcagccgtgaatatcctgtagtctaagccttctctcgttggggttttctgttatttcttcccgaagcatcttaactgatgcgggttctgtgtccagggaagagcagggcagggctgggtgcatttggagttgccctggggctggggctgggagacggagctgccctccccatccctgtccacggcccctctcaccctgcagtactgagcagggtgaggcagggaagaggaggagcagaggagtggctgggagggtctcagtgagcatttcagagccatctccacctgtcagaacgagcaggaagacatccaacccttattgggagtctacacaggtgttctgcactgagctcccctctacttcgggcctgcgagaagcagggaaggtataggctgccgtctccctcccccaggcagctggggctgtcctcacaccagcacagcccagtcctatgacaagcctggccacgttagaccctcacgagacgtcccacgaatggaaccctaggccataaaatatatggatattccagggtttaattcatagccatccttaagctgggggagggcagttatggagctccagagcggggtaagttgttggaaaacggaaagaagtttgtctggcagttgcttcgtctgcatgaggagtgacggctgggctgctgatggccctgaggggtcctcccggagcacctggcacctccgctaattctccggggtggaggcacttgcacaaccatgtgatgaattcttcagcagcgcccggaagctcggaggacatgagaggtggcaccaaggctgtggcagctgctcagccggtctcacaggctcaggactcgagctctgtgttaagccgcactaccactgtgattggcaccaggctcgatgctgcatctcaggctctgtttcataaacaggaggattatttcagaccgatcagaggcggctgcattctgcaaattaccgtgtgctgtggctgcgctcacacattgccaagtggctcctccgacaggcggcactaatccatgttggtctgttcaggaaggttgcctttgtaaactggagacagaatacttttgtttttgttttaaacatacatttgggaaggtggaagtcaagaaatgtagcggttctgttgagttcaaagagaaacacaggattcctaagtttcacccacgctttgcctgactgaccaacacactgaagctcccttcaaacccagagacttactgcacttgcttctagatgccacaaaaattgctgttaaaaagaaaaaaagaaatggaaacacgaaggagctgcacgtgtgggggaggtgagggtgagaaggaaggaaaggcacaatctgtcacagtttccaaacacatatgcttcgcgtgggaatctggggttgattcaaaggctgaatggatcttcagttactggaaggcttggcccaaaatatttcagtatatggagcagttctcttccttctagtagcaaaagcaacagcagagagtgactggatttgtgatcagaatggggacagtgggaaaagttaccaaaccaatttactcaatggagaaaatagccaactggtcaaagaactgtgatgagatggcgggattctccaggaggtgcgtgatgtggctggtgcccatccatcctgtatgatgataaactcgtccaggagcgagatgtggccggtgcccatccatcctgtatgatggtaaactcgtccaggaagtgtgtgatgtggccggtgcccatccatcctgtatgacggtgaacttgtccaggagcgagatgtggctggtgcccatccatcccatatgatcgtaaactcgttcaggaagtatgcgacgtggccagcgcccatccatcctgtatgatggtgaacttatccaggagcgagatgtggccggtgcccatctatcccatatgattgtaaactcgtccaggaagtgtgtgatgtggccggtgcccatccatcctgtatgacggtgaactcgtccaggagcgagatgtggctggtgcccatccatcccatatgatggtaaactcgtccaggaagtgtgtgacgtggggggcgcccatccatcctgtatgatggtgaacttgtccaggagcgagatgtggccggtgcccatccatcccatatgatggtaaactcgtccaggaagtatgcgacgtggccggcgcccatccatcctgtatgacggtgaatttgtccaggagcgagatgtggccggtgcccatctatcccatatgattgtaaactcgttcaggaagtgtgtgacgtggccggagcccatccatcctgtatgatggtaaacttgatggagcatagttccgggagcagctctcctgggttttaggaaattggggagggtgtggagatgcagccgttagtatgatgatcttatccgctgcttcaatttccttccagataaatttcaatattttgcatttcttctggtcacaactctcatccatggacattttaggagtaacaagccgctcatttccataaatcagcattgtggctttctgagtcgaatcggacaggacgtgggcagctggcgctgttggtctccactcctcactgggctgaggcgcactgaacccagaaaccaacactgcagccccagattctctctgacctggtgccgaaagaaggagctggcggatttctcctctgccaacgtccttcgaaactctctgtagtactttctatccgccaatcaatgagccagcagcattccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgagatcaatccatcaattccacccaccaatcagtgagccagcagcactccctgtgatcaatccatcaattccacccaccagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagaagcactccctgtgatcaatccatcaattgatcagtcgacccacccgctggctaccaggggcacccagcgcagctgcgctcacagggaagtcagggcgagcgggcggctccagacagaaacgtgggtgtgcttgtgtgtgcagagtgcacgctcgcagaggggaagccacggggctgcgggcccagcctccagtgagcctggagccggcctgcagggaggaccccaggcgggtgtggggacccaccttaggaggacagacgcacatgaggctacggggcttgttgtcatgaaccccaaatgtgttgtcaataagagcaccggacccagctttcaatgcttctcttagcaaaaccagggattttcctgcagctgtgaacattgacctgtccgcctactccccgagccacagatctggggaaagaatgcatgtagcctgctgtgggtggtgaatggagctggggcagtgatgagctacttcttgccttttgtcaggaaaagaagctggatagatttctcttctcttcctttgagaatgagtgaagagggaagataaaagccagcaaccagggacagctgaaaatatggtttcagtaagagacaggccacagcgtcctgagccccctaggacaagcagaccttccaggaggatttcctaaggtggctggaagagaactctgctaccctttccaacgaagatgcaagacacacagcctctctaaaaacaggagcagaaacacacaacacaacgggaaaaacagggtgtcataaaaacagaaccgttaccaagttatgaaggcaaagagctggaactgggagagatgagaaataactgtgaggaaattaaaactacaatagcagagttaaaattcacattgaggcggcagagcagaactgactacagttcacaaccgaacccgcaaagctcttcgagaatcacgagcaaagcacaaaagatgctaaaagaggggatattagagacgtacggcacaggaaagagactcgtcctaaggatgggggagagtttgcaagaagaagctagaatgactagtaggaagaacaggaaacagggatctgcagcaatgcctcggctctcagggcgctcgggagggtgcaggggcgaaattaacaacatagccgaagggtgcactgcaaatgcgtgggaaacaatggcttattcaagaaactagagtttacttgggggaaggtcctagtttatccctcacttcacacacattacaaccaccagaaatgatccagatacattaacacattaatggaaccataaaaataacaaataaaaacttgtgtttcactgatgacaggatgagcaagcactttctaaacatgagagcgattgacaaaatcttaaaggaaacgactgtgcatttgaatccaccagagctcagcctttctgaacttcagacagtacaacaagcaacgttagacacagacaagcctggcagaacattggccaaaagtaagaggcaaaaacaaatatgaagagtactcgtgagtctatttcagaaaattcacactcccataggaaaattcatgaagagattatcccaggaagcagaaccatcaataatcaagtatgataaaatgtttaaatctacaataaatcaaaaactataaattaaaccaatgataagatgctatcgtttgccctaaataattgcatgcacttaaatgaagtcctaacccttggtgttaagtgagtggatgatggcaggtttattggacttgccagatgcacctgcatttgttggagatattagttcaactggataagaggaattgaggtatttagaagagcttgcaccatttcacatagtagttagatttctaggagtgtatcctaaagaaacagtaagccacatagattgaatgtatgcccaaggatattaattgcagcaagacttatgataatgaaatactagaaacaagctaaatgttcaacaatagcacatgggttgaagaacttacagcagaaccacataaagaccaaagtgttcctcagaagcatattttaaagacaatttgataaggcacacatacaaactgaaaagcaaaataaagacacacacacacacacacacatcctaaaagaatatcaaatagtaagcattttctaagttttccacgctaagtgttcaatagacacaaaacaagtattttaacaaaaatatgatttcctgacagataatatagaagaggtttggcctatgtcatgaccatgtcctggcctggaccatttttaattgctccagagacttccaaattgtgtcaccaaatctacaactgtgtgtccattcatccatccatccatccatccatcccccgaccaaaccacccacttactcatccatctacccacccaccctgcactcaccaccacctatccactcaccaccacctgtccactcaccaccacctgtccacacgtctgcccttccatgcatccctccatccacccacccatccacccaccaccacctgtccacccacccacccatccacacatctgcccttccatgtgtccctccatccacccacccatccacccacctatccactcaccaccacctgtccacctgcccacccatccacacatccgcccttccgtgtgtccctccatccacccacccatccacccacccatccactcactaccacctgtccacctgcccacccatccacacatccacccttccatgtgtccctccacccatccacccacccatccactcaccaccacctgtccacccacctgcccatcgacacgtccctccatctacccacccacccagagaattgctcgcttgttgtgtgctgtgggccaggctctgaggtttatggacggctaggacattattaatgcccatgggggatgtagtgtctgatggaagaggtggtggaggggggaggctgttttgatgcagagtcatccgagatggctcagaaggggcaccatgaggagccagggccatgtaccacattctgtggaggtcgactccccagcacacgcacccaggaacaccctgggcttgacagcctctgctgggtcatgccctcttgctctgtgcctgagtccttcgcactcctgccgtctgcaaggacacggtgcatccagcccccgcagggcagggctcacatcctccatgaccctcacaaggacacagtgtatccagcctccacagggcaggactcacatcctccttcactccatgacccttccttgttgccgccacacgtctgttgcacctgttagacacggagccttggactcaggggtgggtcccgtggatctcacagccctgctgcccagcataggacacacaagtgactcagtggagtccgacacttgctgagtggatggcaagggagaaagctcctctccaccgtggctactccagttcctctcacagtggatggcacgggagaaagctcctctccactatgcctactccagttcctctcgtagtggatggcacgggagaaagctcctctccgccgtgcctactccagttcctctcatagtggatggtacgggagaaagctcctctccactatgcctactccagttcctctcatagtggatggcacgggagaaagctcctctccactatgcctactccagttcctctcatagtggatggtacgggagaaagctcctctccactatgcctactccagttcctctcatagtggatggcacgggagaaagctcctctccgccgtacctattccagttcctctcgtagtggatggcatgggagaaagctcctctccgccgtgcctactccagttcctctcgtagtggatggcatgggagaaagctgctctctgccgtggctactccagttcctctcatagtggatggcacgggagaaagctcctctccaccgtggctactccagttcctctcatagtggatggcacgggagaaagctcctctccaccgtggctactccagttcctctcatagtggatggcacgggagaaagctcctctccaccgtggctactccagttcctctcatagtggatggcatgggagaaagctcctctccaccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccactgtggctactccagttcctctcgtagtggatggcatgggagaaagctcctctccaccgtggctactccagttcctctcgtagtggatggcacgggagaaagctcctctccgccgtggctactccagttcctctcgtcttccctggggtggctacagtgttcttgtcttcgtgaagttgcctctgattccatcctctaaaagccaatgacttatatttggcacaagacagattaacacgtaattgttctttactgaattggtatctgactgtgtgagttgactgaagcatgtatagtcgtatgtgtatctgagtgtgtttgaatgtatgtgcatgactgtgagtgcatgttcatcactgtcagtgtgtcactgtgtccatatgtgtggctgcatgtgagtgtatgactgtgtgtgtctgtgtggctgtgtgggagtgtgtatgtggtggagtgtgtgtggcgtgtgtttgtgtttgtgagagagactgtgtgtgtgtctggctgtgtgtgtggttgtgtgactgtgtgggagtgtatgtgaatgtgcatgtgtggctgtgtctatgtgtctgtctgtgtgtgtgactttgtattactctgtgtgtctgtgtgtgtgtgagagattgtgtgtgtgactgtgtgagcatgtggctatgtggagtgcaagggcctgtgtgggaatgtgtctgtgtatgactgtgtggctatgtgtagtgtgtgtgactgtgtagctgtgtggaatgtgtatgtgcaactgtgtgggagtgcatgtctgtgtgactgtgtgactgtgtggctgtgtgaagtgtgtgtggctgtgtgcgtgactatgtaaccatgtgtggctgtgtggccatatgtgactgtgtgaccaggtgtgactgtgtggccacgtgtgactgtgtgactgtgtgtgactgtgtgaccgtgtggagtgtgtgtgactgtgtaaccatgtgtgactgtgtggccatatgtgactgtgtgactgtgtgtgactgcgtgtgactgtgtggccacgtgtgactgtgtgaccacatttgactgtgtggccgtgtgtgactgtgtgtgactgtgtgactgtgtgtgactgtgtgaccacatggagtgtgtgtgactgtgtaactatgtgtgattgtgtggccatatgtgactgtgtgaccgcgtgactgtgtgactgtgactgtgtggccgtcactgttaccacatgtgactgtgtggccctgtgtgactgtgtgaccgtgtgtgactgtgaccgcgtgtgactgtgtggccacgtgtgactgtgtgactgtgtgtgactgtgtaaccgcgtgtgactgtgtggccgcgtgtgactgtgtgaccgtgtgactgtgtgactgtgtggccacgtgtgactgtgtgaccgcgtgtgacgtgtggccgcgtgtgactgtgtggccgcgtgtgactgtgtgaccgcgtgtgactgtgtgaccgtgtgtgactgtgtgactgtgtgtgactgtgtgaccgcgtgtgactgtgtgaccgcgtgtgactgtgtggccacgtgtgactgtgtgactgtgtgactgtgtggagtgtgtgtgactgtgtaaccatgtccaggcagggtgtgggagtggagagggtacgggacgggagctgcagacaacatccgagccggctgaagcccacagagcaggccccgtgttggggggaagttggaatttagggagtggtgctggattctggacagtggatgacccgatgctgacgctggcacctgatcactcacagccgccaccaggcagcatccagagcctccagcgttttcacccagtgggttgctgctgctcagcagtcagggggacaggttgtttcttcctggtctcaggccacaggacccctgaagaggagccccgtcctcagacccctccaggagccagaagtgtttcttcttggagaggtgaggggctgggcgccctctcaggcagtgcccagggagaagcaccggcgggggctggagccaccacctcaccgcctgcctgccccctcctcctctctcaacgtccagtctgcagggcaacctgcaattcacaacggccgctgcctggcctgggagctctgcagtgccttctgctggaagtgccagccgtgtccgccctgcactcgctcccagcacagggcagaggcggtcgcagagctgcatgatctacttttaagttctgtgaaagtccttctgcagtaacagttcatgcgctggccacgatggcagcaagggcagctttaagttaattcaggctgtttttggaacaggctatggggtcttgaaagcttcttcaccgccttcactccccacacgctccctgtcactggctgaacatcggtgaagagacaaaactgtgaacgaggacattatctaaagtgcagagccccacatggtgggaagctcaaatgctcactaacaggtcggccttccttttcctgatggtttttcaaacttaccgtattgtacgtggctttaagtgaaacttgagtgaaggatcctccccttcccaccccacccgcaggtgatgattttgaaaagctcccccaaaggaaccctaaattagtcttaaacacacacacaaatctatctgaggcagggaaactgcccattaagggccagtaattacccgaggctgctggggtgcctgcctggaagggcccccaccacggggcctttgtgcttcctggcctggcggactctgaggctcatgcattattcaggagcacgtgggacaataaggaagccttccatagaaagagaagcaaagctgggggtaaataaaggttgcttgagaaacactactattttttctacatttatgaaaatattgcagcgttcggggtgctggggacgtcctctctggttatcaggagaacaccctggattctgcgctttccttcctgcgggcctgcagcctgcaggggcccacaggacagcatacagtacccggggactgtgtcttttttcctccctcctctccctttctctcccccataatgcaaagctttgtcaagctaatactttaaggatcaacatcaaaattggaactttctctttctatagccacatccaattgaaagtatcttagacctcccagtggcttccctttcggggaggcctggctgtcagagcactggaaccatgcatccattttaaataacaggaaggtccccaacccatacacaacattagaaacggcattatttgctggcccctttgtgcgtggggctgtgaatcggtgctgctgcatcacatggtcaaaccaggcctcccccacacattcctgctttatggggtcatttcagcgcgctccaatcagccgcctcgtccacctgaccatctcttgattactgatctatctgctcttattttccctgggggaagggaggagatttaaagtgcaaatggtacaaaaggggctcaaatgccgctttgtgtgcagattcaggagacttttttttttttttttttttttgagacggtgtctcgctctgtcacccaggctggagtgcagtggcatgatcttggctcaccgcaacctccacctcccgtattcaagtgattctcctgcctcaacctcctgagtagctggaattacaggcaggcaccaccatgcccagctaatttttgtatttttagtagagatggggtttcaccatgtcggtcaggctggtttcgaactccagaccttgtgattcgcccacctcagcctcccaaagtgctgggattactttctcatctggcctcacaagggcacgttaagaatcctgtgcccctgtctccgccacagtgcacacccagccctttgatttcagatcagagggaatggaatctccaaggaacttcacataggaaacccaacagcaccaaatgctttctaactattcttgggaaagaggcaaggcacaagtaaattaaatatattaacaagtcggagtaaagggtagagtgattaggaatatcttcctcagagaagggatgtgacagcccaatccacaccgcagacacagatccattggacccggcctcctcccatctctaaagtcatgctctgtgaacatcgttatgacagtgaaaaccacgacttttcccctgtaaaattaaatgtcactcttgatagcataatatctgaaacatcatcttcccaagtccacaccaatactttacacagaaaattaaactctctctgtttattgagtggataatgtagccttcaaatgtgtgagaacccctgctaggtgagaaattacaaaagctgtaccataaagcctaatggtatgtatgaaatacacaaaaaggtaacctaattggtaatcagaaatcataaaactaatcatgcaattaatgtcttcaaaagcaagcatttgaggtgtgtataattacaagaaaacaatgcaatggtggtttccagcattaatgaattaattgtggtggtaggggggccggcgtgggggtttatgggctggtttcagtccatgcccactgcctggctgtgcgttctctgccttcctccacctggagctcctcagcaaaggactgtgcctctgagcctcccctggagaagtcaagaggtcccctccttccagacccaacttccctggccactgactgtcgggattccctgggggagggcaggtggagagacggctggtgcagaaaaacacagaaggcccagagccgctcattgagtgcaggtgtcggaaaaaaatttgggaacacacattaacctacgcaactctcttgctttctttccagcgtgccacacaatatcatgatacttacggttctatgattcacactcgcagtttcgaaggaaacctctgctctgtgctgattattccaggaccaaggcttaatgcgtgggatgttaatttgctgatagaaaggggaggaggaacaggtcggggctgcatggcattccttccagacaactggagcaaacagggctccacattggggtcctttcgatgtggtgccgtcaccagtgccaccccactgcaggcaccgggagctcttccacggagaggaaaggtgcagagaaagactctgaccccctgcacggaggagggggcggcgcaggcccctccacgtcatcggtgtggaacgcaggcccctccacgtcgtggatgtggaacgcaggcccctccacatcgtgggtgtggaatgcaggcccctccacgtcatgggtgtggaacgcaggccttttgaacataggagtgtgcaagccccacacacaggaggtggtgtgcagcacgtgtctctgcaggaaagggaacaggagggactggccttggcgggtggtgagacggccacacactctctgaaggagattctacattcccacttctctgtagaagccgtccaggccccagccccatccccagcctgcaccctccaggcagctgaaggcctgggcacagctagcgaggccactggcatgtgggagatggaggacagtggggagaagaaagaacactagagctgaaattcgaggaagaaaccggacatctggggcagaggaacgacccaaagccactgaggaaactgccaggtgagggccaggaggagagggtgaggctgacacggggacaggagcccagcgtgaccagcctggggtcctgaagcaatgctctagaaagagaaggccttccacagcacgaccccagggtggtgatgagggcacactgctggagatgaagaaagcattattactcctccacttctagtacgagaggcttgttcacgtcctaagttgctctgtgttcccggcaacgtacccggcactgagttctcaggactggtgcaggtcagcggctccgcaggggtgagctgggcgctgcctgcatctgacgagatagcagtatgttagcatctgtggtgttctgtctaccgcagagtcctgtgagcctccgggtgctcgtgtccgtgcactgtgacggcctttgtctcttttgttttgttatttcaggggcgtttttcttattctggcctgtgggaagatgccctggagccctggacactggttttccagcaaaccctacagatcggttgggatccacctggtgacacctgccttatcttccagggtttgcccttggtgtagagatagacaaagggagaggtgagcacaaggtcacagggacgcagccctgacctcacgttggtccacgacgggcagagagcaacttggatggctgcctttgttgtttttcaaatggactattttattcctagaaaaagatacacaggctaatgtaatgaatacactagcacccttagccagctgtaggaaaaaaatgcatggcagatactcgatggcctttctgtcctccctgcaccacccagaggacatacacagagtgatccgccctcttttccctggtgaatcacgcagcctaactcaccatgttcccggccacgccacagtgaatcacgcagcctaactcaccaggttactggcctaactcaccatgttcccggccataccccagtgaaccacacagcctaactcaccatgttcccgaccacaccctggtgaaccacgcagcctaactcagcatgttcccggccacatcccggtgaaccatgcagcctaactcaccacgttcccggccacacagggccaagaacagcccaggcaatgttaaggagcattgcatggaggagccacttgcagatgcggtaacccactgtgcggcacagaacctccccgcggggcaggtgggtgcacaggaaagaaaccaacatggagctgaggccccagagaggtccctgtgctcatgactcacagagacggggacggcagcaaggacacagcagggccatgggcagaggaaggacaagcaacgtggggccatggggagggacggaagacagaagtggatcccggctctccacaaaacacaaaaattaaccccaggcagattaaagcctaaatggggggaaaaaacctgtaaatgttttgaagaaaacatttgagcctctctgaactcagggcagaaaacagtttcctcaaatcctttcctcaaacaacacaaactacggaggaagggagtggtaaaatttgatcaaatcaagtgaagcagcttctgtgcttcaagaaacactattaaaaagtgggaaaaggtgggggtgagccacccgccaggaagcgagattcacggcacctctgtcagatgaaagggctgggtctgcgtccagccaggcaatgaagatgagccgccaatattctaggaagaaaagcgggggtgggagtcaccaaaacaagtcttctgaaaactggccaaggtgtgatgtacgtttgcatcctaggaaattaaagaggtaaaaaaacccatctggaaaaccaagagctgcttgattctatgaacctaagaacagtccgtttctccttcagagacgtattgagagaactcggtatcattatgaaatctctcaggcctccaggaaatgacgctctaaaaatgcaaagctctgaaccaaccaccgagaaacaccctttcccctcccctgggtgatactaagctgctgtggggcgtccccacaattttggggccggaacggagggggaacaggcaccagtttgtcactgccctgagtgcgctgccccaacaccctgcctgctgctgtctgagagaaaatcgtgtcatggatcatcatccctgtgctgcaggtgtgtctgatgtttacagagacctctctcgctccatcatgcgtgcccgatgtctacagagccctctctcactccatcatgcgtgcccgatatctacagagccctctctcactccatcatgcgtgcccgatgtctacagagccctctctcactccatcatgcgtgcccgatatctacagagccctctctcactccatcatgcgtgcccgatgtcgacagagccctctctcactccatcacgtgtgcccgatgtttacagagccctctctgactccatcatgtgtgcctgatgtttacagagccctctctcactccttcatgtgtgcccaatgtttacagagccctctctcactccttcatgtgtggccaatgtttacagagccctccctcactacatcatgtgtggccgatgtttacagagccctctctcattacatcttctgtgcccgatgtttacagagccctctctgactccatcatgtgtgcccgatgtctacagagccctctctcactccatcatgcgtgcccgatgtcgacagagccctctctcactccatcacgtgtgcccgatgtttacagagccctctctgactccatcatgtgtgcccgatgtttacagagccctctctcactccttcatatgtggccaatgtttacagagccctccctcactacatcatgtgtggccgatgtttacagagccctctctcattacatcttctgtgcccgatgtttacagagccctctctgactctatcacgtgtgcccaatgtttacagagccctctctcactccatcaggtgtgcctgatgtctacaaagccctctctcactccatcatgcgtgcccgatgtctacagagccctctctcactccatcatgcgtgcccgatgtctacagagccctctctcactccatcatgcgtgcccgatgtctacagagccctctctcactccatcatgcgtgcccgatgtctacagagccctctctcactccatcatgtgtgcccaatgtctacagagccctctctcactctgtcatgcatgccggatgtttacagatgtttacagagcgctctctcactccatcatgtgtgcccaatgtctacagagccctctctcactccatcatgcgtgcccgatgtctacagagccctctctcactccatcatgcgtgcccgatgtctacagagccctctctcactccatcatgtgtgcccgatgtctacagagccctctctcattacatcatgtgtgcccgatgtttacagagccctctctcattacatcatgtgtgcccgatgtctacagagccctctctcactccatcatgtatgcccgatgtttacagagccctctttcattacatcatgtgtgcctgatgtttacagagccctctctcattacatcgtgtgtgcctgatgtttacagagccctctctcactccctcatgggtgccgtatgtttacagatgtttacagagccctctttcattacatcatgtgtgcctgatgtttacagagccctctctcattacatcgtgtgtgcctgatgtttacagagccctctctcactccctcatgggtgccgtatgtttacagatgtttatagagccctctttcattacatcatgtgtgcctgatgtttacagagccctctctcattacatcgtgtgtgcctgatgtttacagagccctctctcactccctcatgggtgcagtatgtttacagatgtttacagagccctctttcattacatcatatgtgcccaatgtttacagagccctctctcattacatcatgtgtgcctgatgtttacagagccctctctcactgcatcatgcgtgcccaatgtttacagagccctctctcactctgtcatgtgtgcccgatatttacggagccctctctcattccgtttgatttgcaccactgctgtgagatgggcaacagttcctggctttacaggcaacaaaatgctcccaccagtcaatgaagccacagagcttgccaggagtgaatggggccccacctgacagaaatgacggcttccgcgggatcccatgaaggttctgtaagccagagctgaagtgagtggggcccctgtccgcaggctgccacctctggcaggtcgtccacaggaacgcttgtcctgaatggtggcccgcaccctgcagtgagcccacggctatagtggtgcagccagcagccccgacgcctctgcagtcccagacccagggaagccccgtgtgcaccacggtgtgccctggaccactcacttggccgctgccaccctgggaggatcacaggggctgccttctggacatatgtcaggctctcactgccccagtgagaggactggctctggtcctgatccacaagctctgaaccaatagcgggtcttgggatgacgtctgcggagcccctcggtcccagcgtggctggcgtccaggaccccagcacctctacacccaggtccttctcagttcccaccggccgggctgacgctggtctccagggtgatggagctgattcttcgggtttccctcagctcagatcaaatttaacacagcaagaggacacccactgttcccaccgaagaggcagaaagctggagttcgcggtgcctttctcccccaggctgggatggaggaggcagcatgaggccaccgtcattcccagtgtgtgagctggggccatccggaagttgcgattcatgtcagacactacggggccgaggctcatgtgggtgtgcgtcctctcagggtcacacctcagcaaggaagctcagcagaaggtctcccaggtccctgagccaccgttcctctgactgcttgtacccttcccgagatgctgctgcagccccacgccactcagagtgaccagcctgggccaacccctgggttctgacaagatgtgctgtttaggactaaattcagctgcatataacagaaaacttctgacaaggttggtgtgaacacctgaggcttttcttccctcccacacaaaacccatctaaatgggcagtctgggtcccgcatcctggccagggacatttacgggaaccacatcagcctaggatccactatccaggtggccgtcatttcccatcaagaagcctttctgcccagagtactgtacagccacagctcatggccaggtctcactcagtgaccacatctaagcacaggggaggccaaacgtgttattttagctaaacttagggttcgatcaccatggaggaggggaagacggcacagacccttcaccgctggccctgatggcagctggggcccgtgtgtgccgtgtcctggggacgacatgagatagccaggctccccgtccctcagggatggtcttccaaggattggagcatcttacacgttttttatttcagtttaaaccactttctactcatatgcttttggtttaaataaattgccagataaaatttgcttgaaaatcttttatgggaggaaaagagaacattcataacaaacagagctcaggttatcccctctccacccaacaccagcatttccaggcctttgaggaactggggagaaacatgatgtggtcagattccaaatttccgaagtgcggagcctcaggctcacataagggatcccaggtctccaaatttccgacatggggtgcctcaggctcgcgtaagggatcccaggtctccgaatttccgacgtgggtgcctcaggctcgcgtaagggatcccaggtctccgaatttccatttccgacgtggggtgcctcaggctcgtgtaagggatcccaggtatccgaatttccgacgtggggtgcctcacgctcgcataagggatcccaggtctcccggggcctggtgtgtgcaccacagactacatattccacaaggaagctgtgagaaagaagcacagacagtcctgcaccatctcacatccaccaaatccagaattctcctttctcaaaccatccacagactaacttattcagctccccacaatatgagtctgttttgaggccagggggtgggtcctggaccctccaattccttgacagacaaaaggtgtagaatagcctgggattccaggttcctgggagtcctgcagggcaggtgcaggctggggcatggaggcggaagcttcttcacaccacaagcggccacggtagagttgacgggagaaaccaactttaaattcatgcaggatcaggaatgctgtgccacatcaatgtgtaaaatacaatcttcatgtgggagaacgaatggtcatctctgaaatatgctttgcacattaggatttttcagatcttccctattcttggtttacccaaagcaaagcgagttcttgctggggtgaagggtggaagagaaaagcagcggaatgggcgggctgtcgaacaaaaggcggcgagggaggtaccgtgcagagcctgctgggccttctgtcccatggccccgcacaccggactcacccagcctccagccgctcctgtgcctttctgcctaataaatatctgtgataattaccaacccccaaaaagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgcgctttctttaatacaaatatagtctgatggaaagtctctgaaacccaacctacggaggcccctccctgtcatctcctggtgcatggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaacccctgagcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaacctctgtgcagagccttttgtgttgaaaacgacaccttcacgttatcagccttagaggcaggtctgtttgcagcggtgcccgctgaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcattaaataacctgactaaaaaaagtagaatgaggttcacttccatggaaataattttattaacaaaattcagaagaccaagctgagaatggagatctgcatgttttaatcaaatgctttctaagccaagtctcctaccctctaacagacgaccatttttaaattgaaagtttaaataggttgatcttaaaaacacattcaatggtgaaggagtgtgtgtttaaaataaaagtgtttatatttttcagattttgttttctcctgcttccttaaaaaatacactggccgggtgcggtggctcacgcctgtaatcccagcactttgggaggctgagaagggcggatcacgaggtcaagatgctgagaccatcctggccaacatggtgaaaccccgtctctactaaaaacacaaaaattagctgggtgtggtggtgggcgcctgtaatcccagctactcgggaggctgaggcaggagaatcgctttaacccaggaggcagaggttgcagtgagccaagatcgcaccactgcactccagctcggcaacacagcaagtctctcaaaaaaaaaaaaaaaaaaaatactagcacagtggaccctgaagcgccagcagcaaaccctctgagatgtgcgtccggagtggccatgccaccagctttttctgcccactgttttggaaaagtgttgattttggaatgtggtttcccatcactgtgtggaccatgggtgaatggggagggtggatggtctctggggccgtcctctctccgcctccagatcagcaggcagtggatgggtatttgggtctttcttgtactcacacggatgcgatgtgtgattcctggtaggaaacaagaagcagctcactggcaacaccacactgccccttgcattccgaggagtcatgtagtcatgaggggcatgagcaagatggagacccagaggctcacgctcacatgatgacggccgagccgggcctgcaacggaaaggcctgtggcatggggtaacttcagagccttcttctcaacaggcacggcccgcagagccactggaggtaaggatcctctccagccagggaggaagcatcccgcaccgtgcccactttaaaccctggagaaccatgtttgcctctgtctggccctctccccacccccccacctccctttgccgtcttctttgtgtgtaacctttgtgtacaggctgaagagaaaagtcccaaaatccagcacaagccccgtgaccctttctcccaggcccacggtcttggggcactttctcagggcctgaccttggagcagacaagagctgagcgctcaggaagggaactgtccgaggagcctcctccacggcggaactggtgcatcatgtagaataaccgagccacacgtgcggagatgctccacgccccactgcccgtaggtctgagggagatactccccgtgttttgggatgaattgagttccccaaattcgcatgccaagccctaagcccagtacctgtggacgtgaccttatcggggaatagggtctttgtggaggtaactggctaagtttcaatgaggtcattagggcgggccctaatccaacaagacgggggtccttatcaaaggcggagatgcggacacggggcagccacagggaacaccgcgtgaagacggagacggcacccacaagccgaggagagagatctgggacagattcttctccgagggcctcagaagaaaccagccctgcccacacattgaccctggactcccagcctgtgagtggtgggcgatgaatctgcggtttgcgccgccccgtctgctatgctgtcacagcagccaaggccactggctctgtgcatttccctgcctccgcctccctctcccatcactgacgatgcagcactgactccctggacagggcctacattgggtgctgctgatggcgagactgtcatcccccgacatgaaggcaagggctgggctcagaagcctggataccgtggctgcctctgccccaccctcagctctgggacaaaccttcagtcccagcctgtctgcccacgtctctccagctgtgcaatcggcacacccacgtccacgtggctcctcatggggccaaagagcagccgtggccaggaaagcagtcagagaggcccagggttgaacccaaggtcactgcccttgtggttgagcaaaatgaagacagttcctcttcttaaatccggctctgtgcctatgaagacggaagcagcagcattccgcttgcaggtttttgaaaaaacaaatggggcaagagaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtatgcatcggggaggctggctgtgctgttgcagggatgtgtgtggggctggatcggggaggatggctgtgccgttgtaggggtgtgtgtggggctggatcggggaggatggctgcaccattgcaggggtgtgtgtggggctggatcagggaggctggctttgctgttgcaggggtgtgtgtggggctggatcggggaggatggctgtgccgttgcagggatgtgtgtggggccggatcggggaggatggctgcacggttgcaggggtgtgtgcggggccggatcggggaggatggctgcaccattgcaggggtgtgtgtggggccggatcggggaggatggctgcaccattgcaggcgtgtgtgcggggcttgctgactctcgtgctctgcggacgcccagggagcggccccaacccacgcgccggcttctcgagctcggcctcttaagtgacagactcaaacacctgagcaacaagtttcctggggtcacctaataacgattattttaacaacagtttccaaacaacaaacaaacccatggagcacgaaacctctggggaccttttgaagctaaacgctgagtggtgccgcttcttggggagctcaaggccagcagggtccctcctacagcgaccctggacagtggtttggggattcacttgatacaagtaattctctaattaggataatctggatgcggcctgctgtgatgtagtgatggggcttccctggaaggggggatgtcaggaatagccctcactgcatagagcacatcccggcgggagcgttagagctgagggatgcctgtggctgagccgagggagagccggagccaggaaagccactgattgggcccaggggggcggcgatacaaagtcacttttagaggatgaggaaaagatgaaatgaacatctaaaaactaacgccctctatgatttaatgaactttcctctctctaaaagtactctggtgattatttcagggacagccacccaactgcacggcaccatcattttttctgatactgagttgatattttgccctacaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacggtgggatgtcttggatttttatgataataatttcagtatatgttcaacccatggaaacatttcatttggaaagatgtgaagtgggttagaaaatgtcatttccatgctttttagagtcgtgactgtggatgactttataggagacccagttgtctgaaacatttcacacggcaatgaaactatttccaaatattcattttcaaaatgtgccacagctggctgttttttgttttcgcttttcaagcacacacattttctcacacacagctcagatgtctattttacactgaaggtttattttactggggagtgtttgctggggcgtcccgttcccaccacaggccggtgcctccgaggctcagccttcaaccctcttacatgagtttgccgcagacaaccagcaagccgtgtgtggcacacagttctactggtttctcctggctttattacaaaatgtatcacaaaggttaactcacagtagtgcaaaggtctcatttttataaaatggataaagtgacaaaatacattaaacatacaaaattcacttcttgcacactgagcttcaggtccttgctgtgctgcaatgatgtgtggggtggatttcatatgacctgctggttccctcacctcacccagaatctttttcgtatgtctgtcagtcaaagtggtcacttcatccatagttattccaatttttaaaactttttttgacctgttaagtattgcttagcaatgagtgtacaccaagaaaggtttgaacaacctgtacattcacccaactgtgtagcagacttccacggctcatgatttattctcaaatttttctccaaatttttagcagcatcttctatttatcttccaagcattgctgacaagggaggtggccaggtttgcaaagctgcagtgccatcagcttgggcgccatgagtgggagtcacagccggggccacagcacgagggcatggccatcggcattgctggtggagctggggatgctggagggggagggaggggaacgctggatggggagggagggggacgctggaaggggagggagggggatgctgcaggaggaagctggggctctgctgtgcccaacactgaagctgggcccgtgtggggcggagagttgatttcaccgttcctgttttccctcaagcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccagctctgaggtccgtgccctgagtagaaaagttcacacagcaaagtttccggagccttccctgacgcgccacgtgtccgtccataactggtcatcctccacatcctgtgaggcacgtctcagcacctcttcgtgcaagcgcccgcactagacgtttgagaaacagatgtgagcaggcgtggtcctgacctccatcccgaggttgggggtggaatcacaaagcaggagtgtctgccaggagcacgtgtgcccacacagcaggcctggccccagtggctcagatcaggaacagacacgtactcaaagacggcgggtatgagaaagccttgtgagggaagggagccctttgtcggggggcctgaaaagaaacacggcctttgctggttctctgagtcagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccgtcaccacccacactcctgcagggagagccccccagctaccacccacactcctgcagggagagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagccaccacccacactcctgcagggagagcctcccagccaccacccacactcctgcagggagagccccccagccaccacccacactcctgcagggagagccccgtcaccacccacactcctgcagggagagcctcccagccaccacccacactcctgcagggagagccccgtcaccacccacactcctgtagggagagccccggccaccacccacactcctgcagggagagccccccagccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccagccactgtacacactcctgcagggagagcccccagctctgcagcacagaccccagagacagcatgcggcttcgtgattcctgtggagcagagtggggacagcctgctatggagcagcagcccactgggggagcctcgagacttgcaacgacccagacccaattccctgaggccccagcctgtggtggcagggcccacagcctgcgatctctgcataccctggatttcagaggtcactgcagtcaggccacctgaggacacacacctgagggtggtgcccaagccaagactctctctagggatgtccacgtgaccccagagaagcagcccaccccacagtccacccacagccttcgcgcctctccaggagctgggccacttttcacacacaggatccacgtcttggttattatcgaacactcttggagcttcccaagactgcagttttaaaagaaatggcggagttggcagtatttggaggtagtaatgaattttcatctttgttctcctataggaacgtttcagagctgagtccacatatctaattgagtgctgtgtgaacgcgtttccacgctggaactagataccactccatgcaaatctcatttctgttctttaacgatgccttttaatatctaatctgggccttaatatctcgctcactaaacgtgttgagataattagatgatagagctagacaattactctgtgggtagagagcagacagtttcttatatttatacaaatacacatagttaaaatgaaacagaactggcagcattcacggtccgtccaaccagggaaggccactgacggccggggctggtcagctcaggcagcagctggccgggtgcatttctatttctagtttttcacggaactgaccaggcaattcagtcagtagctgtcaaaactggagtccagaacaggcacagatgggctggcccaaagttaattaaaaaccaagaagaggataaagaaatgtggcccagtccagggagctgtggagaggtggggggcagggtgaccttctctttcttgtgggggttggaagaggaaccccacggcacagcggacaccatgtgggaccccagcacgggcgctttgggatgtcggcagaggcacgcatgcctccagggatgtgccagctcagggaggcaccctgtgcgtgctccatggtgacactgccccacggggtccaaatgctgaattcctgtaccttttacatacgtgaagtctatacaataatggaaccgaagccctctgtggggaatccgtgggaggatgagaggcctggattgcaccggaagcacctccggctggagctcggccaaggagcccgggtcccttcagtctgcgctccctgcggtgggcagtggcttctgtgttttgccgtcgaggtgcaacatgcagctggtgatgccctgtggcatctgcctcctgccctcggacatgctggcccgccctccctgagtcttgcagggcccagccgctgtgcctctgtgtggcctccccaccttacctgcagacacgctccctgtactcaaagccgagctgtgtgaggcttttggggctgccagaacaaaggactccagacggatgggcttgaaacagtggatgcctgcagtctcacaggctgggtttggagaccttgcttggaggtgtctgcagggccttgaaggggacaccgacccttcctgactcccagcctctgcgttgccagcagccctcggcccacagacacagcgcttccctcctgcctccgagccacgcagacggcttccctctgcatgccggagtctgtcctctccgtcgcagggacacggatgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgctggagtttgtccttcctgtcgcagggacatggccgcatcaaggacctactgcagcacggtgcctccttcaccaagcgaactgtgtctgcaacagtcctatgtccacggaaggtcccattctgagctgccgaggtccaggacttcaacatatctttctgcggagacagttcagcctatagcattagctcatgtgccctctgttaggaagttccctgacagacttgagcccacggctaggggattcccttctgaacacagaatgtcttgcttatttcacacgtgtgctaatttgctgtacaccaccggcttatttaattgttgtgcatttattgtatttctccactagattatttactaactggggtcaggatccatgactttttaacattgatattcatctctctttttagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaaaatgggagtcaaatgcacctttgtggtttcttttccttctacacaaacaccacttgagtgaggcccgggttctgcaaagggaaagtagtcgtcactttctaggccccaccatgagccggggctcaaatcccatcctggcctgctgggcatttgtttcatcaattaagagtcagtgagcaggaaacaacattgcatattcacacaaacacacgtgcatatccaaatacacatacacacacatgcatatgcagagttatatacatatataagcacacacatacacatgagcacacacacgtccacatgtacacacatacatacatatgcatgagcacacacacgaccatatgtacacacacgaacatgcacgatcacacccatatccctcgtgtacacacacacacacatacacacagtgctcatgacctactaaacagcgcatgtgcctctcagcccttgccatgacaaccatgaggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccctggatacacggccactaccccgcccccgacgccctggatacatggccaccaccgcccccccccgacgccctggatacacggccaccaccccgcccccgacgccctggatacacggccaccaccccgcccccgacgccctggatacacggccaccaccccgcccccgacgccctggatacacggccaccaccccgtccccgacgccctggatacacggccaccaccccgtccctgacgccctggatacacggccacctggatacacggccaccaccccgcccctgacgccctggatacacggccaccaccccgcccctgacgccctggatacacggccaccaccccgtccctgacgccctggatacacggccaccaccccgcccctgacgccctggatacacggccaccaccccgcccctgacgccctggatacacggccaccaccccgtccctgacgccctggatacacggccaccaccccgtccctgacgccctggatacacggccaccaccccgtccctgacgccctggatacacggccaccaccctgtccctgacaccctggatacacggccaccaccccgcccctgacgccctggatacacggccaccaccctgtccctgacgccctggatacacggccacctggatacacggccaccaccccgcccctgacgctctggatacagggccaccaccctgtccctgacgccctggatacacggccacctggatacacggccaccaccccgcccctgacgctctggatacacggccaccaccctgtccctgacgccctggatacacggccaccaccctgtccctgacgccctggatacacggccaccaccccgcccagactgaagggtgacaccagaggcaaaaagagtgaactagattcacgtaaatcaacatgaataaacttcaaaacagaacagatggaaagactggaaaagtccacgcactaatgttcattcaggcagaaagagtgagggtccctcccagaatccagtccagggagactccttctcttcctttctgcatgggcccgaggagctggtccctagactgctcagatccaatccacagtccgtgagcaaagggccgcaggcgtggtggaggtgtgcccaggcccagcatgcccccagagtccacaagagcaggactgggggcaccgtgcctgcgccagcccaagctgcccagacttcctctggacagcaggcctcctgagccctggagattaactcactgccgcaggtaggatcacctgagtcctctaggaacccagcccgcatcctgggcaagaggcccacatgcaccttagaaagggcccgaaacagttcacgagtggggtgtgggctgtgggtccagacacagttatcctaaggccaggcacaggaagggttcctttcccgatggctccgacagcccagtggtgcacctacaactgcttcccatcgaggtggtgggctgggactcggcaagcccatctgaacagggctctctgcaggcagccccaggcctggagtttgccaagtgatgagttttcctgtctgagcttgtttccatcatctccacgatgaacgtaggacaccaggacattggatctctgcggggcagcagctcatggcccagctgtaggaaagcagacccagcctctggattaaaaccatgcctggaggaaactggccttgtgagtgtcagggctgcgctgctgtcttccaggtcctccctggtttaatttagcaaaactaccaatgccaagaactggttaaattttttaaagggaagaaagtatgacacatggagaaaaaggtgcagcccatttcccagcctgaggactggccggggaaataactctgagccctcgagatgaggggctatgccttcccttgctcactccctccctcacccacctgcccactcgcccatccactcaacagcggtcgttcttcattgtattgtgagctccctctgggctgtgcactccgggccatgcgtggctggtaactgggaaatgctcgacatggaaaattctgcttgatcatctgagatgccacctcagtcttggggaactcaaggccaggagggtcacacaacccatttagcattgcctagcaccagtggtgaggccaggcctcccgcgccctccatctttctgccaccacagtcgtttggggactcagttccatgtagaaccagatgaagattcataaaggccagtgggataaagacttcccaatgtcccgaaacaccctgacacgtgtaattccaaatctgtaagtactaagttttaaaatgcgtgtgagcaagtcaaatttctgatgtttccctggatgacaagatgttttctttattaaaatatcaaggtctttctacaaatctttcctgatacctcaactttgccagggtcctaagcgtgtgcttaggtacttgcagagcctcccagcatgggaggtctgggtagggccttggaggcctgctgggaggtctgtggactccaggccgctcacttatccccatgcatataaaattcctagggataatttcatttgatgacagagttacacttaatgccaaagtaaagaaaaagtttacatttttcctgagttagcagacaaatataaggggacttcaaaaagttcacagaaaaattggattaaaaggtaaaaataaaaatataaactttatttctcaacataatctccaccagggccaagacacttttgcaagggatcaaacccaccatttagtccattcccaaggcactgaggaccttgggaatttagccacatcaatgcagtctttttcccattactatctaaggaaaaatgggtaccctctggatatattttaagaatggaaaacaaaaagaagtgagaaggagccaaaccaggactgtagggggatgcctcatgagttctcatcggaactcttgctaaattgcccgtgtttgatgagaggagtgagctgaagccttgtcctggtggagaagggctctctggtgaagctttcccaggcatttttctgctaaagtttttataactttctcaaaacacccacataataagcagatgttatttttctctggccctccagaaagtcaacatgcaaaatgccttgagcatcccaacatctactgccatgacctttgctcttgatcagtctgctgttgcttcgatgggaccccttccgcctctcggtagccactgctgtggttgtgcttggtcatcaggatggtactggtaaagccatgtttcctctcctgttgcaattcttcaaggaaatgcttcaggatcttgattccgctgttaaaaatttccattgaaagctctgcccttggctgcagctcatctgggtgcaatggttttggaacccatggagtggaaagtttgctcaactttaattttccagccagaattatgtaagctgaaccagccgagatgtctatggtgttggctgctgtttctgctgttaattgttggttctctccaattaggatataaacaaggttaattttttccttgcaaattgatgagggggtctgccactataggattcatcttcaatatcatctcattctttcttaaaatgagttctccatttgaaagctgctgatttctttggggtgttgtccctataaacttttcataaagcatcaatgacttcatcattgttccacccatgtttcaccacaattttgatgtttgttcttccttcaattttagcagaattcatgttgctctgataggggctcttttcaaactgatatattctcttcctagccttaaactagatcctgttcagacatgttacaacaagttagtatgagtttattttggtgcagaaagatttttgaaatccatgcatagttttccatgatccacattttccatggaccttcttcagaatctcttccataacaagcctgatggctgcttggggtgctggctgaactcagagtaatgcctgtgagccgccaggaatcctgctctggggccaggagctgcatggcctcgtgccagcctcccgcacctgcacccccaccttgatcccccagagcacctgggttgcgtaaggggctgcacaccacagtcatctgtttcttaaagtactttgatgttgatctttctgtgagactctggaagtggagatagctttgggtttattgggcgttcgatgttggggattggatggcctggctcagagatgttgaaatgtccccgacctgaaggctcttgcagtgctggtgctgggggcgctaggccatgagctgcacagctggggtaggggcctcagggctgcctggacttccttacgaagaagctggctcccagagcttccaaagttgacggttctgaactaggcaccaatctttcctcttttctcagctggggaggcccagttgctcaaagctgtggttctcaaagtggggtccccagactggcagcacccagggagcttgttagaaacacagatccttgggccctgcctcggaccccctgagtcagaggttctggggtgaaccagcaacctgtgtgtttacaagccctgcaggtgattctgatgcaggctgacatatgagaactgtgggcctgggggatttgggttgttctgcttatgggaaagggcaggcgtgacctctgagagaacttgtaagatgtgagagtccaaaagcttcctctaaattggactcaaggtcgcgttcatcggcagctgtgatgtaggaggcaccctaggtgtttgccaatggcatttgtctctattggccgacaccaccccagggcccctgaagagcaaccgggactcactggcacaacttcaccctcctccttttatttttttttgtaatacaaaggcttgaggtacagtattatttttggagggattttttcctattataaactagtaatgtcttagggttaacatttccctaacacacatatacacatacatacacatatgccttcccacacatatgcacacatacacacacacacacagacccctaaatacctacacacccacacacccacaaaaatgcacacacacccatgtctacacatgtgcactcagctccagaacacaggatgtggccacgcatacccagcacctccccacacacaaatacccagcgtccttcccatacctgcatacccagcactttcccacacacatacccagcgcttccccacacacacatacccagtgtcctccccacacacacatacccagtgtcctccccacacacacatacccagcgcctccccacacacacccagtgtcctccccacacacacatacacagcgcttctccacacacacatacccagcgcctccccacacacacccagtgtcctccccacacacacatacacagcgcctccccacacacacatacccagcgcctccccacacacccatacccagtgtcctccgcatacacacatacccagtgtcctccccacacacacatatccagtgtcctccccacacacacatacccagtgtcctccccacacacgcatacccagtgtcctccccacacacccatacccagtgtcctccccccacacacatacccagtgtcctccccccacacacatacccagtgtcctccccccacacacatacccagtgtctttcccacacacacatacccagtgtcctccccacacacgcatatccagtgtcctccccacacacgcatatccagtgtcctccccacacacgcatatccagtgcctccgcacacatggatacccagtgccttcccacgctatgtcctcacagctgtttcccctacccaatgcccatgtaactgtgtcctgacacttggtggcctccttggtttcccggtataactaagcactgagaggcgctcttgcgcccaggccgcctgtccaactggggcaggctccatcttgcaggaggtagaaggagggtgcagagtccctgaggccctcagtccacatgcccctccttggagtgtcccctccccgccctgtcagggctcctgagagtttcctcagcttcctggcggggtagaggggtgacgggtgctttctgtgtgggccctgtctgctgctgcctctccacagctccccttcaagggccacccatgtccgcaggccacctccccttgctgggagcactcatttcccaggtggtgcttgtcctcttcctgggacacttttctgtctgcactagaacttgacagaggaagccacaaagcttcctggccatggaaagtgggaactggccacggaacaggggaactgcccctggccgtgtatgtccctcacccgagccctgtctcctaggctctcgcttccattttgcactgagacctctgcctcattccctctgaccgggcctcttgcctgccctgaagtcctgcttcctcgctgcttgtgggagggggaggctccgactgtctctcctttatccaccaatgtttccgccaccagcgagtgctgagcaagtatctgttgaataaatgaatgtgcaccaggaaagaaagcagccgcctggcctgacctcgtctgaggctctggatgggatacgcttcccagtttgctcgcttccctggagaaacccccggagggccgcgccccgaggctttgctccgacgtgtgccaaggacatgtgctgggagcgtctgcaaggtccgtctcgccgtgggggccgggaggagaacgtaccgtcctcaaggtccgtctcgccgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaagcagaatttcctgcgctggtctctgggatgggcagagggccctgctttcaggtactgaggagagcgcagcactcggcatcacactgggggcacaggtcagcagggggcacctgggagagaagaggaggtggaaagcggaggaggagggatggacgaccagctgggcacaagaggggcttcagggcacggcaggagggccgtccggggaaagttgtttcctgtcccactgactttgacggctctaggtctgccacaactccggcaaagtcccaggaccctgagcagcctcgggaagagctctcgggacctcgggggagtgaggtggcccaggcctggcacagctcagtggtggcacgtcacatcacacatcttcagaccaggccttctgcaacgattctctggcctctctgctgctctgcctagctccagccttgtcctgcggaaggtgctgaagcggccctcagtctgcctctggcctccctctgtttccccctccacaactgggcaggctgctcccttcaccccaacactccatggctccccatggcctgcaaatcagatcacagcccctaagcctggactgcagtgctccacttggcctcgcccacctctcagcccattttcaacgtgacacacgcaggtgaagtggacctgacccagctcctgctttctgccccctcctgtcccctctctcctgccctgccccgatcctgcctctgcttctgtccacatggccccagccacagtgccttcctgccagccaaccatgttcacaaggaagttcatgtcccccttaactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaacagatgcccttgggtagacttgtggtctgacagccgtacaggaagtatgtcccaggaggagcccaggctgtgtcggggtcaccttgacttcactattttcgaaatgctgaattttgctgcaaagttttcctaaagggcttggaaacggtccagaccgtgctgtcctggaagtctcctgggggctccttcttcaaacaagagaaagctggggagtttccaggcgttccgtgagagccgagggagcgcgtgagggcttcctcctatcagcgtccgtattcatggtgggaggtggcaaacctctatcggcagtttctgataaccttgctccgggtcacacgttatcttcctgaagtggcagccacggaagctgcaattcaggcaccaatatcagaaaatgagtcattgccgggaacttcactgtgcagtcccagaagtcttaattccagcagacagggtgactccaaagggagatcgttccagccacttccaaggtgtctctttctccatctcttcttgcagccctgattgtggggccatggcctgtgcaggaggcgagcaagtgtgacccctggtggctgcagcagcagcagcaccttgggcctcgggggtcaggaggggctgagtccccaggtcaggcatccccaggggggcacggggctgcagagggtcaggaggggccgagcccccaggccaggcatccccagggtgggcaccgggctgcagagggtcaggaggggccgagcccccaggccaggcgtccccagggcaggcacggggctgcagagggtcaggaggggccgagccccaaggccaggcatccccagggtgggcaccgggctgcagagggtcaggaggggccgagcccccaggccaggcatccccagggcaggcacggggctgcagagggtcagcagggcaggtatgccttggccatcaccactgcagtggcctagaggtgttcctggctgtctccatctggggcagcacctgcagctccttggacagtgtcagaattcacgactccttgcaaacaatgcagtccacgctcaccctccctcctctccacgagacctcagtgccctggaccatggactgggtgcccgagtgggctcatccaagccctgtttttgtgttggtctcctgttgtgacccatcccctgctatttctgctgggcctgaggtaaggcggacagggctgaccctgaaggcaaagcatcctgggggccactcttctggaagcgaattcccagcatggagaagcctgaattaaccagcagcggccccaggacagagtctgtcaccagagcctggagacaggatgggtggctgtgtctaaagccacagcattttcttttcctgtggcaagttatccctttccttagaaaaaagtactgttggatgctgacaccaccacaaataatctagttccttggcaggtcctctcatgagtaaacggccctagaagacgtttctcccaggaagatgcacagacggccaaggcaggcagacggcggcaatcagcagcttccacgtccaccagggtggccttgggaagaccagcgcccccacgtggggctgggagaggccgcactgcaccccaagagtgaggatgggtcgggggcagcgggaatggtgctctatggggcttcacatggcccctgcaccccagggcggagaactttctaagagggaaggtcggggcagctgctgtgtgggtgccagcagccacctggggacagtgccagcacgggggcatgccgggggagcctctgggagccgcaggaggcactagggacacgcagctcgccggccctccaggaggacgacgttctgaaatgggccttgatgccctggacggcctcgctagcctttacccacaggggaaggtgcaggatgtggcagtccctggaggaaccccaggcctgagtgtggcaccagggtttcctcggggaccccatatctgagtgcagcaccagggtttcctcggggaccccgggtgcaagtgccatggtcagggtttcctcggggaccccggctccgagtgccatggtcagggtttcctcagggaccccagatctgagtgcagcaccagggtttcctcggggaccccgggtccgagtgcagcaccagggttttctcggggaccccgggtccgagtgccacactagagtttcctcggggaccccagatctgagtgcagcaccagggtttccttggggaccccgggtccgagtgcagcaccagggttttctcggggaccccgggtccgagtgccacactagagttttctcggggacccgagatctgagtgcagcgccagggtttcctcagggaccttgggtccaagtgccatggtcagggtttccttggggaccccagatctgagtgcagcgccagggtttcctcggggccccgggtccaagtgccatggtcagggtttcctcggggatcccaggtccgagtgccctacccagggtttcctcggggtcctctctcctcccctccgtgcaccccgcccacgtcacaaagaggaaggtgatgtctctggacccagcatcaaagcccgggtcttggtgggtggtgcagaaggtgttcctaacagtgggctggggaacagccaaccctccctgtgggcctcagagccaggtctcaggaacaggcactgcacagctgggagcagcagggacaggagaggagggagtctgctcagagacgtcttcttcagaaaccacattccccaagcccttcgccaaaatcatcaaaacatcccacgatcagctctgcttgaccggggagaagaggaacaggaaatatgtcaggggtgagattttaaaatgtgtgtgaatataaacattcagctctgtaacataattaacagcgccccaaggaaaatcccgcgtatgtcagtaggaagcgttcttgatgcggagcgaaggctacttggcggtgttccggctctctgactctgaagggcctgcccgtgttccttcctgaggctcagacaagcccatctcagctttgctgtctaggaatttataagtgtaagagagcaaagattcagttccccaaaagataccctcttggtggcctgtggtccacgggagacctcatgcaccagggatccccgtgctgggccggccagtgctcaagagcacggaccctgaggctccttaaaggggctggaagggtcagtgtgataccgtgcacccacacttactcaccgaggagctctcggattccgtggggctggaagggtcagtgtgataccatgcacccacacttactcaccgagaagctctcggattccgtggggctggaagggtcagtgtgataccgtgcacccacgcttactcaccgaggagctctcggattccgtggggctggaagggtcagtgtgataccgtgcacccacgcttactcaccgaggagctctcggattccgtggggcttgacgggtcagtgtgataccgtgcacccacacttactcactgaggagctctctcagattccatggggctggaagggtcagtgtgataccatgcacccacgcttactcactgaggagctctctcagattccatggggctggaagggtcagtgtgataccatgcacccacacttactcactgaggagctctcggattccatggggctggacgggtcagtgtgataccgtgcacccacacttactcaccgaggagctctcggattccgtggggctggaagggtcagtgtgataccgtgcacccacacttactcaccgaggagctctcggattccgtggggctggaagggtcagtgtgataccatgcacccacacttactcaccgaggagctctcggattccgtggggcttgacgggtcagtgtgataccatgcacccacgcttactcactgaggagctctctcagattccatggggctggaagggtcagtgtgataccgtgcacccacaattactcaccgaggagctctctcagattccatggggctggaagggtcagtgtgataccgtgcacccacacttactcaccgaggagctctcggattccgtggggctggacgggtcagtgtgataccgtgcacccacacttactcaccgaggagctctcggattccgtggggctggaagggtcagtgtgataccgtgcacccacacttactcaccgaggagctcttggattctgtgttttcaagcctgcccatgtgtaggaaaagcacagcctccatgagaacagcaggaacacaccccccaacacgcacacccaaacacacacgcatgcacgtgcatgtgcacacacacacactcgtgcacgcacacgtgcacgcacacacacacagagcaacgtcctgcagctcccatcttttctttttaaaatcatacatatttcattaagctccatgcagagtgtcttctgatttatggtaattgtcaacaaaagcaaaaacacagacaattttaaccctgcagtagctgggagttaaccggcatgaaatcatattttttttttcctttaaaaagggagggggctccaagcactcccttgcattaaactctgaggatgctgaaccaagagagacagtgtgaaccccagcattggtggctgttgtctaagaggcccatgccagaagcgacatctgatagagtggccacctcaccccacgtgagcccggcttactcgtggcctggaggactttgagtgagactaatttccatatcaaacccaatttagatgaaacgtctttgttaaaaaaaaaaaaaaaaaaagccagagcttcaatagccccttgattagattttcatctcctgagcagacaaatatgaatatttattaccatgaatgcatatttttctctttccattgctctgatcttgagtattatccactgctaatttttatgaaaatttgggcaacataatgttttcacataaactgacagtccttgagataatcccgttattgtctggttgaaaatgacagcttccgcttattcatgtgttaacgagggattaaatattgtttttcatccccgtaatctaagacggactggaaattaaaaattgaacattgtatattagcagggctctgaggaccagaatttgtttgcgttcacttagagacgatctgtaaattagcagcttcacaatcaggccctgtgatgttgctgctgaaggtagcatcataaaatgccactgacatttctaaaataaattcattactctacccgccgcacaccaaaatgaaaaggcttctatcaggaaatacatcgcaaaggaaaagacaacactgccaaagaagtaaaattgcaacacaagttatattgcttcaacatcaagaattttttagggtccccgtgctagagggggcaccggcagctcctgggaggtgtgagtcttggtcatcatgtggcgttggcagaaggaggaccctgtacatcctccctgcaaaatcacccaagggacccggcccataggcagatgcagccacgtccttctccagctctgagggcaggcaggccatctccacgctgagcatcgttgacggtgacacatttgtaccatgtggtaatttttactttattgctatggctggatggctcagactgaaccgtggatctgaagggtttttggacaaaactatcctattatccttctaaaaatcgcgctaaattttattcatgtatttattcattaattcactctccctgattgccttggtagaatttttcactttttaatttattgtttgatatggtgcaggaaaatggcatagatgtattcctctgaagctagcttgacccaatgctatcttttggaacaaatgataaaaaggcactctgagttaaatgagacactaacagggtcagagtttagagctgaattgagtctctccaaagtgcctatgggaagctctaatcccagaacttccgaatgtgactgtatgtggagatggagttgtctataggagtcattacggtaaaatgaggtcatgaggatatgtggagatgggggtgtttacagtagtcattatgataaaatgaagtcatgagggtatgtggagatggaggtgtttacaggaatcattacggtaaaatgaggtcatgagggtatgtggagatgggggtgtttacagtagtcattatggtaaaatgaggtcatgatggtatgtggagatgggggtgtttacaggagtcattacagtaaaatgtggtcatcagggtgagcctgatcccatgtgactggcatccttgtaggaaggagatgcagacacaggtgcacacagaggggtgaggacttgaggatgcagagacggcatctgaagcccaggagagaggccttgggagagaccagccctgcccacaccttgatcttggacttcagccaccaggattgtgagcaataaaggtttgtgactgaagccccccactctgcagtattctgttgtggcagccagagaggacgcacatggtcaacatggcaacaccccctcagtacaccctagacatctgaggccaagcccctgtgactgcagggatgcgtctctgcctacgagaaaggagaggatttcctgttttcgtggaacgttaagtccaagtgcttgtcaacagaagaaagttacttcttaagaatgttctttttgctttatgatctcattaaaaaaaaaaaaatagattggcacttcagtaaaagggtttgcacacacacaaccctaattagacttttaatagatcctttgtttcacaggaatgaaagtgaaggtaaagtttgtgcctgtaaactactaaagagctactagggcccagtgtctagggccctccaccatccatcagtttctaatgtaggagatgagaacacatcaccccaaaaatgactgtcatacatcagaacatgccaccccaaaaacaactgtcgaagaacagaacatgctgccccaaaaatgactgtcatacatcagcacatgccaccccacaaactactgttgaagaacagaacacaccaccccaaaaatgactgtcatacatcagcacatgccaccccaaaaatgactgtcgaagaacagaacatgccaccccaaaaatgactgtcaaaggctagaaaacaccactccaaaaatgactatcagagaccagatacaccaccccaaaatgactgttggagaacagaacacgccaccccaaaaatgactgtcagagatcagaacacaccaccccaaaaatgactatcagagatcagaacacaccaccccaaaaatgactgttggagaacagaacatgccatcccaaacttgactatcagagaccagaatacaccaccctgaaatgactgtcagagaacagaacacatcaccccaaaaatgactgtcggagaacagaacacaccacccccaaaatgactgtcggagatcagaacataccaccctaaaaatgactgtcaaagaccagaacatgccaccccaaaaatgactgttggagaacagaacacctcaccccaaaaatgactgtcgaagaccagaacacaccaccgcaaaatgactgtcagagaccagaacacaccaccccaaaaagactgtcagagaaaagaacacaccaccccaaaaatgactgtcggagaacagaatacaccaccccaaaaaactgttgaagaacagaacacaccaccccaaaatgactgtcggagaacagaacacaccaccccaaaaatgactatcagagaccagaacacaccaccccccaaaatgactgtcggagataaaaacatgccacccccaaaatggctgttggagatcagaacacaccaccccaaaaatgattgttggagatcagaacataccaccccaaaattgactgttggagaacagaacacaccaccccaaaacgactgttggagaacagaacatgccaccccaaaaatgactgtcagagaacagaacatgacaccacaaaaatgactgttggagatcaaaacacaccacctcaaaatgactgttgttggagaccagaacacaccaccccaaaatgactgtcaggacaccaccccaaaatgactgtcagggatcagaacacaccaccccaaaaatgactgtcggagatcaaaacacatcaccccaaaaatgactgttggagatcagaacacatcaccccaaaaatgactgtcagagaccagaacacaccacccgaaaatgactgtcagagaacagaacacaccaccccaaaatgattgttggagatcagaacacaccaccccaaaatgactgttggaaaccagaacacaacaccccaaaaatgactgttggagaagagaacacaccacccaaaaaatgattgtcggagatcagaacacaccaccccaaaaatgactgttggagatcggaatgcaccaccccaaaaatgactgtcagagaccagaacacaccaccccaaaaatgactgttggagatcagaacacgtcaccctaaaaccgactgtcagagaacagaacacaccaccccaaaatgactgttggagaccagaacacaccaccccaaaatgactgttggagaccagaacatgccaccccaaaatgactgtcagaaaccagaacacaacaccccaaaaatgactgtcagagaccagaacacaccaccccagaaaagactgtcggagattggaacacaccaccccaaaaatgactgtcagagatcggaacgcaccacccaaaaaatgactgtcagagactagaacacaccaccccaaaaatgactgtcagagatcagaacacatcaccccaaaaacgactgtcagaaactagaacacaccaccccaaaatgactgttggagatcagaaaacaccaccccaaagtgactgttggagaccagaacacgccaccccaaaatgactgtcagaaaccagaacacatcaccccaaaaatgactgttggagatcagaacacactaccccaaaatgactgtcgaaaaccagaacataccaccccaaaatgcctgtcagagaccagaacataccaccccaaaatgcctgtcagagaccagaacatgccaccccaaaatgactgtcagagaacagaacataccaccccaaaatgactgtcagagaccagaacataccatccaaaaatgactgtcagagaccagaacatagcaccccaaaatgactgtcagagaccagaacacaccatcctaataaatgtatgcctttttggcataaggattattttgagaaactgaagatataggagaagctctgaaaacaagttgattctcttctataagagagatctatgtttataaaggagtcctccatttgtaagggtggctcctctctgcacctggaagaggacggctctcgtcactggaaaccccatcaatgcagagggctcgactgagggtgcatgacaggccttgcccttgctgaccggcttctctggtcccctcctgtgttaatctgttctcatgctgctgataaatacatacgggagactgggcaatttatgaaagaaagaggtttaatggactcacagttccacgtggttttggggaggcctcacaatcacaaggcctcacaaggtcagaggcacatctcacagggtggcagacaagagagagcatgtgcagggaaactgccctttataaaccatcagatctcatgagactcattgactgtcacgagaacagcatgggaaagaccagcccccatgattcaatgacctcccaccagttccctctcacgacatgtggcaattgtgggagtgacaattcaagatgagatttgggtggggacacagccaaaccctatcacctcctcattgctcctcctgctctgtctcagcagatgatggtgctgaagcctgagtctacacacctctttgtgattgacccgtttctctgggtatggctcatggatgcaggaggtgcacatgtgaatccacttcggcttgtttatctcttgtgaatcggttttttgttacaggagtccacccctcgtaggaactcagaagaacagagacactactttttcttccccacacagagtagtagcttgaggccactggctcaagcaaaaggggtacctgagttggcctggatgctcagtggctgccctgataagtgattatggaaaatgtgatgccagggcggtctcaaggctggaacgacagcccccaccagggtgggcttggctccatgttcactgtctcgggagcaaggctgcccttacacctgcagcacgttcctccactccacagtgcccaggtgggcctgggctgggggcattggacacaatgcatcctggcagccacccaggcctagcctctccagggcacctgatgcccacctgggcagagaaaggcacctgagcagaagggcatggggctttcagaaggagggtccctgaaggggatgcagatgcacccgcctgacgctggaaacaagccaagttcctcctgctggccccaacaggagagtttcccctgacagacacacctctgggctctgctcatcagcgtccatgtccctagctggacaattccagggttgaaaattagggtttcccacctgtatctcatgaactctgccaggtaaaagtttcatattcatggagtataccaggtgcgaatgtgctatagatgtagctaaggacatttcagctttcaggaatctccatgagaaaaggaacttaatttgatgtggggctcagtgtagggagtgcgacctggcctgagtcaggctgcctggtgctggcaccggctgccggttctgccatgtcacttctcctgcctcagtctcccctctgtgaaatgttgcctcctggggacaagggagatgacatgcatgtgaagtgtggaacacaccccgggagggggcgagcatcacaactgttgctgccactgtgctgctgccgttctgaaaaagctgcagcaggagctttcagggtgcaggatcctgttaattttcttcatctctttaagcaactccaagtctgatgggttgacccactgaaaggggtttctggattattacacactgagggaccttatgaacatccctagagttcagttgtttaaataaaaatgaactttggtgccacgtgagccaggctccctagggaacctgcagggacaatcttgccttccactaagacccaggcacaaggcgggcctccgtttcttcagcgggagacatcaccaagtccccacctcagacaataagccgtgtccctgcgactgaaatctatattatgcatatttttataaaaatgcagctgaaaatgttagaaaagggcacagggagggagggaagcatgtcgagaagcagggactgccgttgccacaggcagacatgacttatttcatcttatgtgactatttactctgatattgaataaaaattgaatgtgttgctatagcaacagccacatcacacagcacctctcctgcctttaagtcacaggaaagtattgagaaggcatccgtgagccagcgcaacgtggaaacctgtgtgccattcacaattccaggaggaaaagatgttgtttcatgatgaactcctatttgtcaatacgtcaagtgcagttaattatatcgaaaatacatttttgtgtttttcttcacttttgagaaatagaaaaagagtgagaagagcagtaagcagcaagcaggctgatggggtgcagctgagcccaccacagtggggctgccccagggccactgaagtccttgtcacagagacaaacccacagcgggtctatcctggggccatcgaggtcttcgtcacagagccaagcccaccacggtggggctgtctgggccatcgaggtccttgtcacagatccaaacccacagtgggccagtcctggggccatcgaggtcctcgtcagctgagcccacccatgacgggcctgtcctggggccttcgaggtccttgtcacacagccaagcccacagcgggcctgtcctggggccatcgaagtcctcatcagctgagcccacccatgacaggcctgtcctggggcatttgaggtcctcaccacagagccaaaccagagaaggggctgctcctgacctctgacctcccaccaaccaaaggcttatctggggtcctcagatgggctgaatgcagagctgcctgggctgggctgatgcaaatattttaatgcaatttcatgcagatttccctttcagacgcaaattaggaatatttaccagtaaacaggcttttcttaggactgaggcacttttgcatttaggagaaaaccatctgtcaactaatgcatattagaataaaatagagtgacagtgcaggaaatgacaaaagatgcccactccccccagtacccacttcccccagtacccactcccccagtacccacttcctccagtacccgctccccccattacctgctgctgccagtacccactcgtcagtacccactccccccagtacccgcttcccccagtacccgctcccccagtacctgctcccagtacatggtcccccagtgcccactccattacccactctcccagtacatgcttcccccagtacccaacccccatacccactccccagtacccactcccccagtacccacttcccccagtacccgctcccccagtaactgctccattacctactccccccagtacccactccccaccatacccactcccccagtgcctgctcccccagtacctgctcccccagtactcgcttccccaagtacccactcccccagtacccgcttcacccagtacccgcttccccaatacctgctccacccagtatttgctccccccagtacctgctctccaccatacccactccccccagtactgccagagcccaccacatgcactgagtgggcaagagcccacacaggcaccaccgccccctgcctcccacccttggcagagcttcccatgtgctcttgggcttctggggtgagatgccacaggctccctgaaacgcacgctgtcttggggggtgtgagtgaatgtttctggagagacagaccctggtttttcttgggctcacggacggtctgagattgctggagtgttacaccccagtcactgcagcctggttctttaggctgagccggcactagggacaagccgtagcatgagatgtagggttcagtggtccccccaggcttctatccttggtgtgacccagcattaccatcaaacgcactgttaccttcgcaagctcagctcagtcaccttacccaaggaaccccgtgaactctgacacctcaggctttttagatccactgtccagagcctcaggagctgtgatctcttccttcagatactgctgaacccaccgctttcgctccattctgacaaacctacctctgaccacgtgagcttctcttcctcctgggagctgctcctccaagctcctgctccaggggccccgtcaggaacgtgtggccgtgctctctgccccaccagcccatcctgcgcccccccaccccccaacatccaatgccccttctcttgaatccccaaacacaggccctcatctaaaggccagcagtgattttaaacctttgtcatgtactggcctacgcgcagcaccatgccacgcagaatcttcacggatgtctgatgactttcgttactgtgagcgtttcccacagcaaccacggtcaatgggtgacgggggccgccatgtcccagatggtggctgctcccctcaggtccccacatttgctaatgtgtgtgtaaacgcctttcctttggttacatattttctctttatttaggttgtaaaaaatggtactaaaggtaaaatgagatagaactagacacacacattgttccaatatcaatctcctggttttgccataattggcttttataattacccagacgtaaccaccaggggaaaacctcactgggtaagggatacatgagacttctttgttataactttgcaattccctgtgaatctataatggtttcaaaataagaagtcagaaataatataaaaacttttggacaaaggaaaaaactcacttgcaattccactgagaaaaataaagtccaaagccccaactgacggaatgacctactcttgaccaagaggaccccagagaaaccttaaaactgagttgggaccgtgacaggatgaaggtcagacccgcctggttacccgcccccatcattaatcatcaccaggcttccttccctgggttcagacccgcctggttaccgcccccctctcaactaatcaccaccaggcttccttctctgagggctgaacagaaaccagcccttttaaaagactccattcctgatatccaccaagtgcctgaaactgctcttccttttatggtttcgacccaacaaccaatcagcattccctcctcataagagaccccattcacggagtgcctctggctagtctgtggaggctgcacagggagggccttcatgtcctcagcttcaccttttgatgcagaatgcctaactgtaatctgtttacatgttaagtctccatgccccagtgaacatgggatgcattttgcaaacattagctgaccatgcatgcccgtgtctccccttcacaaatattcacggctcctcccataacctgctgaatatgtatacttagccacccactcagcataaattcctgttccctttgcctctcactagaagtgcctgtttctggcttctggccggaggctacgcttcccagctggtcaggttggctgtcctgcaggatgcagctctttataaggaataaagctctcctttcccaattacgagcctcgtcattcttctgctgccaccatcaaccccataagagctgctctcttattcacctgttacgtacatgggcttctaacatctctgtgcacacacatgtttacacagctgcctttaagtttagagttctcaaaattttaaatgaaatcacagaatttgatttatttgattgttaatgatgagttaccttgctatagttttatattttaagtcagttttttttttttggtgaaggttttgtttttctgatttccttgctcgatggagtgtcttcttaggatacatttctcggagtttgattactgagccaaaggggaagagtttttgtttgttggtttgcagatgaccactgctgtcctgccttctaaagagttagactcattcaccctgcctaccatggagtgtacgtatatgagttttatcacatttggtctttatttataaaaccaaaactgttgttctcaagcaaccttcagtactaatcttaaaaataagacttcaggctgggcacggtggctcaggcttgtaatcccagcactttgggaggccaaggcaggcggatcatgaggtcaggacatcaaaaccatcctggctaacacggtgaaaccccgtctctactaaaaatacagaaaaattagctgaacatggtggcagaggcctgtagtcccagctactcgggaggctgaggcaggagaatggcgtgaacctgggaggcagagcttgcagtgagctgagattgcgccactgcactccagcctgggcgacagagcgagactgtgtctcaaacaacaacaacaaaataataggactttagacttaggatgtgattggaacatctacggatttctcaccccactgtagctctgacatttcacctgcccccagcaccacagggcctccggtctcacacaaatcattttggctggagagccctttgcaagtggtctgcttgccagctctccacctcacctgttggcatttcccaaatagcatttcttccagccaagagcctcatccatccacctggatccacctgaaacatttaatgtgcctgacaaaggcacggtcctgctgctgggcaccgcagagcaacaacagctgtcaccctgacaagcaggggcagctcctccccacctccccacctccccacctccttactccggctctcttcacctgtgggcaaaggcccccctctgtcccgtcctctcctgggtcacacctgggtgtgcagaaccaggcatctggtgaggcgggcaggaaatctgcatcttgacaagaccccagggagaaggtgcatggccatgtcgagccatcacagctgatatgttcctgctattgatttggccaaagtctgcattcaatgtccaggctcctcttggtaatccccaagcaaccgggtaggagctgtgtacagtagcaaacctctttgcacagacaggaaatgacagggtggaagtcagggggaaatgaagctggtttcgaacacatccgtcacccatctcagttctgcccactgcttgctccctgtgacaagtgctgagcatccccacaccccccgccccccaccccaggtaacaaacatcacacagcaaattcacattattcatggggcggattcccacagccccccaccccccatcccaggtaacacacacatcacacggcaaattcacattattcatggggtggattctcacacccccaccccccatcccaggtaacacatatcatggcaaattcacatttttcatggggtggatgcatgaccataggttcatagacttttaagggacttttgggatccacatattcttggctacagaatcctttcttggaacaaagtctcacccagaagcccagtgagcagcaggcaacagaagcctggaccttgctgagccggagtgtgagggtagcgtgagctgagcagggattcacacccaactgccttggagcccccagggctccttgaataaccatctgaagacctctgacctcatcccacactggacagagagaaggctccctcagcagagatggggggctctttgccacccagacagcccccagtctgagcagctcttcccctcagcttcttctcagattcctcttgttcacgctcctgagcctgcaggggctctgctgagactcagggtcggccacttctcactgacatgctgggcagggcacctctgtgtctatcacgacgcttagaagctagaacgctgggcaggggacctctgtgtctatcacgacgcttagaagctagaacgctgggcaggggacctctgtgtctatcacgatgcttagaagctagaacgctgggcaggggacctctctgctctatcatgatgctaagaagctagaacgcacccctaactctggacacaactgagaaggttggagccatggatctgcctttatccaaattatttttcttccaaacttttgagttttgctttttggtgattatcactttcctttggaaaaaaacatggctttattaatttgaataaaatgcaaatacttttcaagatatcagaaattagattttgaaatacatcaaaatgccacccatctatgaggggtgtgtatctgcactgtaatctgttcatttcctttaaattttgttttgagatatttccatttggcttaaaaggttttaattccactatctgtcatcacttgcattaaacgcaagcgcaggggagagatttagtaaatgctattagatttctgtaatcaaactctgctttatattccagagtcagggattagaagaattttaaatacattaaaaatcagaatcgtcaaattcaggcttaatactgaataaggcaattaaaattagaaaaaaaaatcattagctgttaaataatttatcaacttgtacccctttctcccattttcaccactgcaaatctactccaaatatataaacctcccgaaactacagcagtgaataaaacagacaaacccttccatcacagagctcccattccaggtgaagctggagatgcatccaggaataaggcccattgtttcctctgaaggcagaacccagccgtcacctgcattgctttctgcactcacttggggcaacaggagacacagatgctgggcttgagggccctctgggcacgatgtccgtggggtcaagagctcgagaagaaccatcttttgaaatgtaaaatggccacgtggagaaggataatgctccaggagctggtctccagcatttggtggaacgagaacaaagaaatgtctggagaaggccaggaagacaggcaggtcagggtgaatgagctccttgtggccagatcgtaaccagtgggtgaaataaacactctagcgtttggtaattttctgtcccagggatgacggagcctctgcccctgggaatggcaaggtccatcctctgctcgctcaggggccagagaggacacaggttggatgtggatggaagcagaggtgtggtgctgtgcaggtgagctcctgcctctgccctcagcccccacggtcccccgcagtctagggagaaccttccttcccacatatgagatgggtgggcatcaggagtgggcagaggccaattctttccagagttaaatagtccacttcacagataatctgagcagcaattcagatttccatgcattgaatcaatctacttcctagacagagcttcacaaggagcagtgatgccatttccattaagagataagaaaacctgacgggagaaacaggctgcggcaggaagatcaagagccctgcgtggcccactttaagtgtgaggctcctctacagatctcccaggagagaaaaggaggacacctgtggccatacacacctgttgctcggtgaatgggtcagggctggagacgtaggcttgggatcatcatcgaacagataacataaaaagccagggcccaggtgagttccccacaggagacagcaccggcagaaaggaggagggagccaggccctggagagtccaatctgtagaactcacggaggaggagctggtcgacttgaagggaacagagatggccgtcgcgcccagtgagagcagaaagcaatgcaggggacggctgggttctgccttcagaggaaacaatgggccttattcctcgatacacctccagcttcacctggaatgggagctcgtgatggaagggtttgtctgttttagtcactgctgtagtttcagttcttaaaacctgcctgacgcatataaatacctaggaatgaatgaacgaacagctcactaaactgaggctgagcagggaccctcgcacacgcacatcgaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacgctgagagctggggtgtgagttcctgtggacgctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagaccacctaccagctggggaagtggggagggggctgaaccccagatctgtgcatgtgccagagcacggtccacactttattgaatgaagcagaaactcccaggtgggcaattgacaggaaagtggatcggctgggacactgagggcagaacttcttatccagaaactctcacatagaaattcacacttcagtatcaccaatccctgctgagggtaagctcacaattctaaaaaaagacttcatcaaccacaaaagaggacccctcccccacaggagggggtcagcagatgtgatgagcaggagctgtagaaagcgaagactaggaaacggccagagggtctgaacgagaccataaaataagccagagggtctgaacaagaccataaaataagccagaggatctggacgagaccataaaataagccagaggatctggacgaaaccataaaataagccagagggtctggacgagaccataaaataagccagaggatctggacgagaccataaaataagccagaggatctggacgagaccataaaataagccagagggtctgaacgagtcaataaaataagccagagggtctgaacgagaccataaaataagccagaggatctggacgagaccataaaataagccagaggatctggacgagaccataaaataagtaggtttaaaatgattgaaaagataaaagaagatatcaaacacataatcaaagtagaaggcaaaataacagatttgataaattactaaataaaaatttttttctaagtgaaaaatacagtaaccaagagaaaagtacccagcatttgagttttacagcagattagacagaggaggaaggaacgtgggagacaatttcaggaaataatctgtcgtgtagcatcgagggagggagaggtgaaggcgcgacagagggtgctgagacagggtggatggaacaagaaggtccaaccctgcctaatcaaatgctgtggaggcgtcaggaccgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctctgcagagtcaagaaggggcctgagtgaaagggagcaccaagtatagcacaaaacccagaccccccgatccaagcagggagtgcctggacatcacaggtgcccaggggaggacgggaggagctgggaagatgaaacccagatcccccaatccaagcagggagtgcctggacatcacaggtgcccagcggaggacaggaggagctgggaagatgaaacccagatcccccaatccaagcagggagtgcctggacatcacaggtgcccagcagaggacaggaggagctgggaagatgaaacccagatcccctgatccaagcagggagtgcctggacattacaagtgcccagcagaggacaggaggagctgggaggctgaagccacagcgaccaggccctgtggctcctccagcgtgggaagagcagctctgtcctgaaagggtggccatggaggtgctgtcctccaggctcaggtgcgtgtgggaaggagctccgttgtgagtggggagccagggaggtgctgtcctccaggctcaggtgcgcgtgggaaggagctccgttgtgagtgggcagccggggaggtgctgtcccccatgctcacgtgtgcgtgggaaggagctccgttgtgagtgggcagccggggaggtgctgtcccccaggctcacgtgtgcgtgggaaggagctccgttgtgagtgggcagccggggaggtgctgtcccccaggctcacgtgtgcgtagacaacagcatctgaccttccatgcttaagaggcaacctgtggcaaggcacatggcagaagccacttgggctggagctgcccagtcagtggctccacctgtcaccatgtcctgcctcttttctggagtggccggagtccaggtttcaatgaggaaggtgtgtctggacaccaggcaccacacttgtcacctcccagatgaaccccagagtctcccattccccgtcccccacccttgcccctccagccctctcagggcagagcctccctcatgtccacaggacccacctccccacccaccacagccgcttctcacggggcctaaatattccacagtacagcagagggtcccagcctcgacgcgttctctgaccaggttacagagatggctctaacctgagtccatctagatttgtcccaaattcctggacaccattatccctctaggaatgacttagcaccaaccaccaccccacgtgatgagctcggaagggagaggaaagacaggaggacaccacagctccttgtacacgcaggagacgcacctccgacatcacatcttccacatgcaggagactcacggcccggtcacagccacccccggctgactccaccttgcaactacttggcccctccgcatcggtcactgcaccttccgtgggatgcaggtggctctcggcagcccccaagactcttggcttctttctcacccttcactgggtgctaaagagacagcaagctcccgggaaagaccagggcatcaccagctgcccaacacctcattcatccggcacgagccaggaaggcatcgagaaacaccaagaacaggagcacctgtccgggacgtgcacgccagtttccatcagtcgccggctgctctcctctcccacaccctgcccgtcatttaacccagacgcagccattttcaaagcccttcaggctattcttaagcaggctctgcatgggaagcgcaagaacctctgtttgggaagagcggccaattaagcagcttcttatttcaagagcccgagtctggggcctggtgaggacgagatttccccacagaagcagcttgtctttaagtggctccgcagagggcggctctgctgtgcagcgagcacactcataaataagcgctccttcacagttaattatctctaatggcgagcgctgtgaaacccgaaatctcgaacgcgggagcgcagattggcttcggtccacactgactgacgagtggccacacgccattcctcagaggaggcgcgtccgcgctctgtgtgcagttcattaagttgtcatgtcaggggacagcggccatcggcgcggtgcggggaggcgcctgcggctccagctgctggaggaggctggccgagcgcctctctgataccagcatggtaaggtttggacacacaggggcttgacagattttcagcgatattatggaagcattgcctctctgataccagcatggtaaggtttgcacacacaggggcttgatagattttcagtgatattatggaagcatttcctgttttatattgcctctcccaaatgtgcgtccttcgatattgaagatacaagtatgtcccactgagtcccaggaggaaagagtaatccctctagcccatattcattttcacacacttggcaactacaaaacagctgaagaaggaaggaagcacctattttctgaaggcttctccgttcttcttagccatgaatgctttttcttgtggggatactaaatcaggacttcaaaggccctaagacatcattgaactcgccaggcacgtttcgccaccgtttcccacccgcagaggatgctcctgctgcagcccactggtcctcccaggaaaacaggaccttggctgaattaacctgcaggtccagcctctgttctcacggtgttcgccagcacccagacagcactgcagatcgcagagcagacggcaccccttctgttactcaccgacccgactccggtttgaagaattttcagtccagaggtttcctccagtttgtctttgttgtcaactgttaggaaaaatcagaaagcacaagagtcaggttggagaggtcctcagtctccgggcacctctgagtattttcctccattgaaaatttcaattacatgactgcttgacccgcctaccttaatggaagggtcatgaacaggcacagaattagaacctgcacgaggccccattttcccactgacccagtgtgcgtccacctcgggccggcacaactgtgcgcttttggtttcatctagaaaggggtgtcccacccgggtccccaggactgctatgaatcactgatgagaaatatgtagagacattctgcaaactgcaacgtcttattttaaaattacgtaatcgtttctagctgtataattactgggaaatatgtttcattaaccagcattaggtgttgataaaagactccgtagaaggcaaagctgaatgtgtgtatttctgccatcagcaccgccagctattttgcagcctcttgttcatgccctgacaggaacatcctataataatttcgctccaataaaagcctcaccctggttttctcctgatgtagaatgaggaagactttcagagaatgaattgcactcgatggcaaaccaagggaaatgagctctggaaacaattagcagatggaaatgaaaccccagtaatcctagcaccaacacagcaaacccacctgccccacttcacagagaggacgggtgtcacaaggcaattgaccttggcttacgactctgtggaaatatgcgtttgcataaagcccttgtcactttggagatgaaaaccagaaaaaaatggaatttcactgcaaaccctatgaatgaagagtgccttgcaattgtgattaatacaggatgagatagcaggaaaatatcaattactctcaccccttattgtaacgcccctgtgttaatctggggtaatgaaattattcctttcggagagggacgcgatgagatcttgttacagcctgccctccctgctgttggggcctctccattgtcttatggaaagtttttccctttgagcaaatgcatactattttctacatataactaattacctactgcgctgaaagaacaagacagacagaaaacagtctgggctaaagcaaaactcctttaatactttatgatggggtagagccccaggggaggggaggacacaaatgtaagccttgggtggcaagagagctataaggccatcggtgctgctgtcctcccgcaaacagaggagacatctgacagattggcaagcttctctcaggagggtaatagtggactcttttaagcaggctgaggaacagaaagtgagtacaaatgcaaccttagaaccaccctggtcactgctgcagaacggtcaccgacgtcagggtcaggaatgaaaacggcagccccagcccatagtaatgagaaaaatccaatctgccggggagcgcccttttcctgtgaagggcaggtaacaactgggtcaggctcggcaggcccacggctctgtcgcagctactcagccctgccttgcagcgtggaggtagctgcagaccacgcctaagtggatggtcatggctgtgttccaacaaacctttatttacaacagcagacagtgggcctgacttgacctgcagactgtggttgccaagaggttgtctggctctagtccattctccacactgtgcccagggtgtcacgagcagtgagtctaagggtgtctgtccatccttgacctcaacatccagacctctggctccaaatccagacacttcggtggcccttcaaagcctttcaatggtgtcccctgcaggcatggagaacttgccttgctggccctgaggtccaggtggcactccttgcccagatattgggcttttcagcacatttcaggcattctccgtcccctgccaggatgctctgagctcctcagtctgacgaaaacgcagtcctcctcccaggaagctcaggccctacatgtgctcaggggcaccccctccctcaacatcctcagcacggccctctgtgtctcacagttcatggtgtgcaggctgcctgtcccctgcataacagaattgtaaattatggcactgggtaatttctgctctgtgtaaatgctcccatcacagttgactttagtgctcatgtgacactactaaagggaatggggagagatactgtcttagtccatttgtgttgctgtaaaggaacacccaaagctgggcaatttacaaggaaaagaggtttatttggctcacagtcctgcaggctgcacaagaagcatggcacaggtgtctgcatctgaggatgccccaggctgcttccacttgcagtggaaggtgaagggagccatgcagtgtgcagagctcacatggggagagaggaagcaggagagggcggagggagggccaggctcttgttaacaatcagctctcacaggagttaagagagcgagaagtcgctcacctccaccctgggagggcatgaatccattcacgagggatctgccccgccccatctgtccctcccccacatccaaagccctcccaccaggctgcacctccaacatggggaccaaatttcaacatgaggcatggcggggccgaaccaaccagatgcagagtcacacatggggaccgaatttcaacatgaggcatggcggggccgaaccaaccagatacagagttgcaggcgtgcggggaagagttcccaccatgcagacgtggaggacagaaataatctcaagggtgccgatgacagtaaaatgtagaaaaccagttataaaatggtgagctttagtatggatcgcctctgctcttaacatagtttatttaagtgcatgtttttatcattcaatgtttcacaatggctgtactgaataatgggctcacaaaattcctgagaaagtaaaattagttctactgagtggatgcaaactgtcccctgtgctggcacagtgctttgtttacacccgaagtggggccttcccgtccgtgtttcctgggtcctgaggtggggccttcccgtccgtgtttcctgggtcctgaggcggggccttcccgtccgtgtttcctgggtcctgaggcggggcctccccgtccgtgtttccttggttctgaagtgggaccttcccgtccgtgtttcctgggtcctgaggcggggccttcccgtccgtgtttcctgggtcctgaggcggggccttcccgtccgtgtttcctgggtcctgaggcggggccttcccgtccgtgtttccttggttctgaagtgggaccttcctgtccgtgtttccttggttctggagtgcacacttcccccagctgaagtggggtcgcagcacgggccagcacggtagtgactaggcaactcccgccaccctgaattggcagtgcagcaaggtgcatccttggaggccttggggagggaatgagtccttgtttgtacttaagcactttccactgggcctcctgtgaggccaggaacgcgctgcagcagaacttccggaaagggcgtcagctgcggccaatagtgactcagaggatgatcttgttggctgcagtggaacactcatgagaagtgtggtgccgccaaccctgcagtggcctggagagcacgtggggaccagccccgcggtggcctggagagtacgtggaaatcaacctcaccgtggcctcaagagcacgtggggaccagccccgcggtggcctggagagcacgtggggaccagccccgcggtggcctggagagtacgtggaaatcaacctcaccgtggcctcaagagcacgtggggaccagccccgtggtggcctggagagcacgtggggaccagccccgcggtggtctggagagtacgtggaaatcaacctcaccgtggcctcaagagcacgtggggaccagcattgtgctgtggaggcactcagtggaggggttccgagtgtgacgcgcgtcaggattctttaacccattgatcactaaaactccttttagatgccgatgcgagagtgaggctgataaacgagtctgagagagtttgttcaataaatacaagatcatctgaggtgattccaaagcacgtgctgtggttcaacggcaccgtctctgctcttcagtggacctgagctgagaaatggcttccaagtcagtgaaacaggcatcgtggtgagctcctagcagagctgcctcccaagctgattgtgagcctctccaggacaggcaaggttcttcagggtctatgactgcactttgatgcttaggggcctgtgttctttcttcaacaaatacatccacgttgctgcaaaggacacaatttggggccaccatcctaagcaaattaacgcaaaagcagaaagccacacgctgccacacactctcacacggaagcaggaaccagacatcatcagagagccacacgctgccacacactctcgcacggaagtgggaactacactcatcagagaaccacatgcgctcacatggaagtggggaccagacatcgggtacttacagccatagagatgggaacaacagacacgtaagagggaatgtgagagggaatgtgagagggaggtgggagaaaagggctgaaactccctctgggggacgtgctcactacctgcaagacgggagcaagcaagacggtaccccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctctcgaaactgactggaccttttaaaatgtagttcagtcggtttaaatcagcgattgaagcaaacaacctgaattagtgtttggttttttctttttccttttttttttttatactaaaaggttttaagagagtacaagggacagtttcattctcgagctaatctgagactgcagtgtaagtcaaaatcgaagtcacagagtaaaataattgaaaagtaatgaagctggcagtggctacattcctgccacacaccaagtgccggcgcaagcgcttcccacacttcaatccgtctccccatccaggctgtggatttccatgcacgcttcacaagcagctgtgaggaccacgtgggagcctctgagccagcatggcccaggtctcagcacacagcaagcgactaatccatgtgccctcgtgacagcggctgttttgctgcatgtctcatggccgggccactgtcacttcctaaggagaaagtgctgtatctgctgcgtgtctgagactccagtgtgctctggtctcttatgctattaactcgccgatcagtgcttctgcttgtgttttgaacatcaaacatcagctgaagcatcgctcaacgactttgctctgggtgactcagctatcaaggtcttcctcccacagtggaattgctgtgtgccccactaacagcacccacagcaataggataaaggtcaccaggattctcctgatttcttgtttcccaagatagggtctcttccttcccccacaggccggttccttcacaggaggagtcaggggctccgcaggccgcttctcagagcccatatgctcccggtgtcactgctcccctcccgtggccctgcacagggtctgctgagtgatgccctccagcactgtgctgggcactgacatccaacctgccagctcacgtcaagaaactccaccatcctctggaaagcccgacagtgccctgagcaggtgccggggagtctcacaaagcacagaatccgggtcccggagtccccagagtccagcttcttgccagggaaatctctttggagattgctgagtgcttttcgggggcgtctacgcgttcccttggcgctgtggaacgagccagtgtctgtggggcgtcagctgacttcacgcggccctgtgttccggccgctttcagcgatgcctgtccttgctagttcactttctggctttgagatttctcactggcagagagaatcgaaacacagagaggcccgcacctccctcctcctgcatcgcgaacgctgcacaagggcagcctccagggcacaagggcagcctccgcagcacagccctgcggtttgttgcttcagatttttttttaacctcaaatatgcctaaaaggaaaaacaatgcctcgtggtccccggcatcctgtgggtctcagggcacccccgacacctcccgacattattcctgcacccttgatgctccgccggatttctctaaatggccgcgtggattcccttttccacactgttggtggaattgtgacaggtgctgagctctgatcctgacacgtctgcactggggagcccgccgtcctctcgcgggacttttgcccacacctgtgtaactgaggactcacacctactccttttaagtctaaagtaaatacctgctgattctcagtgtccttttgttcctttttatgaactccatgacaatactgccaatttttaagtctctgctgaacatgttgaaggaggaaaagaagaaaaagcctgcttcagccagatgtccatcaaatgccaggtctgagttatgttttgagccaagctctgggcctcccaagtctgtcaggccagggcgtggagacagttggagaagctgccttaataaaggcacagaataacagagaaagcccgtttttatcttcatgggagacaaaaagggtttccaaacacaaaaaagaagtcctttaaaattaaattcactagatgaaggatatgcaaattacctgaagaagcggaaccctataatgttctcaaaattctgcaatagcctatttaattagtattttaatttatcagactaattctttgcacttgacaatttatgcagcattccatataattaagcaggcagctacagtggaataattttgcctactctctttatcctcgttattttaacctgaaagaatgtgcagaagtctcttctgtaatctaaattacaatggggatcacttaatggctttgctccattagaaggtgggaggggagggagagcacccaggcccggggtgaagctgtcacctggagcctggccagctttctggacggcaccactggcttccttaggaaggatcctcctcccttatggggtggagcctggtttctggccgagctgaaacgacgtcccctagggtaagacctgcatcctgtgcctcacagccaccgtaaacaagctgcctcaacgctgccactttccacccagggcccccgtgcagggggtcagcatctccgggtaatttggggacctctgtggactctgcccctgccctgaggtcagccttcctgaaactggaagccactggtcaggattccccgtgcatgtcagcaaggtgcccagccgagggctttccttaaagcggaagtcattcctgggaagaggaaggggaaagagctttgaaggaagttgattcagtgattggagctctggtcccaaccggcacctcctttcctttttgggcatcccagggtggccacagagccactgggagtgcagaggcctcctgggcccaggcgagctgccgtgtcgccgactaacatgaggcccacctggtcgcagggctgatcacaattcctgtaaaggaatcttttaaaaattagcaatgtccatactttcctatttcagcccattctctttccccatgtcgttttctgaaaagaactctagcagggccatacgtgaggcccatgaggggccccaccttccctcggagtggacaatcccggactgggctctcccagtggtaataggtattctatgaaaaaatggggtctttattcatacaaggttaagaaatagcctgccagtcactcaggccaaacctaaaactcctaaaaaaaaaaaggtttaaacattgcaaaccttcttaaagcttctcactcactactgtgcactgtgagcctttcactcaccctctgggcgctggggcacacgctgttctcccaggaccacgggcggtgtggaggatgggctaggggctgagggagaccttagggaggggcagggtaggaaggacccacgtgtcctgagcccctctagactgggggctcgccagggtctgaagcttcctggagaaggccctgctctaagcttctttggttctgggacctctaacatgtcttaacatcaaacacgtgcagtgacacttcagtcttcatttcagaaccaaagactctcactcagcaaatcctgagatcccgagatcctgacaccctgacacctgttggaaaggtttggaagcagccatggaagctgtcaccagtgttttatgctcagatctgtgctgatgtcacactttggacagccaagggggcgggaagatgaagcataaaaccaccttcaaggtgggtgtggtggcatctggggtaccccgtgaccgagcagtgtggcccgagggtgagaacgtgggctcggagaggaccaggccacagctctgtgcggccactggccagctgggcaccacgggaacatttacccctgtgtgtggtgtgtcctgcgtggcagtatctccttgtcccgtgtgtggggtgtcccgggcggtggtgtctccctgtcccctgcgtgtggggtgtcccgggtggcagtatctccctgtcccctgcatgtggggtgtcccgggtggcagtatctccttgtcctctgcgtgtggggtgtcccgggtggcagtatctccctgtcccctgcgtgtggggtgtcctgggtggcagtatctccctgtcccttgcgtgtggggtgtcctgggtggcagtatctccctgtctcctgtgtgtgaggtgtcccgggtggcagtatctccctgtcccctgcatgtggggtgtcctgggggtggcagtatctccctgtcccctgcgtgtggggtgtcctgggggtggcagtatctccctgtcccttgcgtgtggggtgtcctgggtggcagtatctccctgtccgctgcgtgtggggtgtcccgggctgggcctcaggcttctcttttccaccctcttctgcccccatgtgctgtgttcagtcctcaggccctgactggcatctgttcactgatcagagccattttctttcctccagccccatcctttctgtggatctgatatcccacctgtcttcttgccacttccactaggacgtccaatggtgtctccacccaaattcctgacctcaccgacttccccaagcctgtctgtcccccgtgaccccagcctgccaggagctcaggcccacagccgcagagccgcctttattctcctcggacacagcacagcgcgcctggtgaggctgcaggttctggcctcagggtgcacatgggaccggccggcgtctccgcgtggccaggtgcgtccagcatctcattctctgctctggatcttgcagagaccccaactgcgctgcctggctcttccatccatggtgccgggcccggcctgggaggggctgcacaggccgagccgcagcatgatgtcccctgcgcccagcacttctgccatgcgagccttgaaagggcctccacccctgcagcctgcattctgtggaagccacgtgttgcgtgaggcctttcatgcctgggagagggaggtttgaagagcagaagcacttaggcaggagaaaagacaaattaatgaacgtgtcaaatcctgctgttcaggttacagaaaagccaatgatttctgcataaagaagtatccgttcctggcagtgccaggtgcccactcttgcgtttctttgcacgtcggctcacagctctagaagtactcacggacaaatgtggaggcgccccgcagcaccccacaatccctttcacttttccacgtctgtcgagacaggacatgcatgactcacgcaaccagctcatgacatcagcaactgcagggatctcagagccagaattgcaaatgtcttattcttacaaaaatatggactacaatttgattaaattgtcacaaaatacaatttaaaatacagctctatttaaatacttttgattgaaaattttgatattttgtgaattatatttggctttagaattttaataattcacattaaatctttttgaagaaaaatagcttttgaagcatagttttagtttacaattttaagtgcatttttatttttaatgaaaatacttctacatcttgtaccctgtgtgcaattacagttgaatcatttctgtctaaaacaccccaactttatgaagatcgtcattaaacaatctaattagtgacttcatgaaacaaggggaataaaatgcatttacaaataaatatacaataatttacaaaattatgtatgtcattaatttattactcagccaaaccttaccagcccatcgagagaacatcactactcacaggattataatccaatccactgtctttttcattggattaattttcagaaataaaaacaatagctttatgcacatttgaataatttttttcactatgaacatatatttttcaaagtatgaagcatttttttagcggctaatgagcttcacatagacttttaaatgtccagaagcccagcatggaatgccacttgccctctggccttgggcccctcgacagctggacaggggctgactctatacactgggggggggaggatgctggccactcaacacacactcaagcctctcctcaaagccctgcgctggcgcatctcacccacagtgaggtctacagtccaggccacagacacaaggcccttcagaacctggcccttggctgctgccctgacatcacctccaacagccccctcgcccctgctcagccccttcagcgcgggacgccccggccagctcctgcctcagggcctttgtacctgctgtttgttcctgaccctcaaatgcctgcctgcagccatctgcatggtcctcctgttctcacccaacatcgggccctcatcccatcacctgtctgtgccctcatccagcttcattctttcccaaaacatttatcaccctctgacatgatgcatgcttggttattatctattttttctctagaatatcagttccacaaagcgaggatttgccctagtgcttagaacactgtccagcacattagaggacctcaacgattatctgttgagggaatgaataagtgacttataggaagcatgagcaaattaactccctagtggcagcgttaaagcattactatctctaggatgatcatgccaccactgttacctctattactaagaccagtggtggcactcactagtggtgcagggagggagtttcctataccttccacacccacagttctagttttgaactaaagagccaacgataaaaggatatctgaggattcctgatttgcagtctcatgattctcttccaataccggctgccagccatgagcacgggtgcaggatcacgcatgtacgccgtgggaatgcgtgcaggatcacgcacgtacaccgtgggaacgggcgcaggatcacgcacgtacaccgtgggaacgggtgcaggaccacgcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcatgtacgccgtgggaacgggtccaggatcacgcacgtacgccgtaggaacgggcgcagaatcacacacgtacaccgttctgcacagctggcggacgcttcctctttcccacatggtgtggtgtaacctgatcgtttgtatgcaaagcaaacccatgcacagctgactgtgtcaaaacacagccagaaagatgccatgcggcagggcacgtgtgtgtgtgtgtgtgtgcgagcgcgcgtgcgcccctgcgatcagcccagcagacagagcacgttcctgtaacgtgttgtgatccactgcgcggcaacaacacaaaacacaagaaaatgttttgatgttaatcattttacatcaagtcatctgaaagtagcatgttgccccaatgtttggatgtttaattttgctaactgtcagaaggaattaaaataaccctggaacataactgctttcctgacaattatttactaaaaccagagatgccatttaaagcttaattcccagagagggagaagagaaggggggtgcccttgcctgtgcctgtgctggaagtgggctgttcatcatctctcttttcttctttggcggtgaggccaaaggcactgtggcacagcaagccaagaagaggctatccatgaagatcggtctccgtgctatcgtgaacgggggctgatgcctgaccacccgaaggaagagaggaggcaagatgctgtgcccacaagacccaccccatggagaaacgtctgcatggtgactgggcttgcaatgcggtgatctccaggatgaaaagatgcccccttagagatttaccacgatgcaaagacgctcatttctacctgaacagccagggtcccatcctgcttagtatagaaatagcaaagacgtttagggagataaactagatgtgcacctactgacatgtgtataacgttcagtgttttattaaacatgtatatatcacgggctcctggaaatgattcctctcaccaactcagatgactttctcttgaaagttagaagttttggggttaatttgtaattcaaaaatattaatattttatatttatattccattaaatattaggaagataccaaagaatattataaaatatgtgttggttccaaagaataataagacagcaaacatccaggatacctgacactctgaaaagagataaaacattaaaattatctttgatactctctgtgagctcttctcggtcctatcaaagctaataactttcatgaattctgggtgcatagtttctgtatgtagactttttttttcacctatgtgtgtatccctaaacaaaatactgcataagatgacataataacatacacgttctgtgatgtgccttccgtcttctgctaaccctgtgttctgagactcagattcggttttgcatgtcatggtggctcatgcattttcattgctgtgtgactgcattctatacacatggagcatcacgctttatttttccaatcacttacccagtccggtgggaaactgggttcttatttttccctccatatctgaaacagtatagccatgaaccttctcacacgtgtctccaggcccatgtagagaattttctccagtacaatcactaagacatagatgtcccaaagggattctatcaatttacactcctgtcaccaacacacagagttcctagtgctccgtgtgctcattggtttaagctttaaacactttgccgatttggtagatttacgttgtatctccttgggcttccaatgtgcatgtctttgataattcatcagtttgtgcatcttcgtgtatgtttattcatcattcatgcttcctcttacatgaaatttttgttttgcccatttttctactgggttatttgtctttttcttactgctttgtagaagttcttcaaacattctggataccaaaactttgtcagttatgtgggctgcaactatcatatctcagtttgtggcttggcttcttaaagttcctggttttaatacagtctaatttatcattttctttaaggtttgcatttctggcatcttgtttaaaaaattctcctttagctcaagatctaaagatatctatataaagatatctatataaagatacaactctgtttttttcctaaaagatttttgtccttcacatgtaagtctgatattgaagaactgatttttgtatgtgattcaaggtagaggtcatttcatttttttctcattgaataccccatttccccatcaaagtttcttgtaaaggccatccttcccactgatctgtaatgtcaaccctgttatcaatcagttctatttaagggtctactcctgggttccctctgttcctggcccaggtgtctctccgtgcacagatccatgtgatctttcttactttagtgtaagtagtttatgctgtctacacacgaaggcaggtgttggctctttgtacttatacattttggaatcagcttgtcacgtttgtaaatgaatagtttttggatttttgttaaaattttattgaatctagaagtttgattgttattaatagcatcattattcccaatctgtgaacatgtaaatctctccatttattgtcttcaacatcttttaagttttatatttttccccataaaagtcttatatatttaacatatgtatatattcccgggactttaaattttgatgctattttaaatgagtatcatttttaaacagcattttctaactttttttcctaaatatacaaatacagctgacttttgcatgatttcatatacagcacccttcctaaactatctaattccattagtttacctggatcttcttctgtctcttctgagtaaataatgaggccgtctgtgaataatgacaggcttgctccttctctcctaagtgcaccctttatctctccttcctgcttcactgcctgctgaacggatcctcctacaaatgcttgtaagggtgagagcccacatccctgtcttatttctggtgttcaagagaatatttccagtgttttgctgggaagcatgatgtttctgtagggtctttaaaaaatcaaaataagaacaaactagtcttactttattcaacatttttattatgaatgaatgttaatatttagcaaatgtttttacctgtatctattgagataataatttttttctcttttcattaatgtgatagactacattaattacagctttaattgctcatgacattttttaaaaataaattgctggattttaatttgctattatttggcttttacacctatgtttttgaggaaatttctctctaattgtcattccctgtactgtaattactgagttttggtatcaagtttatgctaacctcatgagctgtgtagtctgggatgttttgtgtatgagtgcatgtgtttggatgtatggaataacttgcttataaaatatgtgggcctgatattttctttgtgggaagacttttaactattaactcaagttcttccttggctacagggctattggagtttttcattctggtattttggtcatgttatctaacatttcaaatatatggccataaattgttcatgatgaccccttgttattcttttatatgccaaagcatctatattagcattccaattttaattctcaatattgtttatgattccctcctctcttttttaaaatcacttatgacaaaggaggtttctcaattttgtaagctttttttaaaaagacaaaaaattttgctttttaaacaaacagagagattctctgtctttgagattctccaacttcactgtcaggaatcgaggtgtagagcctttttcactccataggcttctggaatctgagtactggtgtcttacatcagtggtggaaatttttctgccactgtatcttcaaatattacttctggagtgctctgctggaatgcttatgaaccatatgtaagattccaactctgccagaatacttatgaatcgtaggtaatattctaactctgctggaacactcatggatcatgtgtaagatgtgtaagatgatcctcgatggtgatagagtgtgcctcttccccggcaatggctttcccaataaagttggctctcaatgtagctaccttttttttttttaaattagtatttccttaggaactccataggcttctggaatgcttatgaaccgtgtgtaagagtcttctactctgctggaacacttatgaatcgtgtgtaagagttgcctaatctgctaaaatgcttatgaactgcatttaagatcctcctactctactgcaagacttatgcattgtaggtaagattctcctactctgccctctatggctcctacccttactttcatattttcaatttatttgtctctgtgggctgcgttttagaaaatttcttagttctatactttacttctctaattctctcttcaactatatctaatctgctattaaactcatacccttagtttagaatttctattattatatctttcattaaaatatatttcttcaaaaattgtggtctcttttaagactattgatctgtaggttatatttagcttcctcctatgttcctttaatcatattaaaatatttaaatttatgatctatgtccaatagttacaatatctgaggctttcttttgttgtccattctttcaattaacttttgtcctgttacctggtatgttttaaaattttttattgtggactcaaatttcttggaattttacttgcaggtattctttatgagtagaaggggaaagaaaggattcctccagagaggatctgcctttccctctgccaggcatctggaggcccgtgcacctgggagcgtttgaagctgaattccctgcttgagatgttgtggctgtccaggcagcatgcagtgggattgtacatccctgtgaagcttggctgtggttaatgtcctaagggaaaatgccacccccccacccccgccttccccgccacacacacacacatccaggaacagcgctgaacgcaagcagtttaccatcctccagcccaatggagagctgagaagacactctatcatcggtcaccattaccctgcagtcatggttcttgggggtcccagctccatgtggcatgtcttctattagccttaccatatcaggatttcctagtgcctcctgccctctatagaccacaagatcatgaatgctgaagttcaggtttacccggtgtggagaagattctcagaataaaggccaacatcagtcatccactgatgtccccgggttcctgctctcacttggcttgggatctccaataatttaattattgccagatgtctgatgtgttaaaattatctctatgtcctcatattctcgtagttttgtttttggaatgagggtgagtcccaatatttgtttcttccagcgtaccagcagaaatgggaactcccacatctcctaagaaatctctgccccgccccagctgctttgtgcttatgaagtaaaactcattttaattcaggtttgggcaaaacctcaggggaggctaaatatgaaataatctaatgattttatattatgctaaatataactaaacacagatgtgtatataaaattgctaattattcagtgttttatggaatctgccgtgactcttgctgggactgtgaactagaaatggcaacgacaccttttctttgtgtggtgctgcgtgtggacgctggtctctcctcggccccagtccacgctttccccaggttcttcatctctaaccctcctggcagcagtgctgggtcagagggtctcaccccaaatggtcccaggctcctgtgcagggcctggtggttatggtcccagatgggcggctggagcctctgggaggtgttggcccagggctactcagttcaaaatgggggctctgggaaggagagccaggtctctcgagcttgaggtggctcctcatggactgtgaaggggtgcatgttttaacacaacaaactgctctcctctaattacctgtaatccataagacagtgtgaggacagttctgggagcaggtgagttcgagaagcaccaagacgcatcatttgcctgtcctgtgtgtggtctaagaggtgcctggtgcttcactgcagagcacgcagctccttgctccagccacctgcaccacaagcactgcttctgatgtcataagcgtggcctcgaggagatgcttaggagcccccaggccagtgcacgtcccctccccggctgaaggtccccaccatggcaggggctggccacgcaccccggccactccgggacacgtccaacacacgtccccctccccagctgaaggtccccaccatggcaggggctggccacgcaccccggccactccaggacacgtccaacacacatctccctccccagctgaaggtccccaccatggcaggggctggccacgcaccccggccactccgggacacgtccaacacacgtccccctccccagctgaaggtccccaccatggcaggggctggccacgcaccccggccactccgggacacgtccaatacacgtccccctccccagctgaaggtccccaccatggcaggggctggccatgcaccccggccactccaggacacgtccaacacacgtcctcctccctggctgaaggtccccaccacggcaggggctggccacgcaccccggccactccaggacaggctgccgcagctggggagcttctggttccccttctttgctgttgcaaaccgctctctctcattttaaaatgtcctgtatgaagcgaaggcactgaacacactccagcctgcaacgcagaagtgcacattggcgtggagcatttgaaaggcattttctccttggaaactgaaaggtcaatttgtcaaactccactcctcagggttccaagaaaggttcttcagcccttgttttccagccataacagggtaaataaatgagactctcatctgcgggtctcctgtggattctgccggggggcggggcttcggtggaaagggagcatggctgcgcagtaataatagcggcaggctgggaaaagctaatgtcagctccaatttccaagtcatttttcaaattattttaattagatattgtttcaatctcacttacattaatttaatatctgatatcaacatttcagttttcaattgttcaaatgattttttttcagtctgcctggttgcctggagtaatttaaaatacaatgtttatcttcagcaattttcaacgcgtggtcctggacaaactgctatgttcaataaaagtgacaaggaagggacggccccaggtcctgcgtggcgacgaggaaaaatggaaattgtctccttattgttcatctctagacatcagagtcagcaggccgagctggggctggggctgggataataagattttccacccatttcacgatgtaattggctttcccaacgcaaatttcagtgaaatttgactaagatttttttgtattaaaaggcatctgaataaatggccacattcccccatctacacattttctgagaattttcagtcacagccctcaaacctacccctaaaagattcttcctggacgcactgccacaaatagccttaggttctgcgttttcttagtttgtccttttcttcagacattagcacggatgctggtaaagacgtgccttctgaaatggtaaatgtaaagctgaaccaggccttcacctccccgtttataaaatgtgggagaaatgaggtatcctgaagtgttcttctaagacaaggaaattagtattgttcttgaagttgataatgagaaatctgaagatccttactgcttttgaaaagtgtgaagaacttaaaacaaattacctgggaacaacataaaaccaaactataacatcatccacatggcaacaggtaaaccatcgaaggaacaggagggaagctgaggagctggaaggcgtgggccggtgtgattaacgagaaacacacacagtgaggacgacgcgtgggagcaggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaccaagaaaatgtgcaatttgtttaaaagttattgattaaagtggaataaatagactaatgttagattagattataaaattccagacaacgatatagggttaatgaactggtgtgtgccaagaaataaacatcgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggtcctacagcgggcccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagataccgaaatgattccccggaggtgggtttcgaatactgagagcttccatgatgataagagagaaggacagtaaacaaagtaggcactccatttatgacgtcaaagtaaataggtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggaggacacataatcacagatgcagtggaaatttaagacttataagcccttaagaccatttatatatctatttatagtcatgcaccacgtactaacgttttggtcagtgatgaaccacatacacccacaagtggtggtcccataagagtatgacggagctgacaaattcctgtcaccttgcgacgtcacagccatcgtaaagccacagtgcaaagcattaccttttctatgtgcaaatgatacacaaatgcctaccgctgtgttacacctgcctacagtattagtatagtaacatgttgtgcaggtttgtagcctagcagcgctgtcccatacaacctgggtgtgtaggaggctgtagcatctacaggttttgtaagtgcaccctgtgatgctcgcacaacgacgaaattgccagatgaaacatttatctgaaggcagcctcgtcattaagcaacgcatcgctgtctaagaatttggaactccaagaaattgaactatgaacaaagaaaataaaaattactaacctggctaagaatgaagaaagaaatattaatagatgaatatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacatgaagttctagccagcgaggacaaatgctgagatgtttgagacttcccaaaccacttgtgttttatcaatacattttataagccaaaagttaagagtcagccgcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatacaaagaaaatctaggtgaccttgggtttggtgatgactttttagagatacaacaccaaaagcacagttcatgaaaaaaacaactgataggcaggacttcatgaaaattaaaaactgaatatattattagtatatgacccagcagtcatgccctttggtatttgctaaatagagttgaaaacttatgtccatacaaaaatatgcacatggatgtttattgcagcttagttcataattgcccaaacttggaagcaaccatgatgtccttcagtagatgaatggatcaaccgtggtgtatccatataataggatatcattcagggctaaaacggaatgagccgtcaaaccatgacacagggcttgcaggaaccttaaatgcctcttgctaagtgaaagaagccatcctggaaaggctacacactgcatgattccaacgctaagacgttctggaaaagaacaaaggatggagacagtgtaagttgtggtggaggtaatgaggagttgggggaagagagaggtaccagcagagcacagaggctttcatgacagggaaaccactctgtttgatgctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagagggactgatggtttcttgcaggagtgtgataattcttgtgggagtgggctgccgcaggcagggagggctgctgtaaggcgagcccagcccctcatgcttgtcgtctcattatacatgctcattggcccttcttccagggcatggcgcagtaagaaagcccttgtcagagctgctgccatgccctcggacttcccagcctccacaactgtgagctaaataaacttcttttcttataaactaccctgtctcaggaattttattatagcaacaaaaatccacctaagagaacagcaggagtgaaccctgatgtaaaccatggaatgaatgtgggctcatcaactgtgacaaacagaccatcctaatacagatgggagcaatggagagacggggcgtggagtggaaggcagggcacgtgggaaccctctggactgtctgctctatttttctgtaaatgtaaaactgcactaaacataaaatctactaaacacaagtcacaaacaaaggttaaaagttgcttgtttttatttgaagtgcagatgtccctggttagatgttcaaataccttaaaaactgtaggtaaagggcattctccatgtgtacaaagattattactgcagtgaaactttcaggagaattttgaagagagatgattattttctgactctactgaccaggattctgttcaacatcttcatacgggatttttggtttttaaatactgggtgacggggccaaggagtggtgacttgcagaaggaagtctttcctgggcgatggggccagcactgcatcctgacttggaacagagtgcgtggaaagggaaatgggggtctgggtctcagtcctgcagtcctgcagtcctacagtgggtgagaccacacctgcggcaaagctggaattgcactgaaattggaattgaattgaaaattatgcagaattggaattgcattgaaaattatggatggaaaacaagagcaaacttaccactgctaagtgctgatttaaacaagataaatgttctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgatgtcacggcacgctgcggcaccgctgaaaccagcctgagttgggaaaatactttcaatatttcaactgactgctttctaagtcacaaataacacagctaatcctgaggtcactcgcttacaaaaacctatttgctgtgcttcagagcaaaatgaaaatatatattacaaatgatgccaccagtggcaagcctgctctgggaccagccatccttccactgtctcctaccactggcagctaaaaacatccctccttctccttaaagccattttaataaagaccccagaggctgtttactcaggtgaacacatttatttgtaaccagtgtttaatgtaaaatttagcctaggctgtgtgtgtcaataaaggtctataaataaaacatcactctgggttttttatctttatcccaacaccctacactgcatgcttttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcgcgaggcagagcacatgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagagaaatctctgcctttagataagaaatgtgttttcaggaatcgacagtgttagtgtaggatgttagcggtcacacccgagatggttcttttgctaaactcagggagattttagttgaatttgcaaaatggttgctaacatatctacctgttcctgagcagaatttaaaaaagcaacctgtcctgaattagaggaggctggctttggtgtgctgtttgggttggaccgtatctcagcactgtgttccattctggataccgctgtttgggagaccccatgggcacccatagcagacggcagggatgggacaatgggggatggcaaggttgtgtgtcacgctggggagctggaggagggggcccggtcctgagtgtttcagaaggcagggtggggccatcacatccatggcctcttcacttggacaggatgagggggcgcggccacaggcaggtagaggggtggcagaggaggtctatgtggcttcctggggctggctccattgaagccacactcgttctccttttctcctccacctgtaaggaaacactgtccattggaacatcagaaagggcggccctgggctcaaagctgaggacgccccctctgacctgcagctggcgaggtgcacagcccctggaggagaaccgaggccaccagccctgttgccagagctcagctgctcctcccgacactggttctgagtcatggaatctccctaccctggacgcctccaaaggccccatccacagggccctgctcaccactggcccaggtgccacccagagtcagagctggttcctgacctctgccagggatagcaattcccattcttgagctggaaaacaggtcatgtggaatctacaggatgcacggggaggacacctcgctttatttcaggtacacagggtaagaagtccgctgcaggtggattaaagacttgccgagtcagccaggaggccactgcctatgccacttggcacggtaccctctgctcacccaactcccatgactgagatgcacagttctcaccagctttaggtgatgaaaacacctccactgaagctcaaacaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacatcaggcaaatgcagttattgaaatgtagtcaggatgcaggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcacaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtgggtcagggtcagtcctagagacgcgtcacagagaaacgacgctgaatcaccagccaccgagacaatcaggaaccagtgacgtgatggtaaacagaggaaaacacgggccactcttcaaagcgcggtgcctcagaaaacacttccacagacacctcttcttctgtgtcgttctaaaacccttctcccagagataaggaaactagttccctgcaaaatatattttatggttttgttatcattttcagtatttgcactgtaattatggaaaattagtttagactttattaagcttttgagtctacatgtgaggcgaatggatgaatttaatttttatccatgcattacctccctctgtctatctaccactaaaccacagccacaggaagctgagggtccacgcgttacctccctctatctgtccactgataaaccacagccacaggaagctgagggtccatgcattacctccctctatctatctaccactaaaccagagccacagtatgctgagggtccacgcattacatccttccatctatccaccactaaaccacagccacagtacactgagggtccatgcgtcacgtccctctgtctgtccaccactaaaccacagccacaggaagctgaggatgaaaatcccctttctcagagcatctactatgtgccagttctgtattagaagtttcaaatgcatctcatcaaattctgagtccatgtgagataataattgccaaattaaaaacaatttaaagagcaagaagggattctggagatcatctaatttattttaatattacctaaatgagaagtggaggcagggagggccttgcccacagctgtgtgttcctgagtaactgggcgggactccctgcatcccaggcctcctacgcaccctccagtgccccttcctctaaacactctgtagctgcattcactcacaaacacccacagaccctgtaaaatgctgctcctttgcttcctgcttagacctgagaagtagcctctctccctgcagccctggagatccttcaccctgatcttgctggacactccatggcccccactgctgttgggtaagagtcgcctccccctgcatctggacgtgtggctgcagggatcctgacaccggctcactgtctgcaagcaaagccctgaagacaggaagccccagggacccgtctgagagcagagacctcacgtctgctggggccctgaacacaggaagccccagggacccgtctgagagcagaggcctcgcgtcttctgggaccccaaagacaggaagccccagggacccgtctgagagcagaggcctcgcatcttctgggaccccgaagacaggaagccccagggacccgtctgagaacagaggcctcgcatcttctgggaccccgaagacaggaagccccagggacccgtctgagagcagaggcctcgcgtcttctgggaccccaaagacaggaagccccagggacccgtctgagagcagaggcctcgcgtcttctgggaccccaaagataggaagccccagggacccgtctgagagcagagacctcatgtcttctgggaccccaagacaggaagccccagggacccgtctgagagcagagacctcacgtgtgctgggaccctgaagacaggaagccccagggacccgtctgagagcagaggcctcacatcttctgggaccccaagacaggaagccccagggacccttctgagaacagagacctcacatctgctgggaccccgaagacaggaagccccagggacccgtctgacagcagaggcctcacgtcttctgggaccccaagacaggaagccccagggacccgtctgagagcagagacctcatgtctgctgggaccccgaagacaggaagccccagggacccgtctgagagcagaggcctcatgtctgctgggatcactcagtgcacacgggcatgtgtggtgtgtgggaagcaggagggaagcgaggttttattaaagcacaggtgctttacctccaagcaggagtcagcattttccatggagttctgctgtgaaccctctggggtttgtgaccaggtcaggctgagcagactgggatgtttacgagttcttacgcacacccttcacagctgagggtctacaattcacgcttgtgggcaattcatgaagaagagaggtgcacatcactacctccattttgcaaactagggctggggtcaggagagctgcccgacgcttagagggactgtggagctctgtgggcaatggacacgtgacaggtggcatttatagagcacttactgggaacatgacaggtggcatttatagagcacttactgggaacatgcactgttgcagcactttatgtgaattcacacgtttaactctcaccacaatccagaaggaaggtgcagatgaggactctgaggcccacccaagaccgtaaaaccagggcagggccataggcagatacaggacccgacccagagcccacactcagccatgctgcccccgggactaactgcctggcttgggtggtccttagtagagcgggcggcatcaggcctctctgctcttggtcgcctggagatcccacagccagcaggatgcacccagcctccctgagaaagatagaactggtctggttcctttccctgggtttagggggctggggccaaagagaaaaatggtaggccctgaacactcttcttgtgatggtgggatggacctgctattcaggaaagcctcaactggctcccccaggtccactgtacccaaaggaactggctgcctgaacacatttggtaaaagagattgcgaagccacccaggacactccccgtgtctcagcgtcactaccaggctctcacaagctgatcaatctgagaccacctgagtttgaagcaccagggctgggagtgcaagttccgactatgaagagagggcagcacagagggcgggataggggtggggtggggaggggggcagagggtggaagatgagagggtgggagatagggatgggagagagagcggggcagatggcagggcacagggatagagggcaggagaaagggcagggcagagggtgggagagagggcagtgcagaggataggatgggggggtgggacagggggcaggagggagggcagcacagaaggccaggcagagggctgggacagaaggcagcacacaaggcaggacaggctgcagatgatgctcagaatgcagccaccccacgtccagaacgtcagggcaggaggggacatggagatggtttaacctcacatgcccactttagaggcaggagagtggggtcccggggtgccaggtgtcttgctgaaggttgtgaaataaggatcagtgaaacggtgagaccattccttccacccttgtgtttccctggcatatgtgtcagccagctggtcaacacatgctgcgttagcaaatgctgaaggcagggtcgtccctggcatgaccccctccccataacccacagcccctcttccccagtacgccgtggcagcctgccatccgctctctgctcctctgactaccttcagcaaccctgccttacggtggggatgctggacaggcattcaggagacacaaatgtcaactcctctgtgggttcctgcagcaccgggagaccctggcgcgactcctgagggcttcagtcctcggtttgttccttttaggaggaagccaccggatcgtttcccatgcttaagctcagacgcccacccagcacagcctccgccgcagcctggcagcccaacagaggctggtcatagtttttgccctggaattcccctccttttaccacatttgccacctctggtcccatcttcctttcagggtccaggcagtcttccccctcattaaatcaaatttattcccaatcctctgatctccattcaccagcctcctctgtctctactgtaagacttccctgtccctcgggtgggggcggcatcctcacaggggtgaggagctctgtgctgctgttgagatgaatggtgccagaagggagtctttccaagtgccctgtaatgcagaacctttcccagtgcccactggtggtgttcccgggacaccaggcactggaggtcggcacgcttattgtaatgaatctgaaggcagcccccaccaacgcgctggctgccttggggccaggcatgaagcgaattcagtccacatcagcgggtccaagcctggacctagacacccgtcccagctcagacgctcagctctgggccatcacccgtcgctcagcctgggtgacgcagactgtaataatcatgccatcgtgcacactgtttttcggagcctgttgaatcacatcacaaatgcaatttatagtttgcctcaagatgttttccggaaccttcctgcagagatagcacgaggcccacagaggggtgtcttggggcacctggcaggttccagggtgggagctataaactagaagtcccacgcttctcctcccccaggttcacttgaccacaattctaaaatattaatagcatacagcgtgttaagtgatggcaatgaaagtctggttcactcttattttatcacaaacgttgcataataaaacattcctggtgcccctcgtgattcgcagcctcctgagagggggtctctgttcagggtctctcagctgctgcttttagctcctttgtggggtgcaatcatttcccaggatgctggagtcaggtttctgcactggcaccagctgaagtgttttccatttcctgtgtgaagctcagggggttgtaagcacacacacgtgaccgtcgtgagcaccatcagccctgcctggagcaccggagggtgccaaggggggctttcttttctttgcttctcctgctgcccctggccctgaggtggtgcctgaaatccctgccaataccatccctgttcctgagagcctccttgggcaaagctgggtctggggcaggtaagcgggcagcttcctggggcaccagccccacaggtgagccaacatgggagtgggcgtgccacacttcccaggctgctcacaggcactgctgcttggggatgaaatgtatatttttatggaaatgttaaaaattatttttggctgcctaaattatgtatattgccttccctacattttgataattttttttcgtttttttttgtttttcgcaagaggcagaaccagcttcccgctgtagcagctaagaggctgcactgaagggcagccctctcccctgtctcacctccagtgcacaggcctcctgtggatcagaggctcccacagactctgagtcaagaactccttctgccgctgcaggagctgcagccagacgaggtttctagaagccatggctccagcactgcagcatgagctgcggtgcctggcattgtgcagaagggcacccacgcacggatagggtggctggcatctcccaggctgctctgagctggttccctggctgtcccagcaattccacgagttaactaatacattttcataagcacatttgctgcctaggccaggtttctgtcgcttgctaataagaattaattgtgactcatgcaggattcttggggtaggggtgagggccccagtgggcactgctgcttccaggcaggtccagtgaggaggcgtttggcccgggaaagggcaggcccaatcaggcctgagcagagccgtcagcacaacagaggcacggaacccagtctacttccgatcacacgctgagtaggcactgaaagaaaagtgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaatctctctctatatttatatttacactgatatttgtgctttattattctgaactatttgagagaaacttatggacatgattttcccttagttctaaatacttcagtgcttatttcctaaaaacaaaggcattctcctacataatgagagtacagttatgaaaaccaaaaattcacactgatatggtactaatatctaatcaacagaacttacacgatttgtctacttctcccaagaacatttctagaacaaaataaatgcccacatgaggccctgcataccgacgtcatgtctctctagcctccttcaatttagaaaatccttcagttcagtctttcttggtctttgtgatagtgacaactttagaatggggtgagtcactttgattgacagtttcagattagaggtgacttactttgacatttttagagtaggggtgactcacttgaattgacagttttagaggaggggtgagtcagtctgattgacagttttagagtaggggtgagtcacttggacatttttagagtagggtgagtcactctgacagttttacagtagggttgggtcattctgacagtttgagagtggggtgagtcactctgattgacatctttagaggaggagtgtcattctgattgacagtttaagaggaggggtgagtcactcggacagttttagaggaggggtgagtcactcacagttttagaagagggatgagtcactccgatggacagctttagagaagtgactcactttgactgacatttatagagtaagggtgagtcattctgattgacagttttagaggaggggtgaatcactccgattgacagttttagagaaggggtgagtcgctctgattgacagttttagaggaggggtgagtcactcattgacagttttagaggaggggtgagtcactctgactgacagttttagaggaggggtgagtcatcctgattgacagttttagtggcggggtgagtcagtctgactggcatttttagaggagggatgagtcactctgactgacagttttagaggaggggtgagtcactcattgacagttttagaggaggggtgagtcactctgattgacagttttagaggaagggtgagtcactctgattgacagttttagaggaagggtgagtcactctgattgacagttttagaggaggggtgagtcactcattgacagttttagaggaggggtgagtcactctgattgacagttttagaggaagggtgagtcattctgattgacagttttagaggaggggtgagtcactctgattgacagctttagaggaagggtgagtcactctgactgacagttttagaggaagggtgagtcactctgattgacagttttagaggaggggtgagtcactctgattgacagttttagaggaggggtgagtcactctgattgacagctttagaggaagggtgagtcactctgacagttttagaggaagggtgagtcactctgactgacagttttagaggaggggtgagtcactctgattgacagttttagtggagggatgagtcaccctgattgacagttttagaggaggggtgagtcactctgattgacacttttagaggaggggtgagtcactctgattgacagttttagtggagggatgagtcaccctgattgacagttttagaggaggggtgagtcactctgattgacagttttagaggaggggtgagtcactctgattgacagctttagaggaagggtgagtcactctgattgacagttttagaggaaggatgagtcactctgattgacagttttagtggagggatgagtcaccctgattgacagttttagaggaggggtgagtcactctaaatgacatttttagagcaggggtgagtcactgatttgcatttttaaagtaggggtgagtcactttgcaccatgctccttggctggtataccgtggctgcctcaggaatagactgggttttgctctttgtcgagaacaccagggacatcatcttttgtgttctttgtgcatcagctcaagggcacgtgtgcggatccatcttgccgctggtgacgttcactggtatcacttgttaagcgctgcctgcctggtttctgcaccgtgaatgctgttttcttctgatcctatcttgtggtgagagctattctgtggttctccagaatatcggccgctcattttagcatcaatgattcttatctgaatcaagtagtactaagaattgatttgactttaacataaagaatttccaatgtgagaagatttcagtattcatggctacagatgccaagtgtgggcaacttatcttttatgcgccttcaacaaagccatgggagcagagagagggaaagaaaatctgaaccagtatgagtcaactggcacatcggctcacctcgatagcatttgcacatttgactggaagcctctggcttgtagaattttttcccactatagtatagaacactccacttcaatttttacttgtttaaaagaatcacatttgtttaatttccactctgacctgatctttgctctgccacagggactcttcacttggcgatgatgagcaaagcatccggccttggacctcctgcttcccagagcctgcagggctgtctcacttcctccagaagctctcagtctgctgccatttcttgggttcttcatccttcctgtggacctgggtctccaactgctgtgatttcccatcagtcagaagaggtccgcagcattttgtacagtgcaggtctaacatggcagattctctcgggatgggctggcacgaaagcaggtttctttcacccttatgctgaaacatgtttttgctggagatagaactctgggcttttgttttctcccttgcagaaccttaaagagttgtcaaattgtctcctggtttctgctgtttctagtgaagaatgaagtcagtcctcatgcatatcattgctcctgggaatgtaacgtctctcctcccagctgttaagattttctatctttggtattttagcaatttgactacaaatgtgcttatgttaattttctttgcacttaacttgcttggggttctctgagcttcttctttttcaccaggtggagggtgggtagggttgctggttttgaatattaattcttctttttttgtgtcccacctttcttggctcatcttctggaactgtcacgtgggtcagaccacttgactttgtcctagaggccacctgggctcttttttgtttctggcatttttctctgtccttcagatgcgatcatttctgtgcatctgttccaagtttgccaattcattcttctgcagtctctgatccgctgtaaagcccatgcagtgaatttcccatcttacaagctctcctttctaaaatctacacgtggttcttctgcacggcctccatctttctgctgaggttcccacgtgtcccctcttctccgtctttccctttacgttcttgaacagatctggaattgttgttaagtccttgtctggttgatttcagtgtctgtatcattgggactttcttttctcttctttatgggtcctaatgtcctgtttcttaacatgtttagcaattttggactgcaagatgaacattggcgggtacatcacaggaacctggtgacagtccactccttgcttttaaaattggagctccctgggaggcatcggcatctgtgtcactccctcaggggggtctagccatcctcagcatctgtgtcactccctcaggggggtctagccatcctcagcatctgtgtcgctccctcaggggggtctagccatcctcagcatctgtgtcgctccctcaggggggtctagccatcctcagcatctgtgtcgctccctcaggggtgtctagccatcctcagcatctgtgtcgctccctcagggggggtttagacatcttcagcatctgtgtcgctccctcaggggggtctagccatcctcatggtgcagcaacgccattctgtcctgtgtgcttcgcaatccgaaagtgaaccgatcgtaggtgtatgactacagcaaatgcagacacattctccccactttccctccctgccatggttctctagtacaagatgcttgaattttttctcactgagcttcactgctgccactggaggtctgaattgattttgcctcaactagttagagaagactgagactgactgagccgaagctctctgctttcttgaggtgacgagatgctatcgattatgggctctgtgcccctgtcacgttcacacgacatcccaaaccagactctactgggctcattcctcccctctgcctgtgtccctcactccaccaggccccgcgagcatcctccctgtagctctctggccaccccacctgtttctcttccacggaggcacctctgtctcctggattcccaccacctctccctgttctcccgagcaccactcaatctcacttctagtgtctcctccactcggaagccagggtgggggtctacagtgcaggtcggacacctcccgtgtctcctccactcggaagccagggtggggttctacagtgcaggtctgacacctcccgtgtctcttccactcggaagccagggtgggggtctacagtgcaggtctgacacctcccgtgtctcctccactcggaagccagggtggggttctacagtgcaggtctgaacacatgtgcagccctgtgcaaagctcttcagaggctcctcatgccctctggagaattttcaagttcgcagggagtgtatgaggccatcctttcggtcattcatgccattttcccacctctcccctgtctttccgccatggccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctccggacccctgaacaccgtgggtctgacaatatctttatgctccttctgcatctgggcacctggaacttgccgtgagcatggctgtggtgggtccttagcccgagtgaccacgtgaacttgcagctggcacacataggtgagtaaaggtccacacggggctggaccacctagaaaaacagcttttgcttatttacccaaagtaagctgtgctggggaaaggaagaggaaggttttgaaggtggatacagaatttccgtctaactgagcacgtggggactggagcaattcactgaagaaatgaaaggtgcgggaataggcaagcccttgatgtctggagcagatcgcatcagctactactaagccgctgttgtcaggcacagagaagacactcagcatcggatgagagaataaagccgtgtgcggtgtggcttcatgtctctcacaatagcgctcccgagtgcggccgctccacctttcccacccaggagaagccgcttaaaaagccaggcaggggctcttcagtgcaaaggttctgccccggactctcaccagctgctgagagcgggtgcggcctctctgagttttggcttgagccggggcctggaaaggccaactgcctgttggcctaaagagctagaaaaggatgaatggattcatatttacaaagacaccacagagtctgtctgaacagtcctgcgtatctgcaatctgctcgtcacccatccccttgtgcctagtgacgtgagccccaggacagtctgttcagtagcaccatttgcaacccctgtgatgggaatcttcgtgactatgtgacatgttccccatctctctctctgttgttttattttcctttgacaatgtcaagctggaaattagaagcaatgtggcatgcggagccactcagatctgaagcagagtgcatggtggggccatctaagtatgtttttctgcacaatgtgaaccccggctgttcaaagctaagagccacccactgcagggcacagtgctctggtgagaggaggtcacctcgaagtgggccccccgcatggtgctgccaaatgcacgcacagattacactttatgaaaggtttcctttgctttgaatagttggctgtctcagaaaaactgcagcacccactggttggaaattacatctgaactgcagtggagatgcaggggagacatcgcacaggagcgtcagccatgggacagctgcacatgcctgcagtgtcatccctgccagctctcagaggcacctgcttctgccctggggatcctgctgaaaggttcttgagctgctgctcagcagggacacaggagagggccggatgtgaggggtagacactataagcagacctgcaggcccagccatgccacgtgcagaccactgcccaccctctgcagatgggaaggagaggcccagggaggctgcctgtctgctcagggtcacacaacaacacccaaaggcaagatgtgaacccagatctgctttgcactgaagacctcaatttttactattagtcttaccacatagacaaattaaatgtgacgtgtttaagttgcattaaactgatgagatttgaggaagctcttttccaaaaattctctttaatatcaaagatacattgtccttgtagtacactaagcatgattgtttttgagtaaaaagaaccaccctttggggtgttggtgcttatgtaggatgatccaaccctggcagtaaaagggagggttttaaatctaccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcatgcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatctgcatatgaacctaatttgccaaaacccataatgttgggttagcaaaggtgaggccctgaggcctcaaccccatcgtccagtgtctactgaaactcagcaccagacagacagagttggcctcagaactcctcagtccagcttccctctggcatatcttacaacctgtgttaataccagggcttttaagatgtgtttgcctagcagttggttttgctaggcccttggataggtgcatttggctgggtactgggcacccgagaaggagaaggttgctacgtatgtgtctacaaatgccacaggtctctggcctgtgagacctcagcacagagcagagtggaggcaatgcttcctgaatgaactaagcaggtccaggaaggtatcactgcacaggcggggaagagcagggagtacccaggtcctggaaggtgtcgccgcatgggcagcagagagcagggaggacctgagtggaggaaggcgtcgctgcatgggcagttgagagcagagaggcccccgttggtatgaccatgagcccctgtcaagagttccagtccaggtcctgagggacatgttctctgcacatttccttctgggcatcatcctcagagttcccatctagtggtctgtcagcgatggtggtgttcagaacttggttataactcagccccggctcctttctgaagcctcagtgcagattcttttctctccccttcctagtgttattattaaattttataaggtctgtgctccttactttcaaagcaaactcttttttgtgccatcaagaggcaaagttataaacagttgactctgtgacattgaaatactgaaattaagaaatgaagaagcctagaaattctcactgttacagaaatctaatgccctcccctgtgacactgcaaatctaatgccctctcctgtgacactgcaaatctaacaccctcccccttgacactgcaaatctcataccctcccctgtgacactgcaaatctaacgccctcccctgtgacactgcaaatctaacaccctccccagtgacactgcaaatctatcaccctcacctgtgacactgcaaatctaacaccctccccaccgtgacactgcaaatctaacactctccccgaagacactgcaaatctaacgcccccccgtgacactgcaaatctaacgccctgccccatgacactgcaaatctgacaccctccccaccatgacactgcaaatcaaacaccctcccccatgacactgcaaatctaatgccctccccacagtgacactgcaaatctaacactctcccccacaacactgcaaatctaacgcccccccatgacactgcaaatctaacacccccccgtgacactgcaaatctaacaccctccccaccacgacactgcaaatctaacactctcccccgtgacactgcaaatctaacactctcccccgtgacactgcaaatctaacaccctccccaccacgacactgcaaatctaacactctcccccgtgacactgcaaatctaacaccctcccccgtgacactgcaaatctaacaccctcccccgtgacactgcaaatctaacaccctccccaccacgacactgcaaatctaacaccctccccaccacgacactgcaaatctaacactctcccccatgacactgcaaatctaacaccctccccaccatgacactgcaaatctaacaccctccccaccacgacactgcaaatctaacactctcccctgtgacactgcaaatctaacaccctccccaccacgacactgcaaatctgacaccctcccctgtgacactgcaaatctaacaccctctcaatcatgacactgcaaatctaacaccctcccccatgacactgcaaatctaacatcctccccaccatgacactgcaaatataaccccctcccccctccgtgacactgcaaatctaactccctcccccatgacactgcaagcgattcttcagtagacccaggtctctgggtacttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgtggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggtgatcttgaggcaccacaaaagcagcacctggcccctggccgctcccagctcagagcccacggtggggtcctcagccttcaccctagttttgctcccgcatctgagggctgcgtgtcacctcactgtgacttctgactgcacagcaggtgttggtgtggggagtcaggcagcctcagcgaatgtcctgaaaatgctcccacagaatgtttatatctttacagacacaaaatgctgctggggtaatactcttgggaagtatgcaaatgagttctttttcagatgtcaagcaggagcgatgatcagagaatcctctcattgagactgggagctggtggaatatgactccaccagctccagaccccaacttctccgcgttcacctgtacatcgcaagtgtctaaaaatgatgtgtatcccctcccagtccctcactgtctttccccagatcacacccccacaaccctgtgctcacggagaactgcccccaccttttctaggaaggagggcttggttatcagtcatcctcctgccatctctgatgacaggcagtggcaggggctcaaccttgtccttccttttcattcccactggtgccaccccagccaccttcatctgcgtagcctgaatcactgtggcctaactgggccctgggtctccatgcttcactcccaaagtcaaacacaccgtctcccatccctggcatttccatgccctcacttgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttgctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctccgccccatccctgctcctggacctgttggttccgaggaggccctggacaccaagacacccaccccagatgcccagactccctcaacatggaggatccccagactgagtcctccacaaatgctgaaaccccctcccaagatgccaaggaagccccccacccccaggatactgaagtcctccccagatgccaaagctcccagaggccaagcgctccctaccctgacgccaaggcccctctaggacaccgaagcccccgcctcctctgctgaggaagtgccattccatggaaggcccggctcagcctccctgggtcaagctcctgtctcctttcaggaagatggaagttcacagaggccgcaggtgtctaagggtcaagttgatcactacaccatccccttttagtgtttttgtatctgttttgactccctattatttttctggtagttcatctttttatgtgtttttaactaaatccattcagacaatcttgttcttcctctgccacttttctccacgttgtaagggttttaaaccaatgtttctaagggagcactgggcttcatttgacatttccagtaagtatcaaaagctgctatcacttcaattacagacactccgagcccaggacaggctccagatgcccggccttcatgcagcaaacaccttcacagggaaggaaggcggaactctctttccttgccacagaaaaggattctaacggcatttgacaaagattgagcatggttcgtcgcgaacgccagcctgcccccacggtcatgtccagcttaaccaacacacggcccagcagtctcggtcagtggagcccaccacccaagcgggggcggtaccactcccaccactgactgaaccttggaatcaatacaatgcagggtagagcaattcatttgaattaatgtgttaagtggcacaaatatgtgtttatcgagagaaacctaagtttgtgagaaaaggatctattggaaaattcttctttttaaaaaagtttcatggaaaaagcttcctgcaagcatccgcactgctgcaaatataataattgtttgaaagcataacatttaaatcagaagcatccctagacatgttgattagaaatagtcttaagagggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagacgatgccgcctccagcttggacgatgccgcctccagcttggacgatgtcacctccaacttggatgatgccacctccagcttggacaatgccacctccagcttggacaatgccgcctccagcttggacaatgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcccagtccaggttctggaagattctgcctttctgttcagctgtcccacctctcagttccgacagtgtgagcctggtggctaaagattcctaatctggcccttgaagactcaggcaaacttagaagctcctggtttcaaacttctctttcccactttgcctcttgtcttgaggtggcagaaacagctgatggtgaggcaggataatacggtctggaggcaagaagcaaccacacttttctagtcttgtgaaacaaccaaagcaactgtctgaagcctcttcagctggcccatgcctcatgggagttttgtagctctttctgcgtttgagaagacactaaaaaaaaaaaagtaaaatccagctggtcctgagagacaagagtttcctcaatcctggaaattcagcaggaaaaatactgtttatgcactgaatgaaatcactgaggccaagaatagttatttgttcacaccatttcatggatgcctatttttgtcccaaaataaagactctgcatgtcaccatgttgatgcatctggaaacaagtgagaggctttgttatcagcatgcagcccagatgtgaaggcccacagcagctcctgagggcacgtaagcttgcaggaacaggatgatcctccaccggctgcctgggccatctgtgtaagggccctgtggactgagccatttacatcagttaggccagcagccacagggatggtgtcaccactgtgggattcaacactttgaagaattaaggcagaggttacttttgtccacaaaatcacatcctgcagtaaggatgtgggtacaagtaatttatttggaggatgatcccagaagccaagtgagagaacgggacagtaagcctgagaagggcggaagccatgaagtacatgcacaaaccaccagtgtggacggccggggcccgacactgccggagaccctctgagaggcatgtgggatgtgccttgaatcgtctgagggtcaaagaatcaggggtctctatccattgactcccatcccttgctctctgaagaggtgaactcctgagcagccctggcctgccctgggtgtgggctagtgtgctgcttagctcagacagaccaaggcaggtgcttaaggctggagccatcagcatagatgggagctgccctgcagagctgaagggaggcacagggtgggcaactgggatgtgggcaggatgcgaaaaggtctgtcaaaggggtacttcttccaagtgggccaaagactccatcaggtcgagtagtgacatggaaatcacagagcaggtggctccaaggatctgtccctccactgaagtaacaagtaagctgacaaaaatggacagaagtgactgttctgggattctgtagtctaattttaaaaatcagcagtaaccagggggtgctaaattgagaaagagaatgctaaattttggttaaaagacattctgtggtttttgcttgcccacctattattccccattccccagttcaacagcagctacaggattggtggcctaagttcctggtgagatgtggtggtaccagggggcagtatggatcttgttttcaaaaaactgtggctgtgtgttttgagctgtctggtggttccttgagaaaccagtgcaaagaggaaccctgttttagcacctttgggcgagactggctttccaggaggaagctgacgaaatcatgtatagagttatactgaccaatactatcccaaatttgatgaaagacatgaatatacatatccaagaagctcaactaactccaagtagaattgattcaaagagatccatgctgacatattatcatcaaaccatcaaaagccaaagacagaaatttgaaagcagcaagagagaggcaattcatcttgtacttgagatcgtcaataagatcaacagcagtttttcaccagaaaccatggaggcctgaaggcagtgggatgatgtatttaatgtgctgaaagaaaaataactgtcaaccaataattctgtatcaggcaaaactatcctttgaaaatgaagccaaaattaagacatccccttagaagcaaaagctgagggagtttgtcactagtagacaagctctgtaagaaatgctaaaggtgacaggctgaaatgcaggtcattgaggctgaaattctaaacagtaaccagaagccatacaagaaaataaagaacttcagtaaaattaactacataggtaaatataaaacccagtattgtagctttggtttgtatctcctccttttgtcttctatatgatttaaaagacaaatgcataaaacaataattataaatctatgttaacagcatacaatgtaggaagagataatttgtgacaataacaacataaagctgggaaggaagctattcagaagcagtttttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcaccaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaacatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaaggttgtacttgaatcacagtcctgagatcttgggttgagatgctttttatttagcttgtgcatcaccaacttgtaaaaaatatcttggtaaaaaaatttaaaataaaactttaaagtttgtgttatgacagattaaacatttaatgccacatggtgtgtatatctcaatggaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagatatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcgaagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgcttccgcagtcttcaggcctcaggcactgccagtgacattagctgctgtgcgtccctcctgccggactgcaacaccgtctcaggatccacctcccaccatcttccctgaccatggccctgctccatctgatttgtttgtcctctgatcaggtggggcctgagtccggcagtggatgccagtgagtcagccatggttggcagggactggctggctgcccccctctcttcattggccccgcctgtctggcctgggcgcccactcactcctgctgcacctgccacaactgccggctgatcctgctgctctgatgccccctcacgtctccagcctgcgccccgcactgcgttcgctgcccatcttcctcccaagctcacagtctagctccaggtgcctgctctccttgttctgtgtctgtttctgcacaccctgcggggaggccaggctcacccaagaaaagagtcaaggctgcaccatgaagcctctcgggctgggcagggagtccaggccctgggagccccccagagccccccacagaatgtgcagctagcctcgccagacgcgggcgatggggccgaaccccgcaggacaacttaggaggagtgaagagtggaagagtgcccggtgcagggatgggtgggaggaacctggggtagtgtgcacgcctgagacagggtgggggacacgaagggagacaggcgagggtgggacaggcaagggtgggtagtgtgcatccctgagacggggtgggggacacggggggagacaggcgagggtgggtagtgtgcatgcctgagacggggtgggggacacagggagacaggcgagggtggggagggagacgctgactccgtggtggaacgtgggtaggtgataggctggctccctgagcagcccctcccctgtggtgcagagctgtgggtctaggggtgagggagccatcatctcatctcacgccatggagacacaggtgtggcttctgttcctgtatctctagtaaatgtttccttctgagaaactgggtctgtcagcctctttctcaggcctcttggttccctcagacttgggggtaggtgtgcacaggcctgcctgccaggggacaggaaccccaggggaaataaaggtgatgctcaaacccagaccaccgaatgctctgaacacacttgcttgctttcaggtggaaacattcacagtgtccctgggtacagcagacttcatatcacagagacttccctctccaggacgtgaagatgtccatcaccgagacgtcagcacggcaggtgggagaaagccatgcacacagtgaaggggacggcctccattggcccacagggtgagctatccagttccaggagccacctgaccacagggtgagctgtccagtgccaggaaccacctgaccacagggtgagccgtccagtgccaggaaccaccggacccacggggtgagccctctggctcgagaagtcctcagcgacatctgggggtcctgtgcatgcaccatgttgactgtacccgtgtgcagcttgcacagagtccccagcagctctggggagggctccgtgttcaatatgtgatgagctttcgggaaggacaggagagccgggtgtgagaagcctccttcctagggcctgtgtctctggagtgcacgaggcagatggatggagacgtgggagcaggggctggcagcactccccgagcacagtgggaactcaggagcaggggctggcggcactccccgggcacagagggaacggcctgggtggcatggagagtgtcctcccaggatacagcggagtgcccgtcaccacctgcccaccttcttcacaccatgaggctgctggcacgggtgcctttgctgccggctgctgtctgtgctgccctgcaacctggatccacatggctggaggtccggtgtccctaaagacttctatgacatcctgacactgccctgcttggacactctctggacaggagacacctcacccctcacagacatctcattttttcagagctgcatcatcagagcagttgggggacaggagggccaagtctgaggactcagacccggggcagctggtggaagctggggttaagagtggaatacatggccaaaggatccctcctgagggtgagggcgaccgagaaaggaatgagggcataagagcggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccgttccaagagcttcaggtgttcaggttcgtatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtactgtgtgtgctgtgtggtgtgtgtggtacatgtgtgctgtgtggtgtgtgtagtctctgcatgtgtgtccatgtgggtggtgcctgtgtactgtgtgtgctgtgtggtgtgtgtaatctctgcatgtgtgtctatgtgggtggtacccgtgtactgtgtgtgtgctgtgtggtgtgtgtggtgcacgtgtgctgtgtggtgtgtgtagtctctgcatgtgtgtctatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagaggagtggtctcagccggggtgatattaaggcctgcagtacagctccagaccccagagcgaggccccgcctccctgccgagccccagaaacccccttttcaggggtggaagtgggggtggcctctcccatgcagttgagtgtcctgggagggaaagcacagaagttctttctggtatctttagaaccaaatcaggtgaggtgtttaagtatctcatatgttttttggtcatcatttctatttactcctgcaaaattattttttaagataaattaaaagaataataaaccgaaatactagacttaaaatttaaaaatttagaaattgctggcaatctttttgtttttacaaaatgccacttcctagtttgtttctgggtagtgtgggagtgaagcgggtggggtggagggtgctgggccagtgtgcctctcaccgtccccaaggagccccctggagatgcagtccagaaagacggatccaccggccatcccaggtaccaggagcagcacacacgaatgctggatttgtgcctcacactaaaaagcagcttggtgtagctgcgaattttctatccaggcacatctcttcactgctgattaagctacctctttttgccaaacatactctatatttgtgctggatcacaggtaatttggtggagaaaagcaattccaaggaacacaggggagggtaccatcatgtttgtgatgcatggaattccttgcagctgggagacctatctagaatgctgagccgggctcacatccccctgggtgggagctatttctaggtctcatcagcagccaggggagggcttaccagtaatttttaagccatttcaacttctctgaaggcaaaacctgggaaagcaccgcaggcccatcacagatcccctgagagaagcaactcctcaattctgcacctgcgtctgcttccagacagcacacagcaggagggttatccaagcatttgaagaaatgctctccaggatcaactctcttcttcagacaactcccaaccattgtggttttaagtggcagggcacagctcagaagagaaagacaaggagggcaaggcggcaccgcagctcagccccgcagggtgctagggcggacaccctgcggggtttgcctgggctctgcattcccatcccttcattagcccaggggtgtggaacagtttgcacccagctctgggtcttcatacgtggaggtcaggagagtctcaaatagtgcatctgagaaaacccccaaattggtgcgatttccaataatacgtagcctttgcatatttctaaagagagtcagaggttggaaggaacccaggagaccaagggagaaacccgcacattctgacaggtgcgttttctcatcaggatgtcagctgctgggacactgccccaggccattcgtgtgctgctgaaactaggatgtgtttctcttgtgtttggatgagattttattcttcctacgtgctggcatttagtacactgttgtttatggctgtttgatgagaaaagcctagggacggctggtttaaggtaagaacattcacagtgtgttatctgcatgcccagggctgtgagggagcagaagacacagggttggctccctgacgtgttggagacagcaagagacgtggagcacatctggagggggaggctgggctgctgctgtagccgtgatcgctccggtccacatctgggttcatttggtgtgtggacacaggtgtctaccgagagggttttacctaagttagactaaacaaggctgcgagccagtcccagtctgtgactctaccagaagaggctgggtccctggctgaagaaatgctgaaaaatcctcagacacaaatgaatctgttcgactcaatgtgcactcaacaattgactggctatccctagccctctttgggtctaccagttgctatttcttgcgtgggcatcagcctgcacacagtgaacaaaagcagctggttcagagctgccagtgctccccaggggaaggactgacagagtgatgccaagacagggctgccctcctccctagggaatgtccaatccatgcatggccaccagaatcaagggcccacagaggaatcaagtttcaggggtcatggtgggaacctcactttcccagaggataaactgttacacagaaggcctgactgcttttggtttcttagcctgtgagttggaattcatttgtgtgactaattcatgtttggaatttacaaaaagaagttgtttcaattgccaccaagtaaagggttcatttaaatctgcaaccttgctagaatgcctggctcatgccactatgaaaacctgcatctgagcccattctgttttgaatggtggacacctagagagtaagaaggaaaagggaaggaaaggtcctacccaacatcagaaccacatgagcgaatggccacttgggaaatggaaatacatttgacctccatggctcagagaggttcagaagggttaataaacagctcaagcacttgcacctgagagcccactgttactctagagcaggggacaagagtcacccaaggtgactataagtccccacaaattcatctgatgtgcacttcccagaatctgcagcaccctgtaccaacccccatcccctctccacagcaacagtgcatcctaactgtgagcttaggagacacgtatttttggcatctaggacttaagtattaatccctgggggggtgaattccataaattaaggaggggtacagtaagaggatgagatgtttaaagagaagcatatccatggaatcaaaatgcgatcagagcattatggccaaataatccctaagaaaaacactgatggtacacacaacagatacaagattcaaaataaatcatcaattaatacttttaaatagtattattgtattctttttatttatctattactattaataattattatttgatggtacaaagtgaaaaggattataagtgagtgtgatgagcatttgcacacctacaaacaggataacacaagaaatgggaaaattcctagaaatacgcaacctactgagactgagtcatgaagaactagaaaaccgaccccaccaggagtgagtaaggagactgaaaccgtagtcaaaaacctcccaaagaaaatcctgcagtcactggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccagtatcccttataaatactgatgcaaaaaatcttcgacaaaatactagtagacaaaattcggaagttcagaagcatattaaaacgattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacaaactaggagtaacagaaaatcacctcaacataataaaggccatatatgaaaaatctgcagctaatgtaacactccagggtaaaagatggaagacttttcctttaagactaggaacaatatgaggaggcctgctttcaccactgttattcaagacagtattggaggtgccagccacaggaattaggcaagaaaaataagtaaaaggcatctaaatgagaaaagaagacataaaattgtttctgttcacttatgatatgatcctataggtagaaaatcataaagattttacacaagagatctgttagaacttaatagaatttattaacaaatttagtaaagttgcagggtataaaatcaatatacagaaatcatttgtacttctatacactaaaataaacaatgccaaaaggacatttaaaaagcaattccatgtacaatagcatcgaaagaataaaatatttagggtaggcttaactaaggaggtgaaggacatgtacactgaaaactacaaagtgttgttaaatgaaagaagacacaaataagtggaaagacatcccatcttcacgtattataaggctcattattgttagcttttaatactacccaaagtgatctacagattcaacataatctctaccaaaaatattgatattttttcagagatagaacaacccatccaaaaatttatatggaatctcatgggaacccaaacaaccaaagcagtcttaaagaaaactggaagacttgctgatttaaacttacaacaaagctatagtaatcaaaacagcatggtcctggcagaaaggcagacatatagaccaatggactataaaacggagcccagaagtaaacccttttgtgtacaaatgctttttgacaattgtgccaagaccattcaatgaggaaaagaataggcttttcaacaaatggttctcagacaacttgcaaaagaataaagctggacctgtaacttacatcatatacaaaacttaaaactgatcaaatatctgaatttacaagatgaaactataaagctctaggaagacttagggggaagcttcatgacactggatttggcactgatttctcagtatgacactaaaggcacaggcaacaaagaaaaataaacaaattgcactttattgcactttatcaaaattaaaaccttctgtgtattaaaaaacattatctaaacagttaaaaagtaacccaaagaatgagagaaaacatttgaaaattacatatctgattaggagtatctagaacatatgtaagactcctacacccaacaacaaagaagcaaggattggaatagacatttctccaaagacgacgtgcagatggagagtgagcccatggtgagctgttcaacatcaccagccattaggcaaaagcaaacaggagccatgagatgccacttcacactcctcaggacggccatcctcagaaaaccagaaaacaagggctcatgagggtgtaaagagactgaaactcgtgtgtactcctagtgggaatgtaaaatggttcagccacactgggaaatagcttgagaattcctcaaaaaattaaacatagaattaccatttgaccccacaattccacgtgaggtaaacactcaagtaatgcaaaagcaggaacttgaatggatatttctacactgacatgtatagcagcactattcccaacagccagaaggtggaagcaagctgagtgcccatcaggggaagaacagataaaaaacatgtggtctatacacggcggggtattattcagccctaaaagtgaaggacattcatccaagctacaacacgggtaaaccttgaggatattatgttaagggaaatgagttgtatatataagaggacaaatattatgatcccacttctctgaggtccctagggtcatcagatccataaagacagaaagtggaacggtgggtaccaggggccgggggaggggttgaggagttcttgtttagtgaatacagagtttcagtttgagaaaatgaacaagttttggagatggatggtggagatggttgcatgacactgtgaatgtacttaatgccactgaattgtacaggtgaaaatagttaaaatggtaaattttactttatgtatattttaccataacaaaaacatcattgcaaaagaagcatgggaagaatcataatcaggtgctgttttaaactgtaaatcaataaaacctttctgaaaaaggagttgggtggcacatgtcaagaacagataaaatatagatacattttaaccatctaatttcaattttaaaaatacatctttaattctttccatttaaaaaatgtgcagtaaacattagatatagaaataaaagctctaagaatagggaaatagctaagtaaatatattttcatggatgaaaaattattcatccgttaaaatgatattacaaatgttgaaaagaccaagatatttttatgatacaatgataaatgaaaaacaaaaacaaaaacaaaaaaacatggtcaggcatggtggcttacgcctgtaatcccagcactctgggaggctgaggcgggtggatcacctgaggtcagaagttcgagaccagcctggccaacacagcaaaaccccgtctctactaaaaatacaaaaatcagccaggcatggtgatgggcgcctgtaatcccagctactctggaggctgaggcaggagaatcacttgaacacaggacggggaggttgcagtgagccaagaacatgccactgcactccagcctgggtgacagagcgagactccgtctcaaaaacaaaaacaaaacaaaaccaaaacaaaacaaaaaacaagcaaaaaccaaaaccatggaagtgaaattctcaattatattaaaatatgtatctgtaacactcttgaaggaaatatgccaaaatattcacagtagttatagtttattagagagattatgaagaaatatttttctttcctcttttgattttttccaaaaatttcacaatggcacacaatatagatattaagaattattataaggtcaggcgtggtagctcatgcctgtaatcccagcacgtcgggaggctgtggcaggtggatcacttgaggccaggagttcgagaccagcctggccaacagggtgaagacccatctctactgaaaatcaaaaaaattagctgggcatggtggtacacacctgtaatcccagctacatggaaggctgaggcaggagaattgcttgaacccgggaggtggaggttgcagtgagttgagattgtgccactgcactccagcctggatgacagagacagactctgtctcaaaaaaaaaaaaaattataaaaagtcgattaaaacaacaacaattttaaaaagagggcaggaaagtggtctagtgcccaagagacctgtctcagcattaaagcatccatttaataacggtgtaatcttggctttgttatttagtttctctattcttcagtttcctgatttgtaaaatgaaattttcaggtgactgcctttcagcactcacactcgaaggcacttagtaaattcggcactcatattctaaggcactaaacacatgtgtctacttatgggagcccgaacatgagcctctgtcaggtttatggaggatgagttccagtgggaaagaggcttcctgagtcacagtgagcccaggagacccggcggcggccgcaccgggacccggggtgtgtggagacccggcggccacacctggacccggggtgtgtgggaggctctggaagagccactctgtgtcccaccctctcactttccctcctgctgaagaggcctcagtgcccggcgggtgcacacaagcggcgcagtccctactctggcgggaaacacaggatgtgaaagtattttatgaaacagtttcagtgaagaagaaagtgggtcattttctaatttgaaaaatccagagtcttctatttttctttgaaatttaaggagaagcaaagtgcttttaaaatgtttgcgtattagcataaacgattacaaatatttgtgtgtttcctggtcgatgaaaacacgccgctgccagcaggatgagatccgaatgtgaatggccacacttcagcaggagtgttattccaccagcgggagcgttattcccccagcgggagcgttattccccttcccgtttcctgttccttggtgttgactttaatgcatatgttcagatacacagaggaatagaattgtcaaactcggtcaccagcaggtctctcattattagaggacaccctgatccaggacagcagaccaagggtgcttagtttttacactatttaatacacagattattttcatcaatgttaagactacagcttcctgaagtcagaccccaggccttttattggtacctacacacccggggtcaggtgcagcctgcacatggcaggtacttgaggaacacctgtggacaagctggaagagtccggtgggaagggttttcagtgacaagcataggaagggttcgtgacacctgttcctattacagacatggggaggttcaaagtgaaccagtcaggaataatctcagcctcaccccagaaggaatttacaaatgaggaccatatatggcatggactagagggtcatatcaacccacagactgtggcattcttggttccattccccactatttggataaccttgagcaaggtagtctttgagccctgaaatggtgaggaacatgcccttagccatgggatgctggcaggtcattgatactgtcctatctatgaacggggttttcctgtctttaaatggggtgatgaggccacctcgcaaggcagcatgcagagaagcaagtccacacggcagacactcagccagcgcagcgcccagcacagacgtgctcagcagacgcacactctcagctctgacagccacggtgcaagtcagatgcaagcctgcaggctgagccgggcagtctcctggcctcaggtggacctgcagtcagagacagtccctcccttctgcggcatcctttccttcctgtgtgcacgctgtagaatagcgggctgggggtgtttaagaccagaagcagaaaactgacaactttgttgcctggaaaaaataaggtggacaatactggaactaatggcagaaacaaggttttggagcaatctacaatttattgaaagcagccctgagtcccaggactaaaataactaagaattggtttggttttattatttcttgttaagcaccatgtctgaggttaagacccagttcttaaaagtaatcacatagatacgtgttacacacatcagttcagttgctaaccagcccatcagcttggatgtaattacttcacacgttctctgagaatgtgttccacacataaagaatttccataatggccaggcagccttgagtggaaacaggccacagttcgggcctgggagagaagtctgcaggggggagatctgtggtcatgccctcaccccatccccagggcagacgatgccgcttctcagtgaggtccccttggcttcctgtcacagcacctcggtgctagtccacccgggagatgccagaacagggctaactcgttcatctttccagtccaatggccggggttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacacaggagcaggtgcagcagggcccttgagtctgtctcacgccattaacaccctgtgatggccttacttggcgtgtggagctgtgaccaccagggccaacctgaggcagcatcatggacttgaccgactcacctcagagcttggcactgggtgctctgattcccttcctcaagcttcccacttgaaggttggtgtgaaaccccaccccactcaaccctggctgatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacctgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaagcatctcaccatcgagagactgagccttcccaacaccatttggcattcccagcttacacagctgagggggtgaagcaaggttcaaatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttatgactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacaggagtactcagccacattgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcatgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattaccatcactactatcaccatcaccatcatcatctttatgatcaccattatcttcattatcaccatcaacatcttcatcaccatcatcatctttatcatcacaatccccatcatcttcatcaccaccatcatcttcatcaccaccatcgtcttcattatcaccattaccattatcaccatcacaatgatcactatcatcaccatcatcttcatcaccaccatcatcttcattatcaccatcaccattatcaccatcatcacaatggtcactatcatcagcaccatcactgtcatcaccatcatcatcaccatcatcttcatcaccactctcatcatcatttttaaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttaagcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccgtaaagcaatggaggagtgggtgaaatctgactgtgggctgagagggctgtgtgtccccgtcctcactcagaggcagacaaatactccatgacatggggaaaaggagaacgatgctgacccattccacaagtcatcaactcgcacaagttatgtatgtgcagtttactgagagtcagtcatacctaaaaagagaaaaactcaacaaacaggagggtggacattgaaaagtatctggctgaccctctgtgagtgaagatgtatttaccttgggatgaatgatcaggaaaaataaaggctgaatccagggagaaggggtctgggcagccacaaagctatgggacacaagtccatggaggtccaatgagctcatctcatgcacggttctctttttgtgatgaacaccagtgtgaccagtgtaaatacaatattagttggatcatttgttagtaacatacctttggacactggcttcattcttcagtatcttccctttatagacttggctttctgggagctggatgtttacccagtaccacctagcactagtaaattactacagcggagggcaggggaggacccactactccaggatcatttgtgggggtggcacctgactcaatattaaaaaaattcacatggtgttttatggtttacaaggcagccttgaacatctgacaccatgtaacaagcggtaactgtgagaagtggggatacaggaccaggccttctctccaaaccttgaggttacctttcctaggaatgcagagctttcagaatggtgtccattccactcactgcatttcagcctctgtggccttgggcagcacctgtgatgcctgtgctgactggcatcgtctgcagtaagtgaggagggcacagagccttccatcaatctgttcagggcatgatttgctgcaaagtgagttgtgaaaactttcggttttcaagagtttctgggtctcggggttgtgtgaatggatgtgaaccagcctccttctgtttttccaggggatctaacaaggctcgaacgctggagccgcatgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggaagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccagcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacctcttcctctgcctgtgcctctatcacagatttaataacacacccttgtaattcatcttgcttatgtgggtgttttctccatgagttcttcaagaaaagagctggattctgttcatctttgttcttacccctgagtatccaactcagagctttgtacatactaaatatttgtacttgtactgaatattttttggaatgaataaatgcatttttgaagcatcagaccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccccagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggaactccacaccatgagaacagggcttcagagaccgcagaaactccacaccacgagaacagggcttcagagaccgcagaaactccacaccacgagaacagggcttcagagaccagagtaactccacaccgtgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacataagcctgcactctgggctgcagcggcctcactggcctgcaggagaggccccatgagatgccctggagcagcagtgggtgggaggaggttgtgcaggggccttcgagggatgaagcagctttgctggcagttttggggaagacagccctacttggcctgcctttagttcatgggctgataggacagacacaggatttaaaggccaaatagaaccacataaaacctgcagatgtaaaataacaaatagcatgctgtggggaggaatggggaaagggtggggggaaataacagggggtaggctcttcaatatttaaaagttccagacatccacagacttcttatgtcattttcctgatgggagggaaatgaatttccaatatttatatacaccatttaaataattttgctaaataatcagaggtcttagagaaagatgtgcatagagccaaacaagctgtctacatgagacacagccacagccgggtggggcttaccctgtaaagaatatccttctgcacagcagaggatggcctcactggattagatggctctccttgaatcaaagccctaattttcaggtaatggccaagatataagatgtaaagcactgttgtaagatttttaaaatctgtactattttttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccataacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacagtgttcactggcagtgggaaccgtcggtcctgccatgggacgatgtgactgggggctcgtccatgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcacagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatggcagagcagagctgggcagcagcccagcacagggccctccctcacctgagtgctcaccatccaagtccttgtagcacaaggtgagctggaagcaaaagccaccccagctcagatgtcctggtgaaacgccgggaaaggggcctcagccagggccatggcagcttagggctggttcccatcgcgttatcagcaaacgaatcttcccagaatcaagctctgatctttcttctctgatgtgaggtgctcggcgattcccaggaggcgctgatgagttgctcagcctggcagccgagttccagcagagttgagacccagcggctcctctggctgttcctgtgttgggcattctcctgctcctagcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcccaaatcgtcaaagccaggcatagtggaagagaagttgaatcaaatcgaagtttattaacaaagatagctgtcatgccaggaatcgttatagatttcgtcaaatttcagaggtatatgtaattatgaaaagccataaacacagtagtttccatgaaaaactatgagtaggtatggaaaataaaacagatgcaagggtaggaaccacagctaatagtccatgaatctaataattagttaactgattaacgaaatgcatattcattaagcacacctgtagagagcctattgcgtacaggtgccgttccagcaccggggactccctggtgtgacccacaggtagggtggctgtgccccatgaagcttgcatggaactcaccatctgtggtggcactgatccaaattcaatgaacaaggtgatttctgatcagggctctgagctctgcgtcaagtgggaggggttaatgtgctctggagtgacaggggtgggaggggtttatcagagatctgggagccaggaaaggtctcctgaggggatactcaagctgatgcctgaatgccaagagccacctgggcaaatgtgggattgtgcctggcaggtggagggcccagagcgtgcaaggccccaggtgggatgacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattcacacctaaagctacagcatttgtgaaaataatgaaaaggtcttaatgctggcatctttaacaaacccttcaaagtcacaaacactcatgaaagcagaagccagaactagactttgctcagaggtgagcagctgatccagctcaggggtccccagtgatgattctttctgaacaagagtcctcagctcccccacttccctctgggactgcacactttctgttcccttcctcaagggaagccttttcccctgattttctgtcacagtgaggttgcattcgtggtgaagtcggtcctggttttggggccaacctcactgctcgtggggctgacagacgagaccccaggaagcatagcgccatgatgggagaaagacatcccctgggccttcctggcgactcacaaggctggatgttcttgtctacgacacctgcccagcggaaggcccagaggggggtggctctctggagttgactctgcagagcactggcaaggccaggatccagagctgcatacaccaagggccgccctcccccaggcctactgcacctgcttggccttgcctacctgccatctcccatcgcccccgcggccctggcaggagggattgtttctctttctgtgtacaaccagaacctactacagggcccagtccacagcagatggctaatgaatgtctgctgaatggatagaaaaaaaaagaaaaatgttttaaatgttcaaaatacctgaaggagatgagaggacattgcttaagttatcagggaatgaaattcccaatagaaagacatgctaactctcagtttagaaaatattatcctttaatccatggttttctctggaaaaaccaccaaagttaagaacattccacatctgagaaaacacttcacgtcgctgtggctgcagcagcaatggtggtgatgacggtgacactggcaactgcacgttgctgagtgtccgctatgcactggtcatgattctaagttctcacatcacatttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcataagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgacttggtaaaaattcagtactgatggaaatcatgaccatattattacatcactgaggtttctctgcaaaacaggaacttgttgatcagggtattcattttatgcaggctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccgaggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaaaccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataatgtgtgtggacgagacatggagaaggcttccatagtcggtgatgctattccaggacaggtgaaactgctcaaactcctgctattccaggacaggtgaaactgctcaaactcctgctattccgggacgggtgaaactgctcaaactcctgctattccaggacagatgaaactcaacttcaactaaaccaatcaatatattcaacacaccaacacacacacaaatttgactccagtcattgataaaatagtaaaaacaatagtttctttcctgttttaaaaggagcttttccctttcattcagttaatttaacagggagtgattccatttttttttgtagtaattcagtttactttattttaaaaaataactcagtgtaccaaatgatttaatgacttcaatgtatcaaaattttattggctcataacctacatctatttcataaaataaggtttgatctaaaatgacccttgggcgtttccaagttaattaattagcaatacttcggaaaggcacaagctatgatgtgaaggctttgagttaatataacaccagttccctatcatatcagcccattcttcaagggctttgcaaagcagcagttctccaaatgcagcccttacgccaggtgccacctggaggttgttagaatttgtagaatgtggggtccccccaaacccctgagtcataaagatgaggaggggaatgcagagtgcagggtaccgcccagaacccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcacagagatgaggaggggaatgcagagtgcggggtccccccaaaccccgagtcatagagccaaggaggggaatgcagagtgcagggtccccccaaaccctgagtcatagagccaaggaggggaatgcagagtgcagggtccccccaaaccctgagtcacagagacgaggaggggaatgcagagtgcagggtcccccctaaaccccaagtcaaagagacgaggaggggaatgcagagtgcagggtccccccaaaccctgagtcatagagatgaggaggggaatgcagagtgcagggtccccccaaaccctgagtcatagagacgaggaggggaatgcagagtgcagggtccccccaaaccctgagtcatagagacgagtaggggaatgcagagtgcagggtcccccctaaaccccgagtcacagagacgaggagggggatgcagagtgcagagtccccccaaaccccgagtcacagagatggaggggaatgcagagtaccgggttcccccctaaaccccgagtcacagagacgaggaggggaatgcagagtgcagggtcccccccaaaccccgagtcacagagacgaggaggggaatgcagagtgcagggtcccccctaaaccccgagtcacagagatgaggaggggaatgcagagtaccgggttcccccctaaaccccgagtcacagagatgaggagggaatgcagagtaccaggttccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggagaatgcagtgcagggtcccccctaaaccccgagtcatagagatgaggaggggaatgcagagtactgggttcccccctaaaccccgagtcatagagatgaggaggggaatgcagagtgcggggtctcccccaaaaccccgagtcacagagacgaagagggtgctgatcacatcccaccccagcttccaggtgcttctgacacagctgaaacctgaacccatgactttcagggctgtggcctcccccgcccccgcccacatgtgtccaccagccctgggagtgagtctgaggcagggattctcagggacgctgcctgcatgccccggaggagtagcgtgtgtgtgtgcacacgtgagcttgtgagtgtaggcttgagaccgtgctgccgacccagtccctggaatccctgtgctgagttgttctcatgtggctgctggcccagggaggagcgttacggacaactgttaagtggaaattgtctggacgtaatgcagttcatcagctcaaaagctgtgggtctggctgtgtgagccaacagcgctagtgtcctggtgcctggacacacggatgttctggggctgttgctgaaactgcggcacagtaagccctgcagcctccctggaatccctgaggaggagccggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccccccacgccaggctccaccccatcccacgccaggctccaccccatcccacgccaggctccaccccatcccacgccaggctccacccaatcccacgccaggctccaccccccacgccaggctccacccccccacgccaggctccaccccatcccacgccaggctccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttcccgccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctcctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgtagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgccaccgcgtgtgaaatgcttggggttgaatctcgagagcagggagaccagccagacagcccacctggctgacgagacccggcctcgcttagaaagctcctccaagatgccaccgcatgtgaaatgcttggggttgaaatgtaacgaatctctcactactgacaagagaaaggccagaacacaaacacacttcctgcttccagatggatggaggtgggaggagggaggggttctgaccatcttctctggtgctcagtgaggcaatagcatgagatagataccctcatctacagccccgctctcgtatgtccgggggaagctatggagagggtgctgcaaagctgccagcaagtatgtctgcctctgacgagtcactgttggatgtgaggcaacgtgaaggctccaccactaggacccaggcaagactgccaagcggatgaggcttcgctttaggaccatggactctggcggcagataatggcctgagaggtcagctagtccaattgcttccttgtagacacgcagaaactgacgcccagagaggcagggcaccccgtgtgtggtcaccgtggtcagtggcagaggtggggctggaggtcagaactggctgcatccgtctccatctccccaagcacaggccatgcctgcctctcccaggtggcatctcctctctgtggtcctttccctcctgcctgcctttctgcgacatctgcactattcagacatcacgcttcctttcgtcctcactcaaaattcccattcactcagcattaccacggtttgatattaggactgcttgattcaagccaatagtgctaaattagaaataatgaaggcttcactcttccacggggttctgcccttggaagaactaatgaaacccaaggaccatccagttggcaggactggaagtaactgggcagaggagacattttggagcaggtggtcggtgcccacccactgacaggagctgccggtttctgacccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctatcagtctttctctagagatggggcagttattatgcagtgtgggatccacagttacagagcggatgggggactaagaacatccattctgcagaaagtgggacattcagggcaatagggaatctgcttttcaatgcagcatcccagtggggtggccccatcacttctgacacctccatcactgatgcccccagctctccccacacctgccattccccacgttaatgcagcagggatccagagaagggtctccggacatcactgatgcccccagctctccccacacctgccattccctgcgttactgcagcagggatccagagaacactgtccggacatgcaggggaccggagtcctcaccactcccccttttgtcttctccaagccagggtcaaagctgcctcatgcagacggagaggagaagctgcgttccctgcctttcccgaattgtttgtggactgtgagtgatgcatgtcctgtggcaccatgggagcaccagggaacaccatgctgtctctccccggagcccccactggcgtcctggccatttccagcttgtctcccaaagacaggcttctttgtgctttggtcacacggagaattatcagtgcagtctctgtctctctctctcatttccccctaaattgccacatgttgcaactcccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaactctgtctctactaaaaatataaaagttaagctaggcgtggtggcgcatgcctgcagtcccagctactcgagaggctgaggtgggaggatcgcctgagcccaggaggtctaagctgcagtgagccgagattgcactactgcactccagcctgggtgacagagcaagaccacaccttagaaaaaagaaaagaaaagagaaaaagaaaagaaagaaagacagcggttttcataagggggtaagactcagagggcagaagaaagcggagtcttgtggggggcaccatctgtggctgggtcggagggacgagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcatgtccaccccacttcacagatgggaaaccggggctcaggtaactcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacatgctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatccccagagtccagcgaacttccctggccctggccagagtccacgtctgactctgaaggtgtgcggggtgtggacatgagggcactgctcatctccactgccaggctttggggtgtggatgcaggggcactgctatctccactgccagggctgctggatatgctccagcctgtcacaagccaaggcgaccgagcttccctgagaggcacccagcctgatgcagcacagggcaacaggctggggcatgacgggctctgctgtttctcagtctccctgtgatgggagtcgcaatcccatcctcggagggtggctaaggggatccccaagaaagtacccggacaattcctgccacagagacactttaaaaagggcaatggccggcatttctgaggtttccttttcctaaccaggaacagattctctttgacaaatgggtcttgccacttgttatgaacccaatgccgtgggcccggcctgcacttcctggtggagtcctggccccacccagctcctctacacgtcctcttcactgaaggaaactcacagagccctggtggcaccgggtgctgcccgtgcagggcacagaaactcagggccggtttccctctggctgagggagggtgagggagggcgagggagggcggacctgtttcctgttaaaccctggagctagcacagacttgcagcctgcctgggacccagtgaggatctgtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggagcccacggggtctgcccaggtcacagtcccctcccacaggccacgcttcaggaggatcatcgcaggtgggtggcctctattgaggtgtgagctgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaaaaaaagaccccacggggacatcccgtacctggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtgggccacagagctaggtcctggagagccacccccaacccagcacgggtccaggacagcaggaagaacccatcctaggtcggaagttcaaatctctgatttgagatgagtgttgaccctacgggggttgaaggcctctctggagagcgtcgattgagcagacaggcccagagctggacgatctctccctaaaatgccaatggcctcggaagacaaaacccaaggggggtcagtggccccccatgcactgagctcactgggtctccctgcgcccgtgtctggagtcatacacaatgctgttattttactgcctaatttcaaaatgcacggctgcagtttacaccctgagctgtggcttgaataatttatcgcaaagtccctgtgtcagtgaccagtgtgttgggtgttgctttgaaacccacagagaagacctaatgtatcacgttgttttcctcctctttaaatattattgacacagcgatacttcactacaggccattaatactggtctgcttctagaggagaaaataccgatgcaggtcagggcaggtgactcgctctgagccacttaacactgggtggcaatggtaacccgccactgcttcctttttaatttaatccacgaagcagcacagcaaagtttcctcatatttctcctcttaaagctgacagaaaataaccagcagaaaacaaacaacacatcttagggaagggaatttagacaaggacagagaccagggagcgagaggaagatgcctgtgtttcccacagtcattgggatgaatctgaggcagcgttagagcgagcgccttccactttggcccacagctccttgttcctaaaatcagcaccgcatccccagcttacagctccttgttcctaaaatcagcaccgcgtccccagcttacaactccttgttcctaaatcaatgccgcgtccccagcttacaactcctggttcctaaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacaactcctggttcctaaaatcaacgccgtgtccccagcttacagctccttgttcctaaaattcaacgccgtgtccccagcttacagctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctccttgttcctaaatcaatgccacgtccccagcttacagctccttgttcctaaatcaacactgtgtccccagcttacaaacgctgtgtcacactctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtcaaatactgcacattcacacatttaagtgggagccaaattacatgcgtgcatggatgtagcacatgggacaatggacgctgcagacccgggacgctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgccaggggagctttggtctctcacacggcttagagcccttccttccaaggcgggcagctcctgcgtgcacatgggggctcccaccaccccgagggccggtcccccatgcctgttggagggtggtgtgggtttgctctggctggtgtggacaagcccttaactgagaacagggtcaggggaccttctagctttcttctctagctttcttcgtctctagcttttctttttttaaggcatttattgctcctgaaaataatctgtgcttgcaaagaaaaaaagtcattttgtttcaaatccagtgataaagaatggatcttttcttctcctagcaaaccattttcccttgccccaggggaccatgtatgacctgagccatcttcccccacgccaggccctcaggagacccaacctccctgacacatcctaggcccggggcgggtgtggggaggcacgagcttctctggaaaccagcagctgtcgcctgcttgcccatctgtcaccaagctctaagtcctgctgtctgctcaacaggcatgaggagcagtcccacagtgcaatgaggccggcacgggggcccagggagggctcggccccaggtcccctgacgtggggtgtctgccctccccaggaggacggggttgggggcacatctgatggggcctgggtcatgcctgccagttctgcacagagctgcctcctgagtgcccacgtgccctgcggggctgcctggcggctccatttgctctgtgtctgtggagcaactgcgcccctgggcccgcctggcctgggctcccactgaggtcacagcacctgggtcattcagctccaaggatggggcaggccccacagggcaggaccccctccagcagttcctgcctgtcctgggaaggccacggagacagacccttgacttcaggacagggggctgctctttccataaatccccctggctggcgcctggagcccaggttcctcccacacagccagtcattcctgccatccacactggccctgcaagggctggaagggccacaggtgggcctcactcaagagggaaggaccagggaggagaagggagccacattagcctggctgggtgggcaaagccacgtcagcagccagaatgtccctgcagataaacgtggggggaggcatgacagaaagccgggtttctacagaaagaggaggccagggaggggcagagcctggggggaggagtgcagggaggggcaggcagagaccagtgggtcatagggaccctgtggagcccccagaccagcccctgcacagaggagaggaatgtggggccggaggaatggagtgcaggggagatgagtgcacgggagaggagtgcaggggagtggagtgcagggctgggggagagtagtgcaggggagagtagtgcagggcagggggagaggagtgtggggctgggggagaggagtgcaggggagaggagtgcagggaggtggggagaggagtgtggggctgggggagaggagtgcaggggagaggagtgcagaggagaggagtgcagggtggggggagaggagtgcagggtggggggagaggagtgcagggtggggggagaggagtgcaggggagaggagtacagggcgagggggagaggagtgtggggctgggggagaggaatgcagggcccgggaaaaggactgcagggccaagggagaggcccagggcccgggctgcagcctggcttcagcttttacccggcagcctcagagctctacttttaattaagtgccttaccaaataattaatttgtactcctctgtggaataggaaaagagccatgaaataattaaagaattaaaacactagctcagagccaggagcagcagtcagggctggcccggaggctcctgggctctgaccacgccatccatccgctgaggacagcagaccacctgcgtgagacgcggaggagcagcagctctgccgtgagaggagcccgtgtccagcctccaacgtagatgctgtgttggacagagtctaaatgtagaccgaataagctacctcacatttcaagctcagtaaatgtaatgtttaatcacacctgtaatcccagcactttaggaggccgaggcaagtggatcacctgaagtcaggagatcgagaccatcctggccaacatggtgaaaccccatctctactaaaaatacaaaaattagctgggtgtgttggcaggcacctgcaatcccagctactcgggatgctgtggcaggcaaatacttgaatctgggaggtggagcttgcagtgagcagagattgcaccactgcactctagcctgggtgacagatactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactttggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctggtcttgaactcctgacctcaaatgatccacccgccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaattgccaaggcccgtaagagaagggtttaaaagccccagggccatgcttggtttcaggccagagggttctcagctggaatcacccaacacgtgaaagccgtggagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtccggccgcaggtggggagcagggtggggctggggtcgggccgcaggtggggagcagggtgggggctggtgtccggccgcaggtggggtgcagggtgggggctggggtttggccgcaggtggggtgcagggtgggggctggggtttggccgcaggtggggagcagggtggggctggtgtctggccgcaggtggggtgcagggtgggggctggggtttggccgcaggtggggtgcagggtgggggctggggtttggccgcaggtggggagcagggtggggctggtgtctggccgcaagtggggtgcagggtgggggctggggtttggccgcaggtggggtgcagggtgggggctggggtttggccgcaggtggggagcagggtggggctggtgtctggccacaggtggggtgcagggtggggggtggggtttggccgcaggtggggtgcatggtgggggctggggtttgaccgcaggtggggagcagggtggggctggtgtctggccgcaggtggggtgcagggtgggggctggggtttggccgcaggtggggtgcaaggtggggctggggtttggccgcaggtctggtgcaacgtggggctggggtcgggccgcaggcggggtgaagggtgggggctgggatctggccgtaggtggggtacagggtggggctgaggttcggccacaggtagagagcagagggccttctcccacaggcctgctcttggctgtgcatgtcacagaggggaccacactccacactcacagcaacccagaggtagagttcacgtgcaaagaatgggaagctggagccttaaataatttgcctaagttcaggcagcagcaaaagccagagccagaatctggaagcaggtacagctgattccaaacctacctcctatacccatgacccctcaggaccacagggcctgagtccacggctggggacgtgcacagcagggggacctgaggaccgggagggcggcacttcagcctcacgggcgctcccaccatgcagacagacgcaggcagtgtagtagatggtaaaacggccgaaaaccatcagcagcctcaggaccgccctgtcatgatgccaactcccaatccgtgctgagagcccggcactgcctcagggagattagcaaacacttttcatctgtttatacacaaacagcaggcatgggcccgctggccttccaggaacatgagtctgcgtgactggctgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcatcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacagagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggcctgctccctggaagcagatctgaggacgtttcgggcaggtcagctgcagcgagagaaatggacttgccggggaggaactcccggctgcctcaaagctcagcaggtccacggagcaggagccacacaaggctcttcaacaagccccgtgaggtggggagctggcctggaccaccctggcgtggacacggctgggctggatctcatctgtggaactcctggcaggagatggagtgccctggtcctggccggggtttggcagcacaagtgggggtctgctacaggccgcttggatccaggggaggaggaaagagcacaggagagggcaggagatgtttggcttctgtcatgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatctacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggtaaaacgggcctctgctttttttaaagaatagcttgtctaatgactctgagagcatctattaatttcatcactgttgccgacttaatcagcaaacttcatttacaattccacaagctacgaaaaatcatttgctactgtcatagcagtataggaaacgtgtcagcaccttgggagcctggccagtgtttcatttcactgagttccagaagactccggctctcggatgggagcagcccccatggctgcttttcggctcctcgtttggaaaacttggtgactctctaaggtgataggaaaagcaaaaattgctctgttaatgcttccagtgcccaatttgggagtaaagaatgggttttatcaccaaaaagaagacttcacatgatgtttctgcctgagagaagtaggcagggtctaggggccatcctagcctcctcccatcccagaggatgagagagggaaccgcccacttcctgtgtggccccaggactcagagctaccctcaatggcacccgaattttattcctaacccctcccagatgcttcctgtgtgtccacagctgggtggtggttctagttttaggttttttatatttaaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacattatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgacagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaagcctcagcatttccggcttgagaaaatcggcctggcacccatgaagtacctgcggtctgagctgtgtggccactatttttttttttttttcgagacggagtcttgctcttgttgcccaggctggagtgcaatggtgtgatctcggctcaccacaacctccacctcctggattcaagcaattctcctgcctcagtctgccgagtagctgggattacaggcgtgagccaccacacttggcgaattttgtatttttagtagagatggggtttctccatgttggtcaggctggtctcgaactcccgacctcatgtgatccgctcaactcagcctcccaaagtgctgggattacaggcgtgagccaccgcacccagtcgtggtcactcttaaggtgggtgcagcttatggtggcgaatatggaaaggttactattggctttcgctgatttctttaaaaaaaaatgcaaagagaaaggtcactaagcaaaagacctaagctggtttggaattcactaatctaacactggctagagtttaaaaagtaggggctagtaaagcccacttgatatgcacaaaataagattagctgcagcgttttgctgtccacgttgtcttagagagctggaagatggggtgcagggggaggtgcagggcaggaagcatctgcggtgaggcctctggtcagtcactgcacagctggagaaggctcaggtggtgctcgtggcccacgaggggttctccccagaagagacaggaagggcccaccgtggtttcccacagcaatgtcctcatgcacgctgaggcacacatcttacgtggatgctgttagtattcagtacactgcgtctaaaatgcacgtgtgtgcaaatgcgtgtctctagtgcactcagagtgggaagtctgcacggctccttttaactctatgggatcatgaaggaaagtaaaaccttagaggctgaggggtttctgcctgcatctgaatttctttggaatgctcatgtcaaatctgatggaaaggtggtactagcagcagccactgcccaaataaacatgttcaaagctccttttcaccaaggcttctgctgtgaacctctcccttcttggggcacctgctgccccttcctcctgcctctcctggggcagcacaggcacctgcaaccaacttacggagttttgcagatgtgacaccctaagaaagcagccaacactgtgttcctcgtggaattactgagttcacatcccttttcctttttagagagacagatcctataggcagcatgaatggaaatgcaaagactccatcgatttttaccaacttttccaaggaaagtccaaatcatgtttgctcctccatggtggtacagttcagtgccagcctggtctggccctggagccttcttttggcatccagaacatctccctgacaacccagaaacacagctgacctcctgccatcctgagcctcacaagcttgctggacacctgcggtgagtcccagcaagggtgagtcccagcgccaggcaaagatctggcgagggaagagccgcccgggatgcagacacacttatcactcacttgccatttccacaacctcatttctttgcagctgtggacggcaatggcttccttaagggccatcccacccctatggagatagatgccagggcttgggagccacctggtgtggctgtgcacgctgagtgtccttgtcactcagaggaaggtaggcccagggtcccttaggccaagagacttgtttgggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacagttctgggggctgaagtctgaggtccgggcttcggtttctcctgagactgcgcaggctggcgggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccggtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatgtgtgtggatgcatgcatgtgcacgtgtgtgtatgtatctggttgtgtgcattgcacgtgtgtgagggtgtgtgtggctgtgctgtgtgtgggggtgtgggtgtgtaggtgggtgtgctttgtgtatatgtggggtatgtacttgtgcacgtgtgagtgtgtgtgctgtgtgtgggggtgtgggtgtgtgtggaggtgtgctgtgtgtgggtgtgctgtgtgtgggtgtgggtgtgctgtgtgtgggggtgtgctgtgtgtgtgggtgtgtacatgtacacatgtgtgagtgtgtgtgggtgtgctgtgtgtggggtgtgcattgcacgtgtatgtgtgtgggcatgtgcatacacactgcctgatgggttctgaggaatgaacggatccatgaatcaatgattacacccaccaaaatttctactgattgcatgatgggaaaatatggaataattgcccattcttattttcattttcaggagaaagaaaacaggagtgagacaccaaaacgcagggctttgtttacagagaaggccgcgggggctccccgccaggtctgtgcatttcaactcagttctgtccttcctcataaacagatgaacctgtcccgcgcgcgtggtggcggcttacacggcggaaacaccctcaggtgctttctcactatcaaagagcagcttagcatttatttcatatttttgtcttccactgattcttatttattttacaaattgcacctgaacaataaaggaagtcattccaaaagcagcagcctgccccccaccagcaggcagcagtgacgtgtctccatggggccttaaaccttcagggccacgttgtgatttatcttcacacagcgcttggcgcatgcgggcctctaacgaatgtttagaatttcagtgactctagtatcaccgttttctttctatcttctcttccacgcacgtgtctgtctttctcatggtctagtcattgtaagtttgttttttaaaaagttttactaagtacatatgctactaaatgtggtgagtaaatgtttactgttcaattttatcacgttgatatactcagacttcttctgaaatgagacacaggctttctcctttcacctttgtttccaagatgctcttcctgcctctagctccccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacgtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttcccacttaatataaaaaccacgacatcaagctgagtataaggacacatttaaattctggccaaaaagcaaagcttatcctgggagttccaaacctccttcctgcctgggcacagctctttctgggtatatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctacgccacgccattcccagaattccccatgccatcctgccccaccatgggcaccagccaaacccactgagtaggcactgtctcccgcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagtaaaagttattccaaataaatatattttcagggtaacttaaacttacccacataacaccagtatgagaagtttatatactttaaaaagtctattttttaaaaaagtattgtttatttctctgctgccttacacacagtaaacaaaagttaatttattcctgatgactaagactcctcctttaaatttcagtgaggccttgggccccccatggagcacctcagatgctgcaaagaccagtgggtctgctccccccactccagatggtcccaggtgggcaggggaggaagagccccattttaacaagatctttccacttagaataacaatcgcctccacggagaaggttttagaagttaccagtttgtaaacacagacggaatcctgaaataggactgtcaccttgcaccttgcacagagatcccagcaaacaccacaaaggtgtacaaatgacaggaaggtgtgcagatgacagagtggtctctgctaggatctctgcggtgattttacccacacaaaaccccacctgggtctgtacgtcattgctaaagacatcagatgtgcctgtttgatgctgtgaaagtttttcacatcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagatgcacaggtgtttgatttcattccagtttgaagcatccattcaaccagaagagggagcacatgtttaaaagaaacccccaaaccgtcagaccatcgtcaccgacgatcaccatattaagtggtagaaaatggtacaaattaagaacatatcatgatgcttaggttcttaaggagctataagcaaaggaagatataaaattatataacactgaaagtgaaaatgaaagtaggaaactacactttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagattgttattttacactgaggtgctttttccccacagttctttcttggtcaaatcatggtttctttctttttttggttgaaaaactacaacaataagagatcaaatattccataactcaccaaagacttcagaatcaacttgggtgagaagagcatccttttctgaatgtggatgaagctgccccgatcccgagtttgtaggagagccattcgtcctgaaattgttggataactgctccctcccactccttggctgagagagtcccacgtgttgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgtatggaagaatttccaaaattcacaaagcgtagaaagaagattgttaaaaagtatgtccagtgattgacttggagtgggtacggaggcatgggcagtggccctggactgctgcctctgctggcaccagctcttattaccaccgcttgaagaacatggtacatttgtttctcatataaaaatgtgaaagcaggcaggtcggggctaatatggggactcatccatgaagccctcctttctcccctcttgaaattcccaggtcacctcttggaccatggtgtagcatcagctccggccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagaagaagaggaaagtagaccttaggctcagccacatctccatggagagtggaggtggtcagacagaagtagagatttagaaaagttcatgtgcccatccttccacccacaggcgggatgccaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctgaatattctccagcaaaccattcatctatatatccatccatcatccacctacacatccttccattcatccatccatttctccatccatccctccagcctgccttccttccttccttccatccacccatccacccacacatctacccatccatatatctatccatcctccaattcatctgttcatccatccatccctctatctattgacctaccatctatccaaacatacattaatctaccaattcacttgttcatctatccattcattcacccatctatccatccatcatacatctatcaatccatctatcatccatcattcatcatctgtctatttacccatccatctctccatccattcacccacccacccatccatccatccagccagccacccactcatccacccacccgcccatccatccatccactcatccacctatccatccattcacccacccaccccatccatccacccacccactcacccacctacccatccatccatccacccacccacccacccactcacccacccatccttgcatccacccaccagtttacctgttcatccatccatctatccctctatccatccatccaatcacccacccattcatccatccaccaactcacctattcatccatccatctaccccatccatcatttgtctatgcatccatccagccagccacccatccatccacccacccacccactcacccacccatccttgcatccacccaccagtttacctgttcatccatccatctatccctctatccatccatccaatcacccacccattcatccatccaccaactcacctattcatccatccatctaccccatccgtcatttgtctatgcatccatccagccagccacccatctattcacccattcacctgtccatccatccatccctccatccacccatctattcactcatctatgcattcatcaaccagcatccatccacccatccatccctcatccatcattcagcatccatctacccacacacccatacatccatcactttacctgtttgttcgtccatccatccacccattcatcaaacaatccacctgctcatctattcatccatccctccatccatctacccatccatcaaacaattcacttgttcatccagtcatccatccctccatccacgcatctttccaactacccatctatccatccacctacccatccattcaggaagccagccatcttttcacccattcacccgttcattcctccttccacccatccctcatccatccacccacctatccatatccatcatccatcattcatcatccatccatctatttacccatccatttctccctctgtccctccattcatccatccatccacccatccggccagccagccagccatctcttcacccattcatctactcacccaaccaaccatccctccacacattcatccatccacccgtccatatacccacacatccatccaccacacatccatccatctacccacccattcacctgttcattcatccatccatcccctacctatctccatctgtctttcctcttgtttcaaaaaagatttgattgtttttatcaagtatttttagtgcaaaagcttactttcatttcctaatttttaagagaataagaacttctcctgaatatcatcttttccctttttgctctctcatttgtctctctttttcttcccttgtatcttgcaaatccctcagataaaagtgggttgctgaaatgagaggctcagatagagcagagggaaacaattcagctccagatacccagggggtctaggcggtcagctgacctttcttcatgagcactgcagagtgccagtctgtgcctcatttctactccacgttgaatctttgaatctagtgatttggttgttgatctttgaacttctctaagccattatacctttagttccctcttccccacttgttctctgattgttcattttgtttttaacctaaaatgaacaaatcccctgtctaccgattaaaaactctgaggtctttttagttaatgtgtgacaaatagagaagagatggggagagagagggaaaaagtgagaggaggggtggtgagagagagagagagaggaagagagggagagagggagagagggagatagagggaggggtgggaggaagacagaaaggtcctcaccgcccccgcccctcacccctgtatgtgcatctggaatccactttcaggggaaagcagagccctttctctttactcaccagcagttcatattgttaatttttaactaaagacaactgatttttgccagtagcagagaacgtacgaggtctttcttcctattttctgcaattaagcaaccagctattattaggagttcaaaacaaatcacaaacatgtctgtctattacaattgtctaatggtcccaggtccaacactaagggaaacacatccattcactacagcctagtaattaagacaaaaatagacacggaagccgcgatcgaggaggagggggaacaaaagggtcagcttccgctaagaaagcctcagccacgtccctggggaagtttcatgtctttcctcacacgtggcagggacggctgtggggtcccagtgtgtcacctgcgtggccttttcaggttctgggggcctcggtggaaaacacgcacagtgcatggcctgacacccgctgtttttcctcgttcagggaataagagccactcccaagaactctcattcagactcgtaatcagcaaatcaacacggatgcctctcagagaaaaaacgatgcttccgatttcaggagccccctgatgattccgagtctctcatacaagggaggtggggaggatgggcagggctcgggaggtccggatgactttccccacggacacgggcagagtgtcacacttcacaagccacagatgccttgcgtggcctgtgtgtgtttagaccccgtcctgtgccccgccgggcccacagcacagacgcgcctggctgaagggcgagggggagtgggctgtgagtgtaagaaagtcaccagagaagggccgagtcgagaaggggccactcaggggcctccctgtccgaggcgcggagcccagcatggctgacttcctctctgaaggtcattagagatggatcccaataaatacacacacacccatcagattagcagacccaacggtctccatggcaacaattggacaagcaagtcgcctgcaattggcattaatttaaaatatttttccccgagtctccttggagtcagttccgtgaaacacaagtgcttgccagctctctaatctgcggcgtcctttgaaattccatccagcgtgtgctgaagctgagccaattaacgtggagagaattgggtggatcgcagagaagctggcaagaccgtgtttaccaattaggttttttttatgatgcaaatgttgcacaccatgcggcaggaataaaagctggctacgctgaatatgaaactgttaattgcattttcagagacatagctacaaggtgaaactaatcatacacatgataaccgggcttcaccacctacagtgccctgctgctgcactctcactaatctgtattaaaacagccccacacatccttgcaggaaaggaaaacattgcgtttggtataaccttccaattttaaagagaaaaaaagtgtgcctatgtgggaagcaatataaaggataattttcatttaaatcagattaataacgttaacaaacgccatggcaaagggcccagtggtgcttcttgaaatgcattttttgctttaaaacgatagcaaggtgcatttgcaaatgaacgccagcacatgctgacaagagtggctcaaaatgaaggagcttgtttcagaagaaagggccatggtaattatagaccttggctttcccagctaggaacatcaaagaggccccgctggaatcactagagagaggcttcccagggagtccagtgctcctgaggttcccagtgcccagcccctccctggggaggggaggatgaggcccaggagcagggagaagggtctaggctccaggctccatcccagtgcttgggggcagagaggggtgcccaggagcacctgtgtgcagggagtccaggcctgaactagcagaggcatttctgaaatggggtgtggctactttaaggggtgaggtcagctttcaaaatgccccatgagaatttatgtctttttcctcatttctatgttaaccacacagtttcagcattgatgctgacgttgactaactcagcagccgagaacagggctgggaacaggagggaatgactgactccccagcagcagcccacgtggggacccttgtcagaggggtctggggtgctacaaaggaggagcacccagccagggctgggcggccagcagggacagaaggacgcaggactctgcacggctccacagctcacacctcaggatttcacacacgcacaaggagcttccgagacagaagccacctgaggctgtgcccatcggggtccccttcttttaattttgcattgcagtcagccccgggagttccaatggaagcctctgctcagagatggtcagaagagcctccgagcccatcactgtgggctggggcctggatgtgcactccccagtgttgtgaacactctcggattccatgtgtccctgcacctcacagtttctggggccaagcgagtagtgggtttgaaagttcccagagattctgagccaagatggggtatgtgttgcggacttctaaatggctagggaagggaatttaaaaggaccagcctgattcctcttcaaggaacgtgtggagctggagctaggccacatgcgctgctgaagtggtgggtaactggaacagtctgtgtgcttgttcacaggcgccgctggccatacaaattagcacaacaggacaggacgctgtctgcagaaggaaaaggctcttgcctgtatgatgtttctaacacacggctaaggtggccagagaagacaggcgtagcgtgcatgctctgatggaatttataaccgggagcatataaatccctgtttgtgacgtagaaaaccgtgaagctggatctgcctggaaatgctaacttctgggagcttcacatttttagcctatactagtgacgtgcacttaactttgaaatttgtttcagaaaatgaggcctctacaaggaaaatcatctcggcttgaaatggatctcttgtcccacagtggctgcctcggtgtactgttaccgtatgtggtagagacggttcctaaccaaacgttcagtttgtttctctttaagaatataagaaagtaggccaggcacagtggctcactcctgtaatcccagcactttgggaggctgaggcgggaggatcacctgagatcaggagtttgagaccagcctggccaacatggtaaaaccctgtctctactaaaaatacaaaaattagctgggcgtcgtggtaggtgcctgtaatcccagctacttgggaggctgaggcaggagaatcatttgaacccaggggcagaggttgcagtgagccgagatcatgcgactgcactccagcctggcagacaagagggagactttgtttcaaaaacaaaaaaaaaaaaaaaaaaaaaaaaagagaatataagaaagtataaacagagtgaaattaattcattaacattaggaagtagaaactcactctaacgtgacccacgctagcatgagataccgtgtaactgtactgggtctggatcccccacggaagcacttgcagccggaccaccgaagggctcacgcaggcccatcctcccaccacgggctcccagcactggcaaaatgccactcagaccacagctgcaggggcctccccgatcctggggctgtttctgtaatagagtgtgttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtggctacaaggacgtgagctggagtgaccgtgtcagacagcgcggtagaggccagggatggggctgcacaggatgcccacaaggcctcgtgattaactgttttttatttgtgcaattacttcttttccttccttagtatctttcttctaaaaaattcaaagaatgaaagagggcgcttaaattattttaaatcagcaggattttttgaggtcccatcatagacaagacctatattgagcaaaccaggctgtagagttagtgttcagtggaagatggtgagcgggctgtgtcccctccaagtcccacctggtctcagggaccccacatctgcaggcctggctgtgcctggcaatgccgggggagccgcgcagcatgaaacggaccctgtgctcggtcttgaggccacagctcggccttggtgtggctggggccgcacagacacagcacagcggcccccggcatccgcaggacacggttttccactgttttaccagtccctcagcttcgccagacatccctggatcccagaccctgctcctcaggtccagccattggccgcggtcctgctccaaaccacaccggccatccaggacccagattcaatgcccagccctgaggcttctgcactgcagctcatcctcttggtgagagcccaagctggggccctgtgtccttgttgagcatggtttgaactcaggagcatctgtgtgatggccagagcccaggtggggtgaccccagccccagtgctgcccgttattgctgccactgtcattatcactgtggctctgtgagttacacctgtgcttctcagctactgcaacttacctccttcagccaacactacacatacatgagctccagggagggtggccttgtgcagccatctgggtagagacgcagaaagacttcttacagtgagtgggctttgcctgaactgagctctcagagatgagggggtgagggggtgtcccaggaacaggtgatgcctgggcagaggccacctgcagctctgggttgcggggaacgtgagggacaagaggagagggaggggcgagggcacagaagtggggtttggcctgcatcctacgtcccgaggtcactgtgggcttgatagtgggtgcggagaggagaggccggcccggggtcatggtgaagccgtcaggacagaagcagtcaggggctggggcagccttgcccaccatgttgggggtaaaatgcaccatgtgctcctcctctgacgtggctgtctcagctcccaaagcccaccagccaacacccaatgattatggtagaaactgatacagaaacggaataggtaagaaagacaaaagtagggatcctgtgtcaagtctaagggagtgcacaggagttgtgttttgctgaataaaaagggaagaagcctgagccactgggatcactgcaataaccttcttcttccaaggccctggtcctgccggaagtgtggatgccgtcctcactcaggctcccccgacagccggagccccctctatagaggaggctgttcctagacggacatcgggtcagacggtttttgcttaaggtaattaaattccctctaccaccctaaaaataattccctctccttgagatttctatacttaaaattcttaaaggcatttattgccctgccttagttgctgctttaccaagacaaacacacttagttcctttccacttttctcacaaacaaatccttcagtctcttaatcatttatgttgcttttctctgaatttcctccaatttgttgacatcctctggtttctaaggttctaatgcctatatttgctttgttagaacacagcaggtattaggaaagaattggatgctattcaagccacagtaattataagggaaaacaagttcaaaagccttgagtgaaagcagcaggtaagagggaggaaacatggaagataatgaccaatgcatataatgcttttctaattcaggacaagaccatgagaaacttcatcagtgatgccggcaaaaaccaaatacctaaatagatacataaatgtgtgtgtatgcacccacgcacacgcacacacacagaggatatcattttaaaaagaagggaatatatcggtaattagcacagaatataaatctccccccgagagatgggtgcagaaggacagcactgtgaggacacagccagaaggcgctgcccaccagccaaggatagaggcctctggaagagccagccctgcccacatcctgatctctgatgtccagcctgccaaccaaggagaggggcctcgggaggagcagccctgccccacctcgatctctgatgtccagcctccatagtggggagaggatgaactcctgttgctgaagctgcccaggctgtagcattttagtccaccagaaaagaccactacatcggccaaccctagtttcaataaaactttatttactaaaacaggtggggctgtccatgggttagaatctacccacctctgtcctagtaagtattaaaataaaaaatgaggtgacctcacaaggtccctgtggagaggcagagaaatggctgctgctactgccctggctgagccgggcagcctcgcccatccaccatgaggcgagaccccacactccagctggcctcctccctgaagggccagatgggtgacaggtccccagaagcttcggtcttgggcttgtcctggtaggaaaggttttcccagccaagtgcatcctctgcttgtcagcagcttccacagacatggtgagaggagacattcaaggatgaatttaaattgtgaaactcaaggggcatcacctgagtgcttttactttccccattgctgaccctacagcatgatgactccgtttcctacacggttccgagcgttttccatccttcctgacggcctccaccacgagacttcaggtcatcctttaatgagggcccaaggaagcacccccactctccagttccatgatttcccacggtgattactgagggaagaccagcgcagcccatgatgtgttcacagccaaggccccggcacctgggcactctggggcagcccgtaatgtgttcatagccaaggccccggcacccgggcactctgtctggggcagcccgtaatgtgttcatagccaaggccccggcacccgggcactctgtctggggcagcccgtaatgtgttcatagccaaggccccggcacccgggcactctgtctggggcagcctgtaatgtgttcatagccaaggcccaggcacctgggcactctgtctggggcagcctctggcttttaatgatgcagcaaagcatcaggctgcccacgccagaaggctttcccccacggaggcttccgccatgagtctggaatgcgttctgagcacccctggagcagggcactgttgggttacttgaaaaataggaagaaaaagaagacaatatccctggaccttagaaacctcaatgatcaagagtagcgtttccctccacggttgcccaatttcaccttgttctgcaggggatggcaagagcagggtcgccctggtgagtctgaactctgtgcactcctgtttagtcctcaatgggaaatgggaaagggctttgttttcagtgtgcatttatccctgataaacaaaaatcacggcacaaagcagaacggtggctgttttcttgtgactcattattaacaagttttaaactcattcatcttggaaaactctcaacaatttagcacagaaaaccactttaatgaattcacctaagcccatgtcgacaaggagtagccagaagccaatcctggtttatttctccaacatctcgctaaaggaggagctcaccacgtaagcgctcccaggcctgtgtcctgggaaacactgacagacagctctctcagaccccaggtgagtctctgctctctcagtccccaggtgaggctctgctcccatggctgcactccgtggccagtgctgctcccaatatctgaagacatcttggcctctactgtggctgtgtgtatttttctttgcggtaattaacactctaaaaaaaatttctctaatctatattttgaaataactcaagcagaagttttcaaacacgcacattctgcagcactgtcccatccactgcaaaggagaagagccgaggagcgagttccttgttctgctcccttcttgcggtgtcccccactgcctggactacagtatttcctgaaactaaggaagacagttgcgtagagaccctgagcttgcattcagcagacacacacattcttaacctatcttgaaatgagtaaacaaatcttcatgcccagtttgtcatctcctccttacccttgccctcatcaagccactcagtcatgtcagtccctcctgagtcatgcacatgcatgcaggcacacacaagcaggcacacacatgcaggcacacacacgtgcaggcaaacacatagggcctggcacagacatgcaggcacacacacgcaggtaaacacacagggcctggcacacactcgcaggcacacacatgcagacacacatgccggcacacacacagggcctggcacatgggttctatatttggtagataccaccattacctccaaacagagctgctaaccactggtatctatcagcagtttcaattcctcttgatgtgtgagggtcattttgtcttctatgacaatgccaaacacaccccagcaaagctctggggtagtgtgaacatgcccagtgcaccccaacaaagctccgggatgttgtgaacatgcccagtgcatcccagcaaagctctagagcggtgaggttccgagtcctcactgctattcagcacttgcacatcagaaacccaggcatctggatggccagtgctgacttaattgactggtcagtctcagcaaacctacagtcagttccttccaagaagcaaatcaatcagaagaacacaggttccctgagctgtccactcagctgaaataatcgctctgcagccctccgtaacttcaagatctctagtgaaacacacacatttagatttttaagaggaaaaaaatgccaaaatgattgccaagacatgcactgggcattccctgggcacacagggcacccgtgcagctgtgattctagggacactcgctgcccacgtcctccacaaggtcataggcattgtaagccaggagtgcatcctaggccctccaagaagacgaccaccaggatgtggctcctgaccccatggggctgatctgtggggcagaaactaagacaccttgtgacaaacaagcaatggaagagaaaactgctttaggagcaggaagggggccaaggccagcttggcaggagctgatgaaggctttccagggaggataaggcatgagcaacttcagttgtgctctcaacattgacctcaattcctttccactgcctctttctgctactgcacttagaaaaatgtcatacacacaggaagttttcaataagcaacaaaatttacctaaaaaagaaaaaggaaaacagaaacgaaaagattgagtggggtttggggcctgcagagtccttgtctgcttgattgtgggcagtgggtggtttgtgaatgtcagaataagcttttcttctcagatgggtaagcgggcagctgggctttgcagtgacaggtgccccgaggaaagcaggcaaacatgcactggacaaagacacatgcagccctattctaagaaggacttgacctttgagtctgaaaaacaccctgcactttaggagctcagaagagaaaggcatcatttcagagtgggagagccgcgcctccttgtcagtgtgatggttggtaactagattggcaggtaaagccacaatgcagttgatgtaccctcatctgctctattattaaacatccaaaatacattgttaatattttaaaaagcagacaaaggcccccatggtatgatacaactggatgggtgtttgttctcggccatgctgagagatactgacatccccaagtctctcctggcacccccagcacggccgccttccccagaaaacaatgtcagattttagaggctgaattgtgtggccaacttggtttacttctttaatagccctgtgggaacacaactgcttatatgtgacaaggcctaactccacacagaacaaacacgagtatcaaataacctcacttaagctaaagaaacacacacatatgtgaccaccttgggggatgatggctggtgtatttgtatttccctgctcagcttatcagttggatatcggcaagtaagatttagaagcagaaacataaaatattgaacaaaaactaaaacacttataaaaaggattcgctgtgtggtgtgaagctttgtgcagtaattgacacaagatcagaaagcaaaccctaagaaaagcggcacccacactcccagcgccaggccagggattaacgagcccggcagacaattccaatccggagtgggatttgctcttccgtttacgttctattgtccgggtcttatttttgctttcaattccttttgtaatggaggtagcagttgttattgacaattaataggggcttcaaaggcagtcatgtttggaaggggcagcggcttccctaagacccctcagctgctgctcaggtgcagctgctctgtatgccaagcacggcccatgccgggccccgtcgaggcagcacagatatcgatttagatggaaaccggggtcggcgcggagggaaggagctcggtgagcttcgcatgctaatgtattatttaggctttgtggtttcatccggagtaagtgcctatttaggaaaaattacagaatcagtatctctgctactgatatattttccctaacagtaattcacaggtaaaataccagggatgatggaaggtatttgtgcaaagattcaggaggagatggtctgatctggtgggctgggctcgctgggggggaccataataacgcaaagcaaacaacatccatgtgggaaggtccactggccgaggacgggcaccaaggctgccctcagatgccagccggacagcatggcgtggattttggcgaagctgagtgatgcatgctatatgcatccttattgatcgaaattattctttttactcaaatatttacaatgtaagataattccttgtgttcatagttcttacataatcatacactaaaacaacttttaccaattaaagacaaaaccgagaccctcttccacgtgagatggtacaggagggagctgcagtgggcctggctgtggggagcaccctggccactgtttcaaagctgccccctgagccccacagaggtgccctcaccccacaaagcacttccactcagacgtacaggacaccgggaggaaggcagagtgccctccacgtataccgtgacaggtcaggtgcaaggaggccccatcaagaggcctgaccacacggccctgtcctctgcagggctgcgtgaacacaggacacacagcagtgatggtccagcagccactcggctctgggcactgtgtcagttggcactgccctaggtatgctggtgacaaacggttcaaatgaccccaccatcgtgacactcgacccttttggcccaggaactgccattcacgggcacagcacacctgctcctcccataccgaacctccatcatctccgctgaccaggcaggtccggggtcctagaaccaacagggctcacccaccccagccccaggcagagccggcccctgtggaaagtgcccagccacagccaggactttacccacatgcctaggccaggccctggtcatccttccacaggtacgtgaaaggtaaatgtaagtggcaggaagtcaaatggaactgaaagccacctcgtctcctggcttccactcagaagtggtggaggaaatactctcaaatgaaatcatgtgatcctgtttaaataaatggaaaattaaaaggcagggcactggctgacccttgatgccaggaggggcagatgtggattgacgtggctctcggcccccatgggctggtattgggcctccttgggagcagcctgagagtgctcattcttggccaaatcgtgagttccagagggaaagagatgggaccaaaaaccttagggagaaccttggggccagctgcagtgggaacacatgggcaccctccacaatcctctatcctgacacgatgctccttttgtgtctccactgtgtttttcactcccatattttcacagttgtgattcaacctcaatgcttctggaacccacaagccacccagcctcactttctaaaaatatgattgagaaagcaagacagagtttgggacggaggtttctccagcggagcagagccctggcatcctgtggaacatattgtgagtgttcacagccgagaaagtaagatgactgggatgtcattttcaaagaggaaatgggccccaccccaacagggccaccgagggagaatcgcaggaggcagctcccccaaaactgggagaaggtcaggcctgggttcccccataccgtcatggtcttgagtcagaaaccagagatttgtaaacagcatcaaaagccttcacttccttctgcagccttaaagtttgaactttacatacattttagacatgaaaagtacaccaagaaagccaccatggtgagttttaggcagagaccctcttgtgaataattcgtctatgatccaagatggccagacaagaatcagggcccaagctttttctccccagtgtcacatccacgctgttgtctcctctccagctcagaccaaaattctctggacattttcatggctgaaaaccccaccagaacgctggccctgacaggaccctctcctcaagtcctgaggacccggctgcggccagccagaatgtaaactacagctcgcagaagcagcaggcatggaggaagaggcaggagagcaagagcagaagctcgaaaccttcaaagggagcctgaagaacaaggccaggagaagcagcggccaggccccaccggtttcctcctttccctcctgaatctaggacagaggccatttcagacgagagaggaaagaacaacaaaatgaactgcaggagaagcagccagagcctgcaaggcccagccagagacggcagaggagagaaccgcaagccaggagcaaggaggagacaggtggactccactaaccaaccgacgcagcccagcggagacaggcggactccactgaccaaccgacgccacctggagaaagtaaatatttaactgtcagaaggaaaacactgtttgaacagtagtggccttaggaagaaggccctaatttttttgaacactgaccgggggccattctttacccagagctactatgtcccgcgcaaggcaacactggctgaagcccaggagggcggggcagctgcagaccctcaggagcctctgctggctcagggagcgtggggagagtccagcgtgcaccagaaggagggaggccacctctccttgcggcattaggagaccagggtctctgaaagggcggggaccacggccaggccagaaccaccacatcaccaggctgaaggctggttaacctggtggaatcagctgtcttcatgttcaaaccagcacatggggctattttgctccagtcacctggtgtgacatgagccactgagactcgaacacccctgctctggagcaaagaagaacccacacctctgtcctgcctggcagcctccccaccactcgccgtgggcacggggtccgtatccactcgccgggggcacggggtccgtatccactcgccgggggcacggggtccgtatcctctcgccgggggcacggggtccgtatcctctcgccgggggcacggggtccgtatccacttgctagggcatggggttcatatcctgtcctctgtctcctctaagtgtcccttaaacttaaggccaatcctatgatttccctctaaaagcattcttccgaattctaccccaaagaaaccagtgacatttctcaacatcaggcttcctaatctctgcaggccgcctgaagaaaaagaagagatatgtgtatggccatgccatttggaaatagaagaaaagcctttaaccgccttctaccttcagctgtttttgccaagcagagaaggtccagaaagcaccttcaaaggggctgggagctctggccctgcccatccacacagcaaatacagcaagcagaaataacacgttcacaggggctggaggctcctgtcctgcccatccacacagcaaacacagtaaccagaaataacacgttcacaggggctgggagctccggccctgcccatccacatggcaaacacagcaaccagaaataacacgttcacaggggctggaggctcctgtcctgcccatccacacagcaaacacagcaaccagaaataacatgttcacaggggctggaggctcctgtcctgcccatccacacagcaaacatagcaaccagaaataacacgttcacaggcttctcctccccactcccaactcagctgcaaaacagctgataaaatgaggatgggctctatgtaagtaaacagtactcgatctaccagtttacgacatcatcaaagacatgtagagagaaaatacatacacaggtaataataacaatgataattctaatactattttgttagattagaagcatttttcctggacagaagcaacatcacctggggtcccagtggaaagcacgggccaggcgtgctccctgtgaccaggtcagagtgcagagcccgcctggtgacctcatttccttagggcaattgtaccttctgtctggagccaggtccctcttaaaggtagaagactgcagaaaataattcaccagaagcaggcatggtgcatccccaggacggatccttcaccgcacccgagaacccgcaggatgaggcagctctgcgcaagcacctgaccccctgcagagctgagatggctgctcggggactatgtcccccagcaaagcacagagctgagccagctgcttggggactatgtcccccaggaaagcacgtctgagtcttggctccagctcctgtgtatgggatgtgatttggaaatggtctccgaagagggaagccagttaaagatgaggccatcagagtggctcctaatccagggactggtgtccctaagaaggagacactggacagagacagaagtgcccagtgggaaggcgaggccagaattcccgagaacacctggtgacccagcagaggtgggagggaggcccctgtaagccgaggaatggcaggggtgtcagggccaccagaggctggaggaggcaggaaggaccctctctggagccttcagagatgcacggccccgctaagaccttgatctcagaccctggggggtgcagggcctggagagctttgcactgttctaagcctgccagtgtgcggggctccgttgccaaagccttgggcactgcacgcgccatctcagaccctctggccccacacagccagagctcagcgatgagccaggcccacagctcttcctcagggccctcgttttctctctctgcaagccttctcctttctaaactgttgttgctaagtcagaaagagaagagaaggcatcacgttgaataatatcctcgagtgataaatctgcagtatctgctgaaggtccacagataatgtgtttaatttgacaaaccagggacaagaatgatgaataaaacactacttgctgataaactggaccactgtggcctttaatattttcccagtcttcctgggttttctaaaatgtaaaaacagagctgaatgtctgttctggaagactgtgtgatctgacagacgacctcgatctcaccgtgatggagacatcaatggtgaggtcatgacttttgcaccttcctgaattttttcctgcatccctgtactcactcatttccagtatctgacatttggggtctatttggttttgaaggaaagacaggtctcaccagagggtggagcaacaaataataaagccacagaaatgctcttaattgtcataaaatattcatttataaccaatatgtttgtgccaaattccgtcactctgtgagaatacagtgtacccaagtgagagatttagaaagccctttaagctgctttttacttgttaaatgaaaaaatataatcattaggcatattcaggaattgggaaattaatgcttattagacttcaggaaaaaaagaaaaagataaatggagggcaagcagaggatattctccaggaagacagcctcagccacactttccagaaggcatcgtaatcttcagtggatgttatactcatttatattttaaaaaaagaagaaaggttaagagctggtaaataaagtgacagataaagtcagaaaaacaatttaaatcatcgagtaaaaaaggtgggcggaagtcagacgcgggggctgtttacagcagcctcaggaagatgcattaattacagtcgctgcaaaactacaaagacggtgctgctctgcagccggcgctccgggggcccgcgagcctctgaagtctctgggtctcctttgtttcttcttcatggtgcagaaggacatggtgagcagcccagctctcactttcaagggacctttggctgttttctccagcactgctgagaaagaagagcagccattctgggggctgctcaggccccggcattccagctgctgtgtggagtcttcggcttccctttcggaaacctgcccccacgcctggccctggctaagcaaaaagccaaatggcattgcactcacatccaattaacttcccattttcagcaattattgcttcgccgggagcagcaagatgccctctgtggggaagcaagggcccaggaaggggtggctgatgctctgatgaaggcccctcctctgacctctaggccacattagagacagcacagcccctggccctctcctgcccctccttccccggctttgaaagcagaggtgctgcatttggggcaagttctggtcagttctcatggtggaggagaattaaagttcagaggagggcaaaggcaaacaaaatgacaggaggaaggccggatgcagtgagtggctcctccgcctgagagacagatgccaagagacccaaggcaggtgaaaaagcgcctctgatgcacagagacgttccgtatgcaatagactcgggctggacaccgagaatctcaactgggtcaattcagagcaaaggacgcattgtgcagtgagcagtgaattcatacaacgctaaatgcagagattctaaaatggcttagacctaaaatcacagagcaccaggcatttggctccactgaccactcagagggacacatgcagggcagatggggcttaatgacatgagcagagtaaacccaggaccacaacggccccacgtccagcaccgtgtggaggacggtacatcttccatgcctccaggttttcaggagaggagctctgctgcaccacgctgggagagatgaataggctaagcttattgtcaaaaggcattactgcagaggaagggaaagtctcattatcagaaacctcaatgagttgtttcttcagatgtgcttacccagtaattttttttttctgtaagtcgctcactgatgcaatcagccaacttctgtctcccaggtgctgtgctcagagaaataagaatttgctctggagtcagaatggtttagggctagaggcatgaatctgaaggatgtcagcctaagcggcagtggccaccaagcctgacagagccattgggggccacgaataaagccttggtgcctggtggtggccaccaagcctgatggagccatcagggccacacatggagctgtggtgatcttcttgactacctgggcagtggaggaggatgtgggacgagagaatgaggaagaaacgagtcggtgattagctggaatgataagtcgttttagccatgttgtgtgataaggagtttggctagccttggtcctgttcctggaagcagcctgagtccttgcagcctcctgagtcacgggagtgaggtcatttgtggtgggcccctcggaccacacctgattgtttatgcaaatgaggtgacaggacgggggctgtccacaccaaaaagaccaacaatgtgatgggtgagtgggggctctgagccgtgggatatagtctgatctcaggagaggggagggctggtgggtgggttaaagcttgtggccaatggttcaatccctcacaccaatgtaatgaaaccttgatagaagctctgcatgctgaggcccaggtgagcatccctggtcagcaatgctgtgtgtggctggctgcacactgagacctcgatagaaactctgcactctgagacccgggtgcacatccctggtcagcaatgctgtgtgtgtggctgactgcacgctgagacctcgatagaaactgcacactgaggcccgggtgagcatccctagtcagcaatgctctgtgtggctgcacactgagaccccattaaaaactctgcatgctgaggcccaggtgagcatccctgcccagcaatgctgtgtgtgtggctggctgcacactgagacctcaatagaaactctgcactctgagacctgggcgagcgtccctggtcagcaatgctctgtgtggctgcacactgagaccccattaaaaactctgcatgctgaggcccaggtgagcatccctgcccagcaatgctctgcgtgtggctggctgcacactgagacctcaatagaaactctgcactctgaggcctgggtgagcgtccctggtcagcaatgctctgcgtgtggctggctgcacactgagacctcaatagaaactctgcatgctgaggcccgggcaagcatccctggtcagcaatgctctgtgtgtggctggctgcacagtgatgtggtttggctgtgtccccactcaaatctcttcttgaattgtaactgccacaattcccatgtgtcatgggaagaccccagtgggaggtacctgaatcatgggggcaggtctttcccatgctgttcgtgtgatagtgaataggtctcacaagatctggtggttttataagggggagtttccctgcactttgcctgctgccatccatgtaagacgggacttgctcctccttgccttccaccatgattgtgaggcctccccagccacatggaactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgcaagagagtggcctgaattcggagaagcagactctacttttgtggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatagtgtgtttacacgcatcagcatgacaatatatgcacttttaaatactctcacttcatagtcaacaagtgtctcaagtataaaactataagaagagaagaaagtctagagatgtccatttcgagcacacattgtaaaaacagcacagaccctgctcccagtctaatgcataaatactgtaaataaaaagggacaggcacaaattttgaagcattagtaaacgtgaaaggaaggaaggagaaatcccagatgccagaacagagaaagcacagagctggggcaaagagcaggcaagggaggcagctgagtgtggcagtggcaggcaggggggtctgttagggcccagcaggctggggttggggtctgcccacaggagggcagggggcaggtgctggcagcgcacccccaaggactgtgcatacctgccctgcacaaaaggaatgccaacaacccgtccacaggcaggcgggcagaagagcctctctttctcaggctctggatgaaaacacaaatgcctctcattagaaatagaagcctgaacctgtatcccacatgagtgtcaaatcctaatataataaaatactcatatatctaacataacacattgatttgaattgctaattataaaatgttggaggaacctttccaacaatgagagttcttgggacttccacaggattctcataagaaaagaaagacatcaaagacaagcatgtaataaaaaattataaaccacgtagaaaacaatctgtaatgagaaagtgtgagcaaaatttaaaagaaaacgcaaactagagaattaaccccatctgacctggagataaaatgatagcctgagacttactggcagaaattaacaaaccagaaagcagcagagagcacagacatgagcagagttgactgtttaaaaatatgaaggaaatacaaagatgtctgtcaaaattatccagaaaggaaagatgcaaaataaataacactagaaatgaattaggggcataacaataacatatacggagatatgcaaaaccacaagaaactgcaacgcacaacagaaacgtaattggaagacataagtgaaatgaatcatttttaggaaaaaaaacaaaaacacaaaatgccagaattgaattgaaaggaatggtatctgactatacttgtaaccattagttaaatcagtattcaaaaaccaactctcataaacagcactaaagccaggtgacttaaacactgttactaaagcttcaagcaacatctgtttcctcctatgcggattttagatttttcagtctaggacacaatttactttatgagatgagtattacttcgatactagcactgaaaaacagtaacacaatgaaaataagggaattccatttctcaaaaaataatagcaaccaaatataacagagggaaatcagtaaaacaaaaagtgaccaaaaaggtatatcccaaaaatgcaaaactggttctactccatgtaattcactttactaagagattaaagggagaaaaagtccagtaatatcttagagattcaagaataagatttggtccattcaaaattttttaaattttaagaaactaggaataaagcatccttaacccaataaaagttatctaataaaatccttcagaaataatcatcctttaacaaggtaaaatgtcaaagacattttcttaatgcttgggatagataatgaagccttccttgacccctttgattcaacactatttggaacaccctagatactcaatgcaatgacaaatgttaagatatacagcattagaaaggaagaaagctgcagatgacatatttgtttacatggacaatctaagagaactgccaatcaagcaattataacaaatataagattccttcaaagatacaggtcacaaggtcaaaatacaaaccaatgtgcctatatgccagcaacaaccaattatataatatcttgaaatagttagaagttaatttaaaaataatcctgatcatgttaagctacttcaaaaaattttaataaaatattttaagaactttacatttaaaaatactaaaagttcattgaatggcaaaggaatatctcactcagcgaagacacatgccatgtaagtacagaagtggatgggaagaccaaatgtcgtaaatacactctcaggtctcctaaccatggggacatgttctgagacatacatcgttagctgatgttgtgccaacatcacagagtgcacttacacacacccagctggcacagcccactgcacacccacaacctgcacggcatatcactgtactgagtgctgtaggcaattgtaaccaatggtatgtatttgcgtatctaacctgcacagcttactgttactgttccgagtactgtaggcaacgctaacacaatggtatgtatttgtgtctgaacacatctaataaaaaaggtatagttaaagtatgtgattataatcttaggagaccaccctcatgtatgcagtcagtagttgactgaaacgctgttatgtggcaatgactgtacttttgtacagttttgtccaaactaaactatacattaaatcgaaattcaacaaaaaacccaatcagtcttttttcataaatttgacaagctcatctgaaaaatgattttagaataagggacatgtagataatttggggaaagaatgggggagggttgcaattcaccttgtcagaaagatttcacattgtcagaacgattgagacaccaagtgtctactctgtaccacagcaggtgagtatcacagatgtatggtgagttagagaagccagacacatggagtgcatgatgtctgaatccgctaacctcccgctttgggtctcacttgggaggagatgctgaggggagggtctgggctgccaagggctctgtctggagctggatggtgactacacagcacagtcaacaggctctgcactaagatgtgcacactttgtatatgttatactccagtagaaattcatgtataaagtaagatgagaaagttgaattgagaaaagaaaatcatcaaggttttggaaagactgacaaacagaaccagtggaataaaactgaggagggagaaatataagtacacacatggggactggatagacaaccaatgtgaagacatacactgcaggagaaagggtatttcaacaattaaatacaagggccaggacaactccctatctaagtagaaaaagataaaattcaacccctgtctcacaacaacaaaaattcctgacagattaaagattctaaaacttcagaagaaaataagggcaaatatttttatgaaatcactagagaaagatgccatgatgaaacccaaagacttcaaatggaaaacactgattaaaaagacaccataaaaaagataaaagataagctatatctctatttttataacatatataatgcactgaccaagaactagtattcaaatataattacatacattttataataaaatactatgctatatataacacatatagcatttctatataaatatggtctacatatatatttatatgtaacatgtatatttatattatataatatgtagtatttatattagataataaagtataaaatatagaaatataagattatacataatatgtaaaatatgtatttctagaataatgacacagatattaagaatccttacattctaataataaaataacaaaaaaaaacacagcatgaaaattgaagtgttcaaacaagcaattcactaatgaggaaatttgaatggctaacagagctatagaaagctgctccaccttatttgtctgccagatacagacaaatgaaaattgtaataagatacaagtttatggccctccccctttggcataaactaaagagaggtctgataacacctaattaaattatattgtggggaaatagaaaaaatgtaaaaactgcctaaatatcctgcagtagaggaagaatgcataaattatactgtaataccatgccatagttacatataaactagatctaaaggtatctgcgtggataaatcctcaaaatataattctgtgtgaaaaacacatcttgaaaggatagctacagcatgaaaccagtcatgaaataagtccagaatgttgtgggatggaaaatacccaattccaacccatctggccttcctttcacttatgggaggaaaagaaaaagctgagaagtcctcttgaggtcacagcccaggtgtgcaggttcaggctgagacagagacctgatcacagggccagaggatgctgccctccttccacaccagaccaccacatcaataccaacagggctcccacataatgacaggggattacagataaaagaactgcacacatcagactttatttaaggagaagtctctagggaaacccaaagaaaagtagggagataaaacaaggacaccagaagaaattttagcctctgacaattacagctccagcaaacagtaaacagcctaactcacagccaggtaaagataaaacctaatgctaaaggccaatctgcctcagtttcttttatccaatacagcatatctaggtttcaacaaaaaaattacaagccatgctaaaagggaaaaaaatcacaaagagaaaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagagatcaaaatcactgtaacagagatgaggaatgcctttgatgggctcattggtagagcagacatagctgaggaataatcagtgagaatgaggatctatcaataaaaactccccaagacaaaaagcaaagagagagagagaaaaaaaaagaaaaagacaaaacagaatatccaaggactgtgggacaattacaaaaggtataacatatgcataataggaataccaggaagagataaagagaaaagggaacagaagaaatatttgaagtaataatggctgaatattttcaaaattaatgccagacaccaaatcacagatctaggaaactcagagaacaccaagaagggtaaatacaacacacacaaattcacactcacacacacagatgcacacacacggacacgcacacacatgcatatacacatgcacacacacacgtgcatacacatgtgcacacacttcacacacacacacacacaaacacactgcacatgcacacacgtgcacacacactgcagaaaaatcaaagacaggaatttttggacaaagccagagaggggggaaaaaccttaccttacccatagaaaagcacggagagaattatgctggacttctttttaggaagaagcgagtagagaatgaagtaaaatattgaaaatgttaaaagaaaacacccaacttaaaattctatgtccagtgaaataatacttcaaaactgaagaagaaataaagacttttttaggcaaacaaaaattaaaggaatttgtcagcagttgatctgcctttctttttttctttcttttttttttttttgagatggaatctcactctattgctcgggctgaagtgcaatggcacaatctcagctcactgcaacctctgcctcccaggttcaagtgattctcctgcctcagcctcccgagtagctgggattacaggcatgcaccaccacacctggctaatttttgtatttttagtaaagacagggtttcaccatgttggcaaggctggtcttgaactcctgacctcgtgatctgcccgcctcggcctcccaaagtgctgggatcacaggcgtgagccgccacgcccggtccacctgcttttcaagtagtgttaaaagaagctcttctgacagaaggaaagtgacacaggtccgacactcggatctaaacaagacacagcagataccagggaaagcattccaggcaccaccaggaagagccactgcagaggccctggagaatcctgcttggcatgtttgaggaacagcaaggaagccagggtacttggaagagatctactagttataaagggaagttcacagcaagaatacaaatgcatcatctgtattatcaataatagcttattgctttttttctaagtagttcttaacaacattgcaataaagaaacaattgaggctgggcacggtggctcatgcccataatcccagcaccttgggaggctgaggtgggtagatcacttgaggtcatgagtttgagaccatcctggccaacatggtgaaaccctgtttccactaaaaatacaaaaattagcctggggtggtggtacacacctgtagtcccagctactcaggaggctgaggcaggagaatcgcttgaacctgggaggcagaggttgcagtgagccaagatcttgccactgcactccagcctcggtgacagtctaagcaagagagagggactatgtctccagaaaaaagagagagaaaacaaaaagaaaagaaaagaaacaattgaaggctacaaatagtcaatatttagtctcttgaaaaatctatggccaaagagaaacctgcgtgcttgggtccaaaaaagcgaaacgagtattgcatgatcttggtgattctgaggccagctctaagtctttgctgtcattgacatgtgacccttcccaatcacacttcttcctacccacggctgagtctgtggtgaaaggacagacttccttcagccatgtcaggctcctttactatccttgtatcttgcaacactcttagtaatcacatcattttgaattctttatgtaaaaatgtacctgctttaagcctcagcaaagaccaatgtcaaaagaaagatatctgtatcacaagaacgatcacaggcccagtagatcgtgcggctggacacgcactttctgcccacgaaagagcctgtgaggggcctccatctcgtgatgcaatgcaccaagatgccacgggcactgaaacaccagcttttgggtgcatacttcatacccacagaaaccagagaatggatttccaaacgtccagaaaaaagaagtcaggggagtgaaacgcagagaccaggagctcatccgactgccccatcgtgcttgactcttccccagcagaggggtcgggagttccggtggattcagtgttcccatcaatggtgagccgcttcggagcaaagccaaacacagctcagaactgcacaagttcaggcaccagacacagggtaggatccacgtcactctctgcagcacagggtaatgcactctctaccacacgcatgaatcatttattcagaaagagatgagagatccatggaactgtgaactaatcctaaatataacatttccatttactttccccgcacttaacatcttcgcagtatcccgtcacggctgagttcacgtttttgctgtgtgctgctggtatcctgcctgcaagcttcgggagggcaggggcaggccaggcccagggcttcctaagggacctggctgtcctgagccacagccggctgatagacaccatagtgaagaatccgatgggtgtctgtgacagtgtctcagggccagggtgacgagcatctgctgcccactgtgccagggaagaaagggagtactggcttgcagagacttacggctgaaactactagaaaacaggttttatgaactgcctctgaatttatttgtattatgctgttttcataattaaaagaaaagcttgtaacagtttcctcatttataaattccatatttcaatacaaagcaaaacactcttggaggttctggaatccttcagtgtgcaacgcatctgccattccaagacagagaccaaaaaaatggaggaaagtttgggggaagttacagtgaaaagctcctgatgggcgtggtggccatgcccatagttccagctactcgggaggctaaggcaggaggattacttgagctcaggagttcaacaccagcctcagaaacatagcaagaccccatctcatgaagaaaaaaataccaaaaaaaagttcctagtgataaaagtaatgtgccatgtggaggggaacactttcctctaatctaagggagcaaatcccaggttttaatcccatggacagaaaaaagtgtcacctttactaacaacattcttacctattagttaaatcagagatgtgtcctgggtgtagacatgaccagggacaggaggatcagggatcagggatgaacatcagagggactctcatgaccagggacaggaggatcagggatcagggatgaacatcagagggactcccattctcgtcacctgactttaaagggttggtaagtttttcaacaaaaatactcaccaacaataatatctccccagcaccaagctcctgcaggagagaatggcatttgggtggcagacatggccgtgaatgggaaggagaagggcctgacctcactgcaaggccgtctgcattaaagaggccaatttctgagcacaaggcaggttgccaggaaatgcagcttgacatttataaacctactcaccagcctttgttctcaatgccagggcacccaagtaagcaagccttccttcccggcactgcagacacttctggaaagacccaccatttcttcagaaatgacacttcacagtgtggcgagaggggagaagcgcacagaccatcctgcacagttggctcagcatttagcaattacataaaatgtgtgagactgattgtcatttgctcaaaaaatgtgttgagcacctaacgtacgctgaccacgtcactcgacgtggcagagggagcaaagcataaagagaaaggccacacgccgaggctgtgatgggcagtgaggatatgtaaatcttatgcttatggactacatcctgccacacatgattttcataaaagtcattaactcccaaagcaaccctgcagggtgtttcagataaaaaaatttagaatagctttatctgagttacacaattttaaaagtcagcaactgaagaaatgtccagaaagtcttggttaaataaaaaacacttaagtggcacagaggcaggagggggaatcctgaagctggtgcgtctggggagctcacctctggaggagaaaattgaaccagcagactgtgggcggccacagccctgaggcaggggtggggggcgtcctcactgctgctgaatctgtacaggactctggggccccttctccccgcacatcctgcacctgcataggaattcataaaaacaaagcaagcactccaatgtgtgtgtctttctttttcctactaaatgggaacgtgttggagcttggtctaaattatctgcatcaccaaagagagcacagtctccagggctcaggcagggtcagcctctggctctcaggcaggcacagagagctcggggcctcgatcatttgtaaagactctgctgcaaccaaactcaccagcagaggacaggctgcaggaggccacaggggacaaggagaacccgtgctgaagagaccacagctggtcccaggggaccaagatgggagctctgcctcagaaacagtgtccagggctcaagtggcccaggttaacatcttctctgctacttggaaaagagatcttttcctgcaccataggccgacaggtgccagttcggcgatgactaagtacaaaagagtctgctgcaggagcaacatttaattctcaacgagagcacctggaggacaccaggaggagcatcacagacaggaaaaattataaacagtgaagggcagccccaaacaataacaacaacttctcttccttagacacccttgagagttatgtcaataaccactgctcggttatattttacagaaagcctttctaaattaaaatatggtgctatccacttaaaccctactgggctgaacttacacatatgcatgatattgacccctgaattgatcagagattgatgctgaaaccacccaaaagcctccatgactggaagcttgatatctgacccggctttaaagaaagttggtggctttgggacagcagtcatgtggcgcacagcagcccattctttgtttccagcaggcagcaacaaatccgtgaggctgagctagcccctctgtcgggaagctccaaatggctggagaaataaattttttattaaaaaagtaattggaaagatgtttacattaatcagatttctaatttttcacttctccatggtaaagatcccagctatccagataaatgccactcagagcacccacatctcctggtggtcttggccttgtgtcagcattctaaatactcacatccatagcaagacatgagaaacaggaaggagaggaaagaagaatcagagaggtgtgccccaggacgtgggcgcagctggcacattcagagacggtctctgaattgcagatttcagagattgtttagcacagacatcctgttttatcatttgaaacctaaggaacagagagtgcaaagggcttgccaatagttggctagctagtcagtgagagacccaggagcagaacctgtgatcctggcgtcctgacactgccttgttctgtccaggagcagaacctgcgatcctggcatcctgacactgcctcgttctgtccaggagcagaacctgcgatcctggcgtcctgacactgcctcgttctgtccaggagcagaacctgcgatcctgacgtcctgatactgccttgttctgtccaggagcagaacctgcgatcctgacgtcctgacactgccgtgttctgtccaggagcagaacctgcgatcctggcatcctgacactgccttgttctgtccaggagcagaacctgcgatcctggagtcctgacactgccttgttctgtccaggagcagaacctgtgatcctggcgtcctgacactgcaatcctggtgtcctgacactgccttgttctgtccaggagcagaacctgtgatcctggcgtcctgacactgcaatccttgcatcctggcactgccttgttctgtccaggagcagaacctatgatcctggcatcctgacactgccttgttctgtccaggagcagaacctgcgttcctggcgtcctgacactgccttgttctgtccaggagcagaaactgcgatcctggcatcctgacgctgcgatcctggcatcctgacactgcgatcctggtgtcctgacactgccttgttctgtccaggagcagaacctgcgatcctggcgtcctgacactgccttgttctgtccaggagcagaaactgcgatcctggcatcctgacgctgcgatcctggcatcctgacactgcaatcctggcatcctgacactgtcttgttctgtgcactgcccttcagggactgaggcaatcccgcgatttctcatgtggcaggttctcagcaccacaccttccaccatgacctgaggcccagctggtttctaagaatgcactgttatgcagcagctctgggactaaaggatgtcgagactttaaaatactgtggctgcaggaaccaggagaggatgccgggctgggtgtcagaacacagggaaaagccatccctgttagccaccttggcatgctcttgagtttcctgaagcagatttcctaacctgacattttggagacggcaggacgggtttctcagcaataatccctcatctgccattgaggcgccgagctcttgtcttccttcctggtgtgtgtaccgctagctttgcaccagttccgcccactcaccaaaaagtccatctaaatccatccatgcttatttttaatttaaccttaatcctgcaggatcagtacaggggcaggcaatcaggtttacacaagggaggcgagcggctgcgagggaggcctggcctaaaaacgcccccgcccctcgccccggaatggagcctccagatacactcaactcaaaccacatcccattcctctctcatgcaaactcatctggtcacagagcatttgctgagtgcagactctgtgtgacacacactgctactttctgaggaacacacagatgaatacaacagtccccatgggcaggtttagcagggaagaagcacagtcaccgaagtccaaaaaagccaggctggagcccatgggccatgcagaacaggccaggagccgagggcaggtcactcagttccctttctctcaaggagctttcagctcaggagaataaacaaggagtatacacacatcatgtccaagggcaatcttagtaaccacaaccaaagaggctggagccactgcacacctcagggaaggagaggccacttgtgctgtgcgaggcctgcctgcagtcactgagcgtgtgaggcctgcctgcagtcactgagcatgtgagggctgcctgcagtcactgagggtgcgagggctacctgcagtcactgagtgtgtgaggcctgcctgcagtcactgagagtgcaagggctacctgcagtcactgagcatgtgagggctgcctgcagtcactgcgcttgggagaggaggcacggcacatctggcgtttcagagccgatggcatgttagaggccaccggggagggacagctgctgggcacagctggtgcactagaagcagctgaggtccattctgcaaaggagagctgaggctgggttgcacagcaaagcacagagcaacatgcagccagtcttttctcagtgcaaaatgggcaagccgggagctctcaagtgagtcagcaacccaccaatgtggcattacaggaggatgaacagggcagtgcaaggtgacctgggggtaggagtaccgagcacatggaacacacgtaaggcagctccttgttcaggcatgaggcaggaagagctagaatggggccgaattcagagcaacagggacaggggacccgatggatatcgaaggtggccaagaatggtgcatacacactttcttctaaggacactttctgtctagatagaaactcatacatgaatacacatatgtatacacacacacacacacacacacaggtcagtaccattctttcaacttttctgtttgtatattttcatcataaaatattggggaaatggtgccttttcatctctgcaatgtgagagctctatagcatcagaaactctccttatcttacagaccatgtagaaacatgtggggaaaagtcctacatgcatctataaatcaccaggtcctgctagccacgggcatctcctcttggtcctcatgttacattttcttagacttaagttttcttcatagcaagggaacatgacttgactctgaaaacttgaatgatgtattttaaggtgagtaagttacataggaataatgtatatccctatcatcattgttactattgccatcatcaccatcaataagcatcataatcatatcatcccaccagcaccatcatcaccatcactatcatcatcatcactatcatcatcatcactatcatcatcaatcacatcaccactaccaccatcaccatcaccaccatcatcatatcaccatcaccatcattaccatcaccactgtcaccatcacatcacaaccaccatcaccatcaccatcatatcaccaccatcaccatcatcactatcaccaacaccatcatcaccctcaccatcatcactatcatcccaccactaccatcaccaccatcactatcatcatcaccattatcaccatcgcatcaccaccattaccaatatcactatcaccatcacattaccaccaccatcaccatcatcaccatatcaccaccatcaccatcatcactatcaccaacaccatcatcactatggtcccatcactaccatcatcatcatcactatcatcatcgttattaccatcacatcaccaccatcaccatcatcactatcaccaacaccatcatcaccctcaccatcatcactatcatcccaccactaccatcatcagcatcactatcattaccaccatcgccatcatcagcatcactatcatcatcatcatcacatcatcaccatcaccatcaatcatcattgccaccatcgccatcaacagcatcactatcatcatcatcatcatcattgtcatcagcatctccatctgactggtggccctggaactcctcctttgtcctttcagttgggcatctcccatcattcccccagccatctccactcccgattctctgtgccgtcttcctctacatgttcagccctctctgctacactggtgggtgactccaactccgacactacatgctctgccctgtcttccttcctttcacagctcttcatgctcatctcacctcctgaactgctgcctgagcatccacaggcctgaagccaggactcactctttcggactgaccctcagctgatccttgagctgaagttccttgaggaactcggcccaacattatatttttccatggcaccagcctcacagctgatcccacatggtcctcaaagaatgcaacctgaggccgggcgcaggggctcatgcctgtaatccccagcactttgggaggccgaggtgggtggatcacctgaggtcaggggttcaagaccagcctggccaacatggtgaaatcctgtctctactaaaaattacaaaaaatgagccaggcgtggtggcgggcacctataatcccagctactggggaggctgaggcaggagaattgcttgaacccaggaggcagaggttgtagtgaaccaagatcgcaccattttactccaacctgggcaacacagcaagattccatctcaaaaaaaaaaatgcaacctgatagaaatgtggtgctcagttcttatttgttgcaatgtagctattacctttggttcctgaaggagttgaaaggggcagggaatgatgcaggcacacattaattcactgctagtgacccccattttattaggaaagaaataaaatacatgtagggtaatgggcacattgtgatttatataacaagcgtgttcctgaaaaggtacatcaaagtcagaatgcttttgaagtggcctcagaaaggttactgtttaaaacactgttattagaattactttaaaaagagtgaaaatattcagggaatgcagccttttgtagattattcatgttctaaagtgatcatgcttatatttttaccttctgttagaatcaatgaaaaacttaattcataattctactaagctacaatttgaaaatatcttgggtgcaattttccttcacatttctttggctcagtgtcctccagatttaccagtgacaacaaagtcacagcaacctcaatgccttttactgactcccatctgcagagcctcaagccaactccctctggaaactcctcctgctgttcttagaagtctttcgggcatccagacagtcctctggttctctctgagcttccccaagatgcaggagccacccagcttgcatcccacagcctcccggcttccctcagctgcacaccctcccaggtgccaggagcacagctcgggccccgctctcccccgtcacgctgagctctgtgctagggtgggtagggaaggcctccttctctgcagaagactcaggccaggccaggttcccacaccattctgtcccccacacgactcttccatgccagtctccatctcctcaagtacctgcctaccaagaaaataagtcctgttccttcctctgtgcacacctctttatgcaaagaggcactgaaagctcagaggcctcagcagccccgtctgggttctggctgcactcagggatgcttgcccctcccgctggaagtgctctccccacggcaggagtgaggagcactgagacaacagccacctggagtggaaggtcacccaggggcacgccatggcggtggagccaccccggggatttcttcttcctttgccagtctctgcccaaaagatgaaatgcagagatgtggtgtgtacatctgagaagccacagatgctagcagtgcccatggggggcatctgcagggggcatctgttgggggtctggagggcactatgttgtccccaagggccccatccagcacagagcagtgtcagccagctctcagcagtgtcactttgtggaccagcccagctctggaccagcttgctgaggggagacggcacagtgcagagagaggaaactgcctgatctccgttccagatgtaacccagttcttaggctattatgggactgtggggacattaaaggacaggaagcacagccctcccctcaaacatcagaacttcccaagactcccaaggagctgctggccccagcctgggtccctcccaagtctgtctgccagcagctgcaaaggcctcacataccctccctgtgtcaggtgcaccaaggttcctggctgattagcaccaaggaggacaaaagcaggccttttgcagtagctgtgtctgtctgtctgtctgtctcaggaagctggaaaagtggctaactgaattacatccatgtcgtgctcccccggcgagcgcccgccaccttcatcttttccccttttggtgacgttcagcactgattacaaagtgtctcagctggtaatatgttcacttcattttttttagatgtgttttttattcagttcacagatgaatccaattagcatatcactgtgactgattaaatatgcctcatgtaaatttacatgtcaaaatacacactgtacttaaacaagtaggcccggctgccaggcatctgtaaacagctttgcaggcttggccagctcgaaacacaaaagctaagatttaaatgtgcggtgactacctggtagagagcgaggaagagggaaaaggtagtgttactcatgcatgaggggagggaatgaatatagacatttgtctctctttgtctctgaagggaggccattgacaagagagtccccatctgcataggaggctgccacatccaattagctcaccaggcgatggaaattgcgcctctgatccagaaaagtccctgtgcactaaagtcaagactgtttcaaagagattatattatcttagacagcaggattaaattaatatggcaatgacttctacgggaggaaatgtttttgtgaaacgtgctaatgtttattatgcattctccatcataagtgatcgcctttgatgttctattcatttgttgattggtttccgacttcctcttagaagggagtgaagaaacccaggtatgaaaattggattgcgaaagttaaagacagagagaaagccttaattagattcctctagaagcagtgactactggttctgtgggttattgggggaagttcttaaaataatgaaataaaattaagtgtggtttggccaccaagagcatcagcaccaaaggcacccagcctcctggggaagccctgagtctccgccgcatggatggtagaggggtgcggccgctgctttgcctcgtgggggccgtggaggggcgcccttcggacctcctggagagggtagaggggtgcggccactaatttgcctcgtgggggccatggaggggtgcccttcggacctcctggagagggtagaggggggcggccactgctttgtctcgtgggggccgtggaggggtgccctttggacctcctggagagggtagaggggtgcagccactgctttgcctcgagggggctgtggaggggtgccctttggatcttttggagacacctggccacagttcccagccactcggggtccaccacgttccctcgaggccaggctccacccaggctgtccccagcctaggacaaagctccctgggctacagggacagccctccctggccagtgccgcccttctgcgaactgcacctcgggggctcctgctggggtctgaggctctgccgccttctccctgcccaggctggcccccatcgatcccaccctggcgtctgcttcccaagcacccagtgggcacaacccccagaagcacagtctctctcagtcctgggaggggattttttttcaatttcaagtcatgtcaataaaagtgattttcataaactaacctagaggaatttttatggctggggagacacaggcttacctgggaatttctgagtgtgccttcatggttgggccatctgcagctgggaactaaaaggcgctttaaaaatgactgacactgtaggaaaatctcacaactggagcagatgagccatagtgactgagggagaaacatgagctggatgagaaaggagggcctgcaggcaccactggaagggcccagcatcctctcacagcacagcgaactccgatgtggctctgactgtttaattaacgtgtagctaaagatcacagaaaaggggaaaacagcgaagacagaaaagaaaagaattcagaaccagctttagcttctgatattatgggaaattctgaagaggaacgaatggtatgacaaaatggaaagaaacattttcctggtgtgttttataaacacacgtaaagaggttcaataggtttaatgtggtaaaaggagatgtatttaaacatggcaggcatttgcccgaagctgcttgtaaataagctgtgggacagccgctgcggaagatgcagagaccccagagatgcagagaccccagagatgcagagaccctagagatgcagagactccagagacgcagagaccccagaaatgcagagactccagagacgcagagactccagagaggcagagaccccagagatgcagagaccccagagacgcagagactccagagacgcagagaccccagagatgcagagaccccagagatgcagagaccccagagatgcagagactccagagacgcagagactccagagatgcagagaccccagagatgcagagaccctagagacgcagagaccccagagatgcagagaccctagagacgcagagactccagagatgcagagaccccagagatgcagagatcctagagatggagagaccccagtgatgcagagactccagagacggagagaccccagagatgcagagaccctagagagcatgggggccctagagagaagtcactgacacacaggtttcggctaaaagttactattctgattagggcctgtgtgaagtaggaatgtgcctgtggagtgtgatgtgaacacagctctccgaaattttcccatgcgtgggccgattcgactgtgtgcttgtcctgagaccaagaagaaaactgctgaagtcccaaagtgggacagggttggggacaggacactcctcaggaaagaaaggccacaccctttctgcagacactcaaaaagactgctgtgtgggatgggggacagagcaagagaggaagacacgaaggaaaaacacacatttaccggctgtttttgtctgtgagtcgagtctatgaaacatgccgtgagattattttctgcggttgattattcatgcaacgaacacgtcagaacaccttcaggtggcccatgggtgaggtctcgcaggtgcagcctcctctccagaatctggcaaccaggagaggccctttggcgggcccagtaatgggggtgcatgcacctctctgcccatcccacacctctacacggctgctcccaggcaccagagcctccacctaccccaaaccaagtcctgcccatagtgtgccccgtagcaccgtcagccctgccttccatgattgcagctgatgtgcctgggggcgcgggcaccattaattcctgtatcttcccctctgtccaatccatcaccaaatcccactgctggcacctccaagacacctgcagactgcagcccgcacgccagtgcccaaggtcaggccaggtggcccctgcctgctccccatccttcgtgctctgcccagccgtccccttcactgtggtcagagctgtgggcggtaagccacccaggtgccgaggcaagagactgagggcacgaactgttccagtgtaataaaatatgtaaaataagaatagttatactagatctagatcatagatatgattatatatgaatatcattcatcattagtttgtagcaattactctttattccaatattatcatagtctttgctctataatcataacctaggaaaaaccaggccatacagagatagtagctgaggggacacagtgagaagtgaccagaagacaagggtgtgagccttctgttatgcccagacagggccaccagagggctccttggtctagcggtaacgccagtgtctgggaagatgcccgttgccaagcggaccgtggtcaagcggtagcgtcagtgccaaggaaaaacacccgctacttagcagaccaggaaagggagtctccctttccctgggggagtttagagaagactccactcctccacctcttgtggagtcaggcccacccgcagttatccggaggcctaaccgtctccctgtgatgctgtgcttcagtggtcacgctcctagtccgccttcatgttccatcctgtacacctggctctgtgttttagatagcagtagcaaatttgtgaaagtactaaaagtctgatatgcagaaataatggcgtaagctgtctcctctctcctctgcctcggctgccaaacagggaagggccccctgtccagtggacacgtaacccatgtgaccttacctatcactggagatggctcacactccttaccctgcccctttgttttgtatccaataaatatcagcgcagcctggcattccgggctactactggtctccgtgacttggtggtagttgtccccagggcccagctcttttatctttttgtcttgtgtctttatttctatgatctctcgtctccacacacggggagaaaaacccactgaccctgtggggctggaccctacacagagcgacacttctaacggggccctgttccagaccccactgcctgtgggtggagtccgggccgaggccccttcctctctgtctggttcttgctgcttttttcagtctggaatcttcggaggctcttgctctgctctaatgcagaccttctcccacacactccctccacctggaagctcctcctgccttcgtattggccttggtaactcccgcaggtcctgctaatctcgcctgaaaggtcacctctgccaaggagtgttaccctgccccagacaaggtcagatctccttaatggatgccctgagccatcacagcatggccaccaggcactccccggggcctcatccacacagaggccgggagcaggggggcacacctggcttgttctctgtccccatgggggcggcaggcactggatttggtgctcaaacagtgggtgctctctccgtcctcccatgagcccaggggaaagtgttgggaaaaacacatttgtaaaaatcacttttgtgtgcatttttcaacagaacaaaatacttccacatgtgcctgggtttaggatgggcaggagaagcccctgaaagggtgctcggtttgacgatgggatgttttcgtgtgcatcccgtcaccagccacagcagacccgttctccacaaagctcggtcagctgctggagcaggagtgtgctggactcctgctgctgcttctccagcgtccagtgaggcctatttcttatagctacattttgccaatgcttttgagtgattcttgttcagtgcctacaatcaacacagcaggacagtggctctccctggcagtgcctctcattgacccccttggagtccttacagaagctgcacattaagtcccacgcatcatcccaggtcaggggacggtgagtggccatccagcatggtggaagcaggtgcagctgtgccacccacatcgggacgcgtgctccactcgtggcattccaggctcacaatgtcgcccttatccgatgatcagccacctcggatgtgtccatcaagcttttaaaattcacaaacaaaaacaaaagatgcactagacccacccagcgaccccaaggtcacgccctctgtggttattggcaactcggggacgctgcccagctcccgattccgctcagcacctgtggacgcgggagcatctatcatcaatcctctgcaattctattttatgataaatacagaaatgacccttaacccacctttccctcctttttgctttttcctattgacacctgcccagcacatctgcctctcggcaaccacagaatgaaccagaaactttgctcttctgctgtgcccacaggaaactgaatctcctgacagcctcccatgactgttctgctagaatcgtcaaacttggggaaaaacaggatttgagatgaacttccacgttacaggcagcaaagcccaatgatgatggtctctttttcaggacaagcatttggattccataacacagtcagtcacagaccgagcaggtacacccgaggaatagcctctgcagtctcacctgctggccccacaacagagttctggattctttcctagtctgtgtttgggaaacacacgtaacgctgtggcactgtggcctggagtgggtgaggcagacggccagctgccctcccctcctgagcaaagggaagtgggtgcatggaggaccccagagagcccaggccccacttcctcatgaggaaaaggaccacagcaaagtctccaagaacccagcctcagcatccccgccactccccaaagctcctcagcgtggctgcttgggacccctcatctgcccccatctgccatgttcatgtgcacaaggtccacaacggcagccagaccacacctggaaagacacacagcaaaagcttcccaaggaacacgggccgtgaaggagttaaagtcctcaggtctacgaatacgacattatctttttttccttgtttcctgctaatctgtttaatgggaaagtttccctcctcacaacccatatacagaatgcttccttagttgcaggctttacaaataattatctagaaataaataagtacaatgatctattgtaagtaaatctgcataaagaagagttttcttttcttccatgaaaatctagccacttactgcagtagaatcactacactccatctgcgcacggtgacgcatcactgcagccacactccatctgcccacggtgagacatcactgtagccacactccatctgcccacggtgagacatcactgcagccacactccatctgcccacggtgacacatcactgcagccacgccccatctgcccacggtgagacatcactgcagccacactccatctgcccacggtgagacatcactacagccacgctccatctgcccacggtgacacatcactgcagccacactccatctgcccacggtgagacatcactgcagccacactccatctgcccacggtgagacatcactgcagccacactccatctgcacacagtgacgcatcactgcagccacactccatctgcacacggtgagacatcactgcagccacactccatctgcacacggtgagacatcactgcagccacactccatctgcccacggtgagacatcactgcagccacactccatctgcccacggtgacacatcactgcagccacgctccatctgcccacggtgagacatcactgcagccacactccatctgcccacggtgacacatcactgcagccacgctccatctgcccacggtgagacatcactacagccacactccatctgcccacggtgagacatcactgcagccacactccatctgcacacagtgacgcatcactgcagccacactccatctgcacacggtgagacatcactgcagccacactccatctgcccacagtgagacaccactgcagccacactccatctgcccacagtgagacatcactgcagccacactccatctgcacacggtgacacatcactgcagccacactccatctgcccacagtgagacatcactgcagccacactccatctgcccacagtgagacaccactgcagccacactccatctgcccacggtgacacatcactgcagccacactccatctgcccacagtgagacaccactgcagccacactccatctgcccacggtgagacatcactgcagccacactccatctgcacacggtgacacatcactgcagccacactccatctgcccacagtgagacatcactgcagccacactccatctgcccacagtgagacaccactgcagccacactccatctgcacacagtgacacatcactgcagccacactccatctgcacacagtgacgcatcactgcagccacactccatctgcacacggtgacgcatcactgcagccacactccatctgcccacggtgacacatcactgcagccacactccatctgcccacggtgagacatcactgcagccacactccatctgcacacagtgacacatcactgcagccacactccatctgcacacagtgacacatcactgcagccacactccatctgcagtgacacatcactgcagccacactccatctgcccacggtgacacatcactgcagccacactccatctgcacacggtgacacatcactgcagccacactccatctgcccacggtgacgcatcactgcagccacactccatctgcacacggtgacgcatcactgcagccacactccatctgcccacggtgacgcatcactgcagccacactccatctgcccacggtgacgcatcactgcagccacactccatctgcccacggtgagacatcactgcagccacactccatctgcacacggtgagacatcactgcagccacactccatctgcccacggtgagacatcactgcagccacactccatctgcacacggtgagacatcactgcagccacactccatctgcacacggtgacacatcactgcagccacactccatctgcacacggtgagacatcactgcagccacactccatctgcacacggtgacacatcactgcagccacactccatctgcacacggtgacacatcactgcagccacactccatctgcccacggtgacacatcactgcagccacactccatctgcacacggtgacacatcactgcagccacactccatctgcacatggtgacacatcactgcagccacactccatctgcacacggtgacacatcactgcagccacactccatctgcacacggtgacacatcactgcagccacactccatctgcacacagtgacacatcactgcagccacgctccatctgcacacggtgacacatcagtgcagggtagaaactcccccatctcccatgcagcccccagcggccgccatcacaggtctcactgtctcgccgtgtgtgtgtaacctgctttctccccagctcccacggctgtggcggcacctctccgtctctgtctgcgcatggccgctctctgtgtctgtaccttcacgaggtgatcccctcttctgctaaggacacagtcatgttggattgggacccaccctcatggagtctgacctcctcttattgacatctgcaaagatcctatttccaaataaggccaaatccacaggtagcaggggttaggttttgaccataactttctggaggtctcattatccccacagcaggtgtcacccagaaatggttgacagagtgtccactgcacaccaggcagcctgctagagacattgcattcattacctttgcctatttatgaatatgggaaggttttgcaaagcgatgaatggcatggaaagagaccatgtaggccttgctaagaaggatggcctggagggatgaagaaggacctttcaaggctttttgtttgaatcgaaagtttcctttattaagttattttaccaagtgagcttgtatcaaggctgagctttcagcgcagtatttatgagctgcatttctttcaaaacattctatcaaactgacatttccttaaatcagactgaccttccacaatatggaataaatcaggtggtttaactctactgactaaagagtgttttccccaaccctgagccaggcggctttgtccgtgtcgctcagctgccggctcactgaagggtggtcatggaagagcaggccgccgtcgggcggtgactgattacaatcatttgttgtgatgcatcgcaaattaaagggacaagcccagccaagctgctccgctcagagagtgcgcgtcccgcctctgcaattactgatgtgcacaaaggacccagggaccacttaaaacaaggggaggactgagtccacgcagggatgaagccacaggcacagtccccacgtgcttgacagtggccccgcaacccacctgctccagacacctgttccgagggaatctctcccatccacctgccgctgtggctcagaccccaggcacaacacaagcgctcggcagagaaatggaccgtgccgccaatgcactcggcgctgaaccatcattgaggagagaccagctgctgctgtggcccctggggctgcagcataaacagtcgtggtggcaaagtggtgtccacaattacttgtgtcgtccgtgagcacactggctgtggacggaggaaggctgtggctccaggattgtcatttcagcaccgctgcccatggtccaagagccgtagctgagatgcaatgggggtgtccttcatcaccggtccccaggaccacacctgaaggacctaacaatgatcctgatgagaaggttgttaacctgtcaaagcatcaagatgaaacatcacacaagacgctctgagcaggaacccactagtgacagggcccttcgatccatgtggaagtgcctaatgccacttttttgatgagcaaaaatggcagctaataatttaaggcaaaaaaggaacacaatccagtatgacagtttttccccaaccagagggagtgcccatgcgtggtgtcccacgaaggcggagctgggcatgagcacggccatggtcctgctgtcagagcaacctcattccacggggtgagcatctcgcaccttggtgcggaagcccagagcccacgctgacttctgcaatagcctcagtaaagcgacgggcgacggccatggcacagagcactgagcacagaggttatctgaggtggcttcgcatcagctcacagcagaggagcgttggcccagttcacagatggagaaaacaaggctggaggagaccaacgtgtccaacatcacaggtaagtcaaggctatgggactgaaactcagtcctgtggacaccagccagggctgcaggtgctggctgtattcctgctgttacagtcagtgcacatgtgtgtggggctctgcagtttcccaggtactgtcagtggcagtgaaaggtgatggcgtgctggcagcccttgcagccctcgctcactctcagcacctccttggccttggcgcccactctggccctgcttgaggagcccttcagctcactgctgcaccatgggagcccctctctgggctggccaaggcctgagccggctccctctgcttgtggggaggtgtggagggagaggcacaggcaggaactggggctgtgcgtggtgctcacgggccagcacgagttctgggtgggcgtgggctcggcaggccccacactcggagctgccagccagcgctgctggccccaggcagtgaggggcttagcacccaggccagcagctgcggagggtgtgccggttcccccagcagtgccagcccaccagcactgcgctcaaattcttgctgggcctcagctgcctccccatggggcagggcgcgggatctgcagcccaccatgcctgagcctccccttcgccatgggctcctgtgcggcctgagcctccccgacaagcgccgccccctgctccgcggcgcccagtcccattgaccgcccaaaggctgaggagtgtgggctcacggtgcacgactggcaggcagctccgcctgcggccctggtgcaggatccactaggtgaagccagttgggctcctgagtctagtgaggacttggagaacatttatctctagctaaggggttgtaaatactccaatcagcactctgtgtctagctaaggtttgtaaatacaccaatcagcactctgtgtctagctcaaggtttgtaaatacaacatttagtgctctgtatttagctaatctgatggggacttggagaacatttatgtctagctaagggactgtaaatacaccaatcagcactcttgtgtctagctaatggtttgtaaacacaccaatcagcactctgtgtctagctcaaggtttataaatacaccaatcagcactcagtgtctagctcagggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaacccacttgggtcccctttcacattgtggaagctttgttcttctgctctttgcagtaaatcttgctgctgctcactctttgggtctgcactgcctttatgagctgtaacactcaccatgaaggtctgcagcttcactcctgaggccagcgagaccacgaacccaccagaaagaagaaaatctgaatacatccaaacattagaaggaacaaactcgggacacaccgcctttaagaactgtaacactcactgcaagggtccgtggctttattcttgaagtcagtgagaccaagaacccacccattctggacacagcaggtcagggaatggggtgccctacagagtttccagaaggcaaccacgacaaaacctaataccaattagctaatgaccattctacacacttacacacatatgtatgtgctcagaaagtgagacacactcagtgagagacacacactacatacaatcactcacacacacagtgagacacgggctcatacagcaagacaacacacatgctcagtgagataccacaattccaccagcagggaccatctcagcagaatgtggccatgcaggggcctgtgcctgctgctagaggcgacgaggtctcagcctctaagtacaaaccttcccacatacgaggacagagaaacctggggtgaattccacatagttcatctaacaaacaggcatcccgagcaagttggggtttaaccgcattgactctggcaacctgaacatgtgctgggtgtccaagtccagggctcagaagcagctggagagcccgggacatgcacagcattctcctggggacgtctctcaggacctgttacccagacgaccaagacgagatgcccaggacagccacagcccccgggagagcatgggaggtgcatgagggagctgtggggccagagactggggtcacagccatgggggagccgggggagcctggggagcccagcgctgtgaggttgcttggacacactggtcacgccggacactgccccatggtttcctgtccagctgtttcctggaatctggctgctaaaaagagagccatctacacactgtgtctgagggacgccaaggactccttcctccccagatgctcctttttcttctcctcagggcctctgtcatctcccactcaccaaagccccccctgtgccagtgatttccagaagctgactggtgggggggacattttctacttgcaggggagggaagagaaagggtcaccctccccgcaacagaactgactcctggctcaaccccattctcctccaagtcacagcgtggctctgtgatgactgctgggctgtcgggtgtccctggggaaaggagtgccagggcctcctggggatggggcacagagtggccaattttatggatgatggatgcttcacctgcttccaaaggggctgcaggcagcgcaggcataaacactcagcttaataaagaccaaggctgagaaacaagtaatccaggggaagaaaggcagaaagatggtgctgcgcatctggtaattgactgtaatctggcatacttctgggtgagagaagctaagcaggtgagcacaaaatctgggagtgagattgccgactcgggacgagagaaacgcctgacatggcagtggctctgactgtctggtggcaggaaccatgcagttcaccaggaacaccaacgtctctcctggtcatgggccccaagatgcactcaggcgtgtcctggctgagagacttggcggagcctcctcagcagcttcaggtgagttttctcaatgagtttcttacctcgcacccttcatgaaaaccaaggacataagatcatgggggagtcctgtaaggtctaccgaagacttactccaaaatgcaacgtgcagaatcctgcagtgagcaggggcatggtttgcggaatatgggcctccagaagcagctgtgttcacatggtcatctgaccaagtcagagccaagtctcaggtcagtgctgaaagggccctgggctaacgggctgcggccagaaagacagtggctggcggggcagatggagccatcagacccggggggagggcaggggctgccaccaccacacggcccccacgggtcagaccaaggttttgtatttcacaaccagcggataatgagttgagttgttcactaaactgacgctcagaactcttattcattttcagaacagtaaagtcaaaactccacgaggaccttaaaaaaaaccatattctggatttaattacagataaaagaaatctgacttctattaaaagaggagaaattgcgtatttaaaatggaaattaccccagagcatgggaatggcactgtctttctgtcttattttagaataagaaattatgtggccattcaattcttgaagaaaatgtttttaaaagggaagaggtggatgggcaggaatgcatgcaaagagtttcgttcagggaaagatcctgccctggctctctaacctcacacagggacgggctttctttccatgcctcagtttacctatgtgtcccacgtccctctgacatgacgttgtatgtttccatttatttcctctgaaaatcacataatatgctgctttgtttctctagcaaggaatggctgtgagcttgggggtcttgaggctcggaggcatcacaaaaaataagactccgtcagcaagatggtgtgccccctctgcctccctctccgttcccaaccaccagcctgggatggcaccttccatgaggtggatgagtcccctccattcaaggccttctctgcaaacagccacccttctggctccaggatgaaatgaggctctaaatatgggctgccaggctcagggccagggccgacaggcacactgacctgcagcatggctaccccaggctctctctggcagttttgccacagaatgtgctctaagctgtgctgcttcctttccttcaaccacctcccaactcctcagtatggaagggctctgagtgctcaaaggaacacagccttttcagctggtgtcacaagacatttacaaaacaccgtggagaaattccaaaaccaggcactgtagagagacagaaagtagttttccctacaggagaacgttaacgctaagatcggctttagaaaacacacacctgacacctgagttgtggtgactctcacctggtgaagtcccttacgaatacatccttacccagattgtatactttatgggaaaattaataatgccaagcagacggcaaggctggcaggtgactctggacctcaggatgtgacacaaaggactggtcctcgtgacttgagcacatccctgggacatatggggtggctgagggctctgcagagagaaacacttcctcagtggggccctaggcctgtcaagcgggaaataaagacgaaatcttaagcagattttcaatcatcttccttcaatatcagcaaatcccacaaaaattacagtagggagtagttataggttgaaaggttagagctggggagaaaagcaggctatattttcctgttttcatgaaatttctcttcttacacctggcacctaagcagcctgctgctgtagttactgttcaggttactatggccacaggagggctgaggcatgttagatgggtggagggcaagggaagggttgagatgcaattcttatttccacgtatgtgataatgctgttgcaatgcttttcagcgaagcctcctcctgcacccagggtgtctcctgatgcagaggggccgtttccaatgccttgcagtcgtctaccttccctgccgctgctccggccagcaggcatttgctgagtgtctactgtggaggagctcccagctggcagggggcaggggtttgtcttcaggagctcttggactgcagctgtgagtggtactcggctccagtgccattgaggtccctgggggctgctcccaatggcttgctggccttgcctccaggacatgttctgaacctctggggtggggcccaagagtctgcgtttttaacgacctccagctggtgctcaggggccccgtttgcagaactgctgttctacaatcttgagaaaaggtttctgtaacgggctggagagtgagtgtcggaggctttgtgggtcgggcagtccaccgtgaccacgcagctctgcctgtggcgaaagctgccagagacaaggcgtgaaggagtgagcgagtgacagagtgagtgagtgagcactgttcccaccaggcttccttcccagagcagcacaccgggtcaggccgggccgcgggcagcacaccgggtcgggtcaggctgggccgtgggcagcacactgggtcacgctgggccatgggcagcacactgggtcacgccgggccatgggcagcacaccagggcaggccgggtcatggtgtgcttagaatttggtgaggcggcagggtcggggcagacagggtggggtctgaggacagccgctgaggctcttcctgtggggtggcatggaccttgcagctgggagatggcaggaccgggtatggggaaaggagggaggaaggcaggcatgctgggctggaggagagctgagccagggtgggcaacaggacttggtgggggtccaggctgtgcagtcccaggggaagaacggcccatgccagcggccctgactgagcagagcaggccagagcgtggggacttcatccctcagtgtccctgtcactccttcaacatgaaggagaaagccatgaaacgacgcaggtggctgtctgatcaggcccactgggtgctgagcttgctgtccccgtggggtgcccgtgctcatggcagccgagggtacggtgcagtgcacaggaggcccaggccacagctcccacgccaggaccattagggacccagtgcagtggctggactgcagctggggcaggagctgctgaggaggtgggtgcccagcaccacctttgcactcggcaccacctttgcactcagcagaacggaggccgcgtcctcagggaagcatgggcctgcattggtacggcttcactttaaaaatgcatcatcaaaccccgcaaaccactggaaccgggtgcctattgaatgtgagcactcagcccaaatcatcactgtgaactaaggtatctacacctgcttcattctaaacagaaatgcagatctctctaagcaggaagcaccttaagctcctgccaccagcattcattgggggatgtcattttggtcggtcaagggctgtgaagctgatgggattttcaatttgtaccattttataccacatgaggaaattgtgtaattacttttgcccatgacttctcattcttaacttgctttctcatggattacaactgtaataagacaaggtgttgatagagtgcaaactgtctttaaatttaaaaggtctaattgtacatccacctttaatcagtgctaaaatatcaacacagattgaaacttcccttcccaagctgcctgccagaggatgtgataaccctgctgccgacaccatcttcacgtgctctctgtaagccgtgggctttgcatcatacgaatcatcgcatctcgttagtgaagcggcctcatcttgacactgaagacagtccagggaggagtgagcagcactgcaagaagatgtcttagtgcctgacacggtgggtcttatcagctcaagatcctctcccattctttttaaacaaaatttttagagatagggtcacgctctatcacccaagctcaggggcagtggcatggttgtgaccatggttgtgacagatcactgcagcctggaactcctgggctcaagagatcctcccacctcaacctcctgtgtgggacttacaggtacatcaccacgcttggctaaatttttaaatatttttgtggagatggggtctcactatgttgcccagcctggtctcaaactcctggtaagtgatgctcctgccttggcctcccaaagtgctgggatgacaggcatggccaccacacccccaccttctccattctttaccccccaaagtgctgagatgacaggctcggccgccacgccccacctcctccattcttaacccccaaagtgctgggatgacaggcatggccaccacgccccacctcctccattctttacccacaattgttgctattcttctaaccccatgacatcttactgtctgcttgtagccaagtaaagaacactactgaaaagagagtacttcatgaggatttgccatggcatctttcccactccaggcattcgtgggatgcccaggcacgcaaggccaatggacatcttgagtgagcaatggcaaccaacaacttataaactgctcagactttacattttgctctcacatcaaattattcccacttcatttgatctgaatgcagcctcgcggagtgtaactattggccctagctgacagagaaggcaccctgaggtttgaaaacagtcaatgagtcgtccaaagtcacaaaacaagcaaatagctgggagggtgctgtgaactcaagttctaaactccaagctcttgtttttccttcttccattttgccaacctcaggtgccatgaagtggcacagaacatccaggcagggctggagaggctgatacctgacctagattggtgcctaatccatggggcactgcactatggccaacacagcagacatccaaaagcagggactgacctagagtaaggaggctccattgccctcagcttcagtaggtaagcagccaactgctgtagaggtgctcatggtgatggaggtgctcatggtggaggtgctcgtggtggtggaggtgctcctggtggtggaggtgctcgtggtgtggaggtgcccgtggtggtggaggtgcccctggtggtggaggtgcccgtggtggtggaggtgctcgtggtggtggacgtgctcgtggtggtggtgctcgtggtggtggaggtgcccgtggtggtggaggtgcccgtggtggtggaggtgctcctggtggtggaggtgcccgtggtggtggaggtgctcctggtggtggaggtgctcctggtggtggaggtgcccatggtggtggtggaggtgcccgtggtggtggaggtgcctgtggtggaggtgctcctggtggtggaggtgcccctggtggtggaggtgcccatggtggtggaggtgctcctggtggtggaggtgcccgtggtggcggaggtgcccctggtggcggaggtgcctgtggtgtggaggtgcccgtggtggtggaggtgcccgtggtggtggaggtgctcatggtggaggtgcccgtggtggtggaggtgcccgtggtggtgaaggtgcccgtggtggtggaggtgcccatggtggtatggaggtgcccgtggtggtggtggtgcccatggtggtggaggtgcccatggtagtggaggtgcccatggtgctggaggtgctcctggtggtggaggtgcccgtggtggtggaggtgctcacggtggaggtgcccgtggtggtggaggtgctcatggtggtggaggtgctcgtggtggaggtgctcttagtatggaggtgctcatggtggtggaggtgctcgtggtggtggaggtgcccgtggtggtggaggtgctcgtggtggtggaggtgcccgtggtggtggaggtgctcgtggtggtggaggtgctcgtggtggaggtgctcttagtatggaggtgctcatggtggtggaggtgctcgtggtggtggaggtgcccgtggtggtggaggtgctcgtagtatggaggtgcccgtggtggtggaggtgcccgtggtggtggaggtgctcgtggtggaggtgcccatggtagtggaggtgcccatggtggtggaggtgctcgtggtggtggaggtgctcatggtggtggaggtgctcgtggtggaggtgctcgtggtggagttgctcctggtggtggaggtgctcgtggtggtggaggtgctcgtggttgaggtgctcgtggtggtggaggttctcatggtgcaggtgctcctggtggagatgctcgtggtggtggagatgctcgtgatgatggaggtgctcctggtggtggaggtgctcctggtggaggtgctcctggtggaggtgctcctggtggaggtgctcgtggtggaggtgctcgtggtggtggagatgctcgtggtgatggaggtgctcgtggtggtggaggtgctcctggtggaggtgcttgtggtggaggtgctcctggtggtggaggtgctcgtggtggtggaggtgctcatggtggaggtgctcgtggtgatggaggtgcttgtggtggtggaggtgctcctggtggaggtgctcgtcgtatggaggtgcccgtggtggaggtgctcgtggtggtggaggtgctcgtcatatggaggtgctcatggtggaggtgctcctggtggaggtgcttgtggtggaggtgctcctggtggtggaggtgctcctggtggaggtgctcgtcgtatggaggtgcccgtggtggaggtgctcgtggtggtggaggtgctcgtcgtatggaggtgctcatggtggaggtgctcgtggtggtggaggttcccgtggtggtggaggtgctcgtggtggtggaggtgctcgtagtatggaggtgctcatggtggtggaggtgctcatgtaggatctaaatgccattcagttgaaccttttggttctgctgaccagcgtgcatttaacccactcatcctcacccaaggactcttgtccaataatgcaaatacgtagaatgctgtcctggccgataagtccgaggcctgatggtgtgcagtgccctccttattaagaacgattacagggccaggggactcagatgccagccttgccgtgtgaatcatcatgtaaattttcaagaatgggccttcagagctttggcattcccgtgctgggaggaaaagtgcaaagaatcagatgcaaggcctgagagcccaggggccttgggcaggtgttgaccaggtaagacctgcctgtgacaagcgtccccagcagacaagcttctgagcaattgtttcccaagtgctgaatagcctcatgctggtcccaagtgctcagggacccctccctacccatcccaggcagctctcggacttcactgaacctcccctgccttccaaccaagagctgcttctccggagtcctggtgtcaggaggaactttcctgggctcaccaaggtgactctgtgttagtctgatcaactgtgcactcacaggggacaccaactgccaaggggtttgtgccacacactccagctgctgtgtagccctgtagggtccccaaagcacaaggagacaacaagggagagtttcagatgccaacgggctggcggaacataattttttaaataattgagcccttcagagtctctcaaaagtcataatatttggacaattcatgtctcaagacctgagcttgtcccaaggggcccataggtatggcagagcaggagaaaccctctgccctgcccaagatggcccaggcttgtgacctggtgcagctacagggcaggactcctgggccgaccaccagggacagagggcagtggctcggctgtagctgaggcaggatctgctggggaggtaggtgcccagcaccatctttgcactctccatcacctttgcactcagcaccacctttgcactcagcaccatctttgcactcagaaccatctcggctcctctgcccctactgcttctgtcgagttgccatgggaactgatattggtagaagaactcccaagaagtggcttctggcagacatcggcctcccctcagctcagagacagcctgtgagccgcggctgcaggaggaaggagcatggtgggcacctgtgtgctggctggaagttgtgtctccaggtgcccgggggagggtgtgggcccatgcgttggcttcagggccgcactggcctctccctgcaggctccaagtgcaccttcctcgggcaccccttgctttcctccttcaggtctcaaagctatgccctgcccagctgccctgcagaacacagccctgatttaaaatgagccactttctgctccggtataaagacactaccctttctatgcggagatgaagccgcttcctactaaggtatgaagacactgccctttctatgcggagatgaggccgcttcctactaaggtataaagacactaccctttctatgcggagatgaggccgcttcctactaaggtatgaagacactgccctttctattcagaggtgagggaaagagtggaaacagcattcgcttatggacaaagaggaaaagaaaaggctgtgaaaacaggcatggcagcctcgcatcatggaaggaccagggcttcaacacagcaaaacagagagccaagtggacagcaggctcctccagcaaaacctgaggcctcgtcccccaggcccacagcccagcggcatcttcaccagcagacgcggctcccctgggactcccctccagcacagctcatctccagtgggctaggacggctaccacaggaggacatacgtgtcctggccacagccgccagccatcctgccgtcctcccgtcagtctctaaccccacggggcctggggcagtgaagacagaaacccatgtgcagggaagagtaatacttgggaaactcagcgacgcccacagtgtgctccatgaccgtcacaccgtcagcaaaaccccctcctgcacatccagggtacagggccttctgctggatttcacctgccccggcagccgactgcaccagcatcacagcctcctgccgacgatccctctgctgggaggctgggcgttccgtggagagaacagctgagaccccctcggcagcttcccaggcaacagaaggcgcagggaggtggtggtgattcactgtgtttctaacaggtcctctggccacggaagcctcctgcacatgtgaaagcctgcagagaatcccacgcacttcaaaactctcactcatgtttttcagaagcgggttttacaacttttggcatgaaaaggtcttagtggcatttctatgggtgtttatctaggctgctcccaaaccccagccaactaggggtgagctcccgtggccacctgtgacagtcagcccctcgcagtagacgtgccgacgtggctcccgaggtggaggggaagctggaggccctgggggctcttctccctgatcagggtatgaattctaaatgaacgtgaaagtgaggatgaaatggaacctgctctccccagcagtgagttggaggggggccaggtgctccccagcagtgagtcggaggggacaaggcagcaccctctgccagcaggatcagcattgctcgttcatttgcaggtgagaacgagctgctcccatgagtggtatgtccagtgcataaaccccctctgtgtaaaaataaacacagaaaagtggctgctgagcaacgcagtttcctagcccttggtttagcagtatccccgagtgtcccccacatgcggctcctggcgttccacgctggtagccctgtcgatggcgatgcaattattttctaccacagcgttgtgttgtctgcgctcagggtaaagccatgatgaaggcggctttcgggacttgtaattacagagccatgggtggcctctgtcctcgcagccgggaaggtcagcacaggtcctgggtgctgccagccctgagctccactcctgcaaacacttgtcaaaatgccagaagtaattacctggctgttcagaatggagtcatggggtgcagctcctaccatctccgattccctaaagcctccatccaaaccgaaacttgtttacaacctcctggggctgcagccacagggcacctgctctttggcagcagaacctcgccatagtccttaccaatgttcctgtctgctggtctctccggcagcccaggggaggcgctcccgtgcaggtgggagttcttgttccatgtccagcccacgtggccctggacacaagctggggctggttcacacactgcaggccccctccccgcccccaacgcagcaggtccagcaggagacgggcactgagcctgcggggcccactgtgcagaccccaccagcaccaccggcccacgcttcccacgccgcgccctccacttcttcatctttttctcttagaggctcctctttttagttactcctcatcgtctgtgtctgtgccgtgagtcagggatgttctaagagcaggaggagagcgtggtgcttccctctgagcatctccctcgcccactctgggtgacacctcagccaggcgagctgtgggatcgtcaacctcatggctgcggagcagcaggatgagcacgagccccacgccagccacagctggagcccaggagcccccagcctgcgttgatcctggcagcagctcagctccatggaggacgtgacacagcggcccacgtgcagcggaacctggagccgggctgcccaggccacacctccagtctcactgctctggcgctgtttctcagctgcaccctggaggtctggcgaaggggagcgctgggatccctgtgcctggaagacccttgaggagagtgcaggtccttggagagtcactttcatcagtctgacaggtgtctcattcacctgcacatggaggcaattttctcagcaagtggctgttttgaacatttccaaagcatcctccttcatttctaataagagtgcaacttcccttccacactcatggctcaggagttcctcttgtcttgctccaatctcttaatcatgagggtggtaccggagcacggatgggcttcgggccccaccagtgcacagctccacccggcctggcctccctggggagtgggtgtgtgggagcgtggatggctttaggccccactgctggtgaccagcatgcagctccacctggcgtggcctccctggggagctggtgcatgggagtcagatgaggaacgtctgccgcttgtggaccaatgctgcagcagcaaggcacccctccccctcccccggggccaacctgcctgtgtccacctcagcggagctgattccatcagctgcagtgaaactcaggcccaagtccttcttagtggctgctgaagatgaagttcccacactatgaagtccgattctgaattccaccttgccagcctcttactggcatgtccttggcacactggaccccacatccaggctgcaccattctcattcctctcaccttcagcccctgagacccacgctagtccctgtgctctgcccaaaggccagcttctctgtggagcctcatctaagccctgccctgccctccccgatgtgccatccactgcccctaagaactcccgtctgaacagccctggcaccggggttggggggagcttctggagggcagggccactgacatccagagtgatatcaccttaggaaggtgtgatgcattgccgaagacagaatccgcacggagcggaccagactgtgaagcaccgatgcctgcctggggtcgatagttaaggctggctggattgtaagtatgtgttataaaggaattcacttcactttgccattacgcttttcaaaataagcacgtttgtctgctttatgagaggccagaagcctgggcagcccttgctccagcagagaggcctgtgactaacgcagaacgctgcgggctatggggtccaggcatcggcacagagtccagttctgagccgggattcaagagaggctcacaagagaggaggggagcctcttcctccatgtggacccgctacatatgagacgtgaaacacagacagcagcacagcagacacgaccctgttctgacactcaccagcttcacaaagatgccgaacaggcagaagcaggaggacgtcacggaaagtcaccgtacctctgaatacagaggcgccgctactgaaatgacacggggcgcctctccaacaggctgaaagaaacaatggcagctgaatgccgtgtcttagaggctgtcaggtggaggatgctgaggtcaaagggggaaactgctcaggacaggagccccccatgagcctcaccccaccattcagggtcagcacaggagccccctatgagccacacccccaccacacagggctgagtgccagagacacaccctccgtggcgcccgagagggaatgtttgaagaaacagcctgaactcggcctgaaggaaacggccgagcatgggaggggattcctggcaataagctcataaaccacaggcagccccacaggccaccgggtgagggtctctgcagactgggagccagcaaaagcaaacagtttctaaaggatgatgaatttccttttctttgaaaggagcaatacaaaaattgatcagaaatatactatttaagaagaaactaccaaggaaatgaagaataaaaaggatttttctcttctgccagttcaactatgtgactgagccacggagattaaacgtagctaccagtcatttctatgtactttgtggtagagtaagtgcctccttgagcaaaacccacttatttttaatattcactaataccctgtgctcatacccaaggtcataaattagcagaattcccgggaaagcattgcctacgataaagaggagacgctgagtaatggaaagcagctgcccttctcattcggcatcaataccacgtgacgtttgatggggactaatgtgggattaactacacgcctattcattaggttttgtatcattttgtataaaattagcaaaatgaatgccctttgaattctaccgccagggtgatctccccgcattaataacagcagcctcaggtcctcaggcccttgagggaaccagacgccagcagccattgggcttccaggcagctggcaggtggcaggtgcaggcagcacccagcactcccagtaatttcaacagcaggctcttgagttctgtatgttggtaacacaggcaccaccacacgtccttccataggtgtccgcccatcaccacagggcgtttgtgatgacactattaggattccacatcatcttttaaaacacaaaccataagaaactccttttgaatttgaaattcttccctgctatcatgtcagcctgtctacgtctcacctgaaactcagtaagaggctcctcttcaccgtgctaagcactctcccaaggccaatgggccagtcaccgtgctaagcgctctcccgaggctgatgggccagtcactgtgctaagcactctcccaaggccaatgggcgagtcaccagtcaccaaccgtgctaagcgctctcctgaggccgatgggccagtcaccacacatgggcatgtccactgcctacctgcaagatcttcacagtcacaaaattcttttttataatctcttgggttttttttgtttctttgtttgtttgtgagacagggtctccctctgtggcccaggctggagtccagtgatgcaatcttggctcactgcaacctctgcctcttgggtttaagtgattctcccacctcagcctcccgagtagctgaggtttgagccaccacacccagctaatttttttgtatttttagtagagatggggtttcaccatattggtcagtctggtcttgaactcccaacctcaagtgacccgcccaccttggcctcctaaaatgctgggtttacaggtgtgagccactgcacccggccaatctgtttcttatatagcatcaggcacgttcatgacaccatagaattattcaaaataattctttaaaaatcatgcatgaatgtaaacaattttgcacacgttcaagaagcaagaaacattctgactcacacagccacaggagttaacatggaggcactggtgcaagttagcaaattcaggtgtttagaaagttgtcaatatgagactcaaatgtacatttcctatgtggctcccccttggtgcagcacttcgataaataacatgaacacatttgaaatgactgagaaactagctttcaaataatcaacctcattttctctagagagccataaaataaatcaaaggtccttgtctgtgagtatattgttatgatttttaaaaatataacaagattgccattcctagcatccttgaggtcctgcaaacctaattccagtggcattgctccccagtactggagaaactgccaatcatgggataattatcaatgcatttctgcataatacctgatcacggatttggtcttaaatatctccaataatcacttctgacagggaactagagcaagcgaaacagatgccatggagggagggagctctggcagccacgaggcactgaagccgttgttgggaccccccattcctcttgcgtgggagtgtttggtatggatcccactgacttttcatgctgggaccgcactggaccgcccagctggagtgaggatgctgggctgcttttccgagttgtaccccagctccacaagcctcacagcaaagtatggcaacaaagtgagactggggactcaagtctccacaaaccttaaatcagactgcagaagtttagtacaactttgcaaagcactgtatttcaaccacaaattctcagccccctaaatcaccaccttgagcaaaggagttactgagggcacgaggatatcccataagcaaaacccgcagcagccaaaacagataggaccagcaattcgctccatcccttagaacatggtggctacttcacaccttgattactctcactggaaaaagaaacttcaagtttacagggtgccagtacagtgacgcctcaatcaacgagaactaagtattgaaatcccgaaataaaccagagtattttgctgcattttacactgggaaaaaaagacacaaatttaagcaaaaaaaaaaaaaaaaaaaaaaaaaaacaagttcatagatttagcaatataaaggactggctaaaaccaagtgtcatttcccgctgtggctgggtcagtgtgttccgtcctgtcttatcaatgatacggaacgggagcaccctgcctgcggaatggccctaatgcactgaaaaccatcaggctaaggttctgttatgcttcctgtatttttcttactaggcaggaagattaaacaatacactctacaagagttttcaacaagtttaaaaaaaaaaaaaaaggcaggttgaggaaaatgcaacattgtgtccaccatcccattctgttcttcaagactctggagagtaaagctttgtgtttttcactcaatgacaattattaatcatataacaaagattactcaagctctatctgtaagtacatctcaaaaatgtgtgattcgcaatgcccagaaccctgggctctaaacagtgaaaccgtctggaagtcggccggtttttactgaaacctcccagatactttgtggtgtctctgcccaccgcagtcgggagcagggccggtgtgtgctcctggtctggtacaaaatgaaaaacctcaaagcaaaattgcacgtgctctgcacacactgggattactacaaacaccaaatcttgcttttccaaaagccggatttgttctcggtcacttgcagccctgtgtctcctgccttctatctgagccagttccacacatcagggcagcccagtccctctccacacagtgaaatcccagatggtgcccacggacagccacattgccctgtgactgcccctcgtcccctcactgcacaccagatttccacggaaaccgagaccttcctctgggttgccccatgtgggtagtgtgagtctctctctgccctggctgtgcatgtgcgtgtttgcgtgcgtgtgtgtgtgcacacacgtgtgtgtgcgtgtacgtgtgtgtggaaacagcctcacctgtggccttctccacatcctcagtggtcacgttttggacattggcgctcactttgaaggtcactgctggtccgagaaccctggaagggataatttaaaataagttcataacgaagtctacgcgccacaccgcttttctgaaaacgacatggaaaacactggtgtgtttttaaaaacgcaaacatccaaggccgctgtggctccaggcgtcgactccactggacgtcggttttccttcacaccatgacctttgtttccatttgccaggaattccgtttttgggctttgcttttccaaaacacacatcacagtgtaatatgctatcctaaaaaattcacatcaacctctgaacccagcaacagcaagcagatattcttgctagagaaaaagaaaagttgttattgaaatagattttagtctttggtccccaagggagatgtatgaatctagagcagagaggaaagagactagtattttttaaactcttttgacaggaaccatttaaaaaactaccaaagtcattaagaactactctgtataaaaacaactggcagggaattgctagacaggaattatcaaaattgttcaaagctttttaaatgctatgtcaaccacaattttgaaaaaataccttactttttaaaccatttaattcatctgaagaccccatatgcagtagaaactgattattgtgcctacagccatctcaaaatgaattaggaatccagggtccattcccaaagacagacagactgaccccatgtccacagatgacagccatagatagctcttcctggaacagaccccttaaatgtcttctaagaagtaaatccctggaacagacaggaaatgcgaagaggacccaatttaggtgggagagggcagctaagactgttgcttcctggtccctgggaggtgcctgcactgacatctaagctgtgaaactgggtaccatgtagcccagggtcccttgctgtccccactgcagccacacaccctccaccacaggctcatcccaaggcagcatatgacacccaggctgtggattttgcacccaaaatcctttcaacctcacatgtatttttgattcagacatctctgctcatgatacctcagtcccaacctctggtcttcctccttgggatttttgctcattctcccagccagggccagctcctccatgtgcaagcccttggtgaaggggactgtcgtgccattacgaggcagcacaattaccatcctaacaccatggctgaatattccatgtggacgtcttagcatcactttgaactcaacaaggtctcccttgaatcagcgcctgctctgaggagcaaacagcattctaaccttacggatattccctttggcttccttatgccaggaatatccagctagtcaccaaattctgcggaaacccttggaaaatgcaccatgtccaccactgcctcttggttcccactgtgatcttctagtccaagcctgtgccctgtcacagcagagctgagtgacttcctgcgtccagctctactgcatgcaaaatgtccttggaagccgcctccagggatgaccatggagcaggagctggtgtcttctcgagcccaggccccaggcctgtctacggtgcctcggctgggccctctgctggtccccactatgggccctcagaaaggaggaggccactccctccctggactgcagctctcctgccaacgatgttccactcgctcatgagtgctgagttctaccccctctcaaagccctactcccgagtgagcactgtgagagtggctgattctccctgtctccacagtcttccagaagggccctgagtgcctgatatttagtgctcaaatggcacaccagacgttttatagatgttttccttcttcccgagcacaggatgggctctttgaagcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaacgctgaggacagagagctcagccacagggcttcaagcttacacacggcatctgtgaaactgtaatctcgaccacatctgaagattccctgacagatgggactggaatatcctaaacctaatttttccctcacgtgctgaaagttttctctaaaggctgtgaggaggttcttggttcctcagagtccaaagacccagacccctatgctatgaagaagcatgtgacccatacatggccccgtatttcacgtgggggccgcaggagaggcccacacagcccgtgtcctttcttgcacgcatgccgagcgtcaccattgcgtggggctgtggtcatcaccagggagtgctcctgacaccctcggggtacatctcgcaggcggtgagcacccagtgaccatcgccgtcaggcccagcgagacccaggtgcctgcggtcacggtgcactgagccctggctctggcccttgtgctctcaggaaccctgtgggaggacggggcatgaggagctgtctccggaggagactcagagggtcggtaacgtgaccccaactgcataaccttccctaacttgaatatgtgcaggctctgacgtgggaagaagtctctatcccgaggccccactacaggtctaactccatgagtcactgttctgtggccctcctgggcccttccgctgggcctcagtttactcagctgtcgagtgtggcaaggcccacaggtcctcttggacttgctttggcctaggagaccctggttttcaataaactctggtggccaggcccagcgggtctgcagtaaacaggggcaacactgggggctccagagctgagctgctggctctgcccccagcaccatcagcagcagagatccctccccacaagaagaacttgccctggcatttgttaccaaccccacccaccaccccccaccccgcccgccacgtctgctgtgcaggtggcagatggctgagtgctgtgtggtccaggtgagaggcttctgggtagggagtgaggtcagccttcccaccaacttctttctaaccagggagccttggttgtctctgccatcttgttcagctttctgtctctttagacatttggggaaaattgaataaatcccatgtgcatattgccagcatcaaaaggggaatttctgtactaatcaggaaataaaaagtaaaacaaagatgcctagagccctgcagagtctcttaggagcaagtactgcacctaatattacagctctcggggagaaaacacccaggacgcccatccacacccacgacactcatccacatcctcgacgcccatccacacccacgacgcccatccacacccaccacgcccatccacacccacgacactcatccacacccacgatgcccatccacacagatgcccatacactccgacactcatccacacccacgatgcccatccacacggatgcccatacactcctacaatgcccatccacacccacgatgcccatccacatccttgatgcccatccacacccatgatgcccatccacatcctcgatgcccatccacacccaccacgcccatccacaccctcgacgcccatccacacccacgacgcccatccacacccacgacgcccatccacacggatgcccatacactccgacacccatccacacccacgacgcccatccacacccacgacacccatccacacccatgacgcccatccacacagatgcccatccacacccaccacacccatccacacccatgacgcccatccacacccaccacacccatccacaccctcgacgcccatccagatacccatccacacccacgacgcccatccacacccttgacgcccatccacacagatacccatccacacccacgacacccatccacacccatgacacccatccacacagatacccatccacacccacgacgcccatccacacccacgacgcccattcacacatgcccatccacacccatgacgcccatccacacccacgacgcccatccacacatgcccatccacacccacgacgcccatccacacccatgacgcccatccacacccacgacgcccatccacacggatgcccatacactccgacacccatccacacccacgacgcccatccacacccatgacgcccatccacacagatgcccatccacacccatgacgcccatccacacccaccacgcccatccacaccctcgacgcccatccagatacccatccacacccacgacgcccatccacaccctcgacgcccatccacacagatacccatccacacccacgacgcccatccacacccatgacacccatccacacagatacccatccacacccacgacgcccatccacacccacgacacccatccacacatgcccatccacacccatgacgcccatccacacccacgacgcccatccacacatgcccatccacacccacgatgcccatccacacccatgacgcccatccacacccacgacgcccatccacacctacgacgcccatccacacccacgacgcccatccacacatgcccatccacacccatgacgcccatccacatacacgacgcccatccacacacacgacgcccatccacatgggtgttttctccgtcaggcacattgtaaccacgtgtcccggcctcacacacagagcacttccttcccattcctgctttggctttgaagcatactgtgaaattcttcgtggctcccttctccaccaggcgctccttacacagtgctcacctatctaattacagacctgcttagaaattccaggggccaattttcaaacagaacaggcagagagactgagctgcagaatcctctgctgagggggagttaggaacaggtagcccaccgctcccaggctgaagccacaatgatagaaaccaggcctctgcacgatgagataaccatcagaacagacacacagcctggcgtccgcctgcaccactccacacagctccatgccttttcctccttaaacccctcactcagccacaaagggggaatggtctgttaaaggcatgagcctggccattccccagctgccagcgtttgattaataactgctttcctctgcccacacctcactctcatgttttcggcctctgagtggcaaacagctggacttgagccagttacaacactaggaacaccagtcagcactcagcactgtgctggggccatttaaacaacaaaaccaccaacgaaaagcacaaaaaatgtggaaaatgtggcactcaatagaccataaagaggagccttgttttacagtatgagctgaaacgagaaggcggagctgtcctctcccacctgagcacaggcatgtcaggcaacctgaactttatggctctgtgtgtgtgcaggaatgactttggcataagcattgatttgggggttacaaattaatttgcaaatacagaatctgcgaatgaacaggatcatcgactgcctagcatctgtgttgaagcgctttcacacacatcaataaccttattatcttcttcacatttttcaattttatactgtagagaggatgggagcactggagcttacaaggcttgagatccaattgtttgtttaaccgccacttcctcgcggggcgattttgcacattacattatttaccctgcaaaatcgggggaacaagacaaacattgcagggcattggaggatcgggcaggatagctgacatgcgacagggttccctctgaaccaaagctgtcagtctgtgccctgctcagtcaggaggggtctgctcctcctccaaattcttccataaaatccactctctaaattgactatggcttgtgtgggttcacacagtccccgcacgctgtactgctttctcagggagcctggttgctttccttcgggaatgacgtggttgatacaagggaggggactgtctctttcccgaccctggaccgtgcagtgaagatctcatgaggaatctgtaaatggccacgtcagggtagatcttgaaagtgtcgtcccgatggtcgtgccaggcacatctatggtaagaagcgtctgatgcaagagcaggaagagtttctgagtcactgttcctgggagaaccatccaccttttgacagtcaaattcacttaccgtgaaaggtgactcctatttagggtggaagaaatgccaaaaaggaatgctgcccactcagatgcaaacgcttcctcccctgacgaaggagggagtcttcacacaaaccttcctcccctgatgaaggagggagtcttcacacaaaccttcctcccctgatgaaggagggagtcttcacacaaaccttcttcccctgatgaaggagggagtcttcacacaaaccttcttcccttgatgaaagagggagtcttcacacacatccttcttcccctgatgaaagggggagtcttcacacaaacccttcctcccctgatgaaagagggagtcttcacacaaaccttcttcccctgatgaaggagggagtcttcacacaaaccttcttcccctgatgaaagagggagtcttcacacacatccttcttcccctgatgaaagagggagtcttcacacaaaccttcttcccctgatgaaagagggagtcttcacacaaaccttcttcccctgaggaaagggggagtcttcacacaaaccttcttcccctgatgaaggagggagtcttcacacaaaccttcttcccctgatgaaagagggagtcttcacacaaaccttcttcccctgaggaaagggggagtcttcacacaaaccttcttcccctgaggaaagagggagtcttcacacaaaccttcctcccctgaggaaagagggagtcttcacacaaaccttcttcccctgatgaaggagggagtcttcacacaaaccttcttcccctgatgaaagagggagtcttcacacaaaccttcttcccctgatgaaagagggagtcttcacacaaaccttcctcccctgatgaaagagggagtcttcacacaaacccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaggagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagggggagtcttcacacaaaccttcttcccctgaggaaagagggagtcttcacacaaaccttcctcccctgaggaaagagggagtcttcacacaaaccttcttcccctgatgaaggaaggagtcttcacacaaaccttcttcccctgatgaaagagggagtcttcacacaaaccttcttcccctgaggaaagggggagtcttcacacaaaccttcctcccctgaggaaagagggagtcttcacacaaaccttcttcccctgatgaaggagggagtcttcacacaaaccttcttcccctgaggaaagggggagtcttcacacaaaccttcttcccctgatgaaagagggagtcttcacacaaaccttcttcccctgatgaaagagggagtcttcacacaaaccttcttcccctgatgaaagagggagtcttcacacaaaccttcttcccctgatgaaagggggagtcttcacacaaaccttcttcccctgatgaaagagggggtcttcacacacatccttcctcccctgacaaaagagggggtcttcacacaaaccttcttcccctgatgaaaaggggaatgttcacacaaatccttcttcccctgacgaaagagggagtcttcacacacatccttcctcccctgatgaaagagggagtcttcacacaaacccttcctcccctgacgaaagagggagtcttcacacaaacctgtcttcccctgacgaaagagggagtcttcacacaaacccttcctcccctgacgaaagagggagtcttcacacaaacccttcctcccctgacgaaagagggagtcttcacacaaacccttcctcccctgacgaaagagggagtcttcacacaaacccttcctcccctgatgaaagagggggtcttcacacacatccttcttcccctgacaaaagagggagtcttcacacacatccttcttccactgatgaaagagggagtcttcacacaaacccttcctcccctgatgaaagagggagtcttcacacacacctgctgcctagagccctcagaggtgtgatactcgaacaatgtgttcacatgggtcctatgaagaatatattaggagaaacaaaagctatttattgccgctaggagtcatctcccaattgggctggaaataacatgaaaaaatatatcactgagattctacagaattcactgacttaaaactacctttaaccaaaataaggaaaccatatatgttgtacatagataagagatcatttcatcactgtaattttagctatagttacctctattttaaatatcattccatttattcctgagttctttatcactcagtggttccacttgatagtttactatatattgataattgctcatttcttttgatggtcataaaacatgccaacaaagaagagaagtgacatctagcattttaacactgattttattgcttgtgttctaggatactcctatcactcaagacttatgagacaaacataccagccctccatcaaccagactgttgagtgtaagagttctgcgtaaaaggccttttcttaactgaggactatttggaaatctctttttcccctacttttatgagtgaaataatttaaaaatacatataattatctgcctttagaacatcaatatactgatgtactaatatttgttgtcttagcaatcatatatctcaaagtgattttctgaatattagttttcagggcatgacactttaaccacaggaaagaaaacactgagctccatctgttcttagaccaaccgtccggttgagaatgaagaagatgaacaaatctctgacaaaagcttccatgtttcggaaatggttttaaataagaaccgaggcttctatttggttgggttagtctgggggttgttatttctgtatagtaacgactatacagtcgatacataacacaggcttatttgtatcaagtcaacctttaagggctacaataaatgtaacacatttgactacagttttctgaatagacactgcctaagcagtagttaacaagtttgtagtccgtttaaataaagacaggcctcaggtactagattcccttgactttttgtggataaaaagaagatagccaaggcatatatggcaacaaatatagttttaaagttaatcatttaatgttgatgctttacaaccaacataaaagtaaatgcttctcttttcaactggtgaattttcttgaaagttatttagaaatgaaaaaaacaaaacttctgtagactgttttttgtttgtttattttactagcatgctctctgctggcttgacagactgacctgtgctttatctatttgacacctggatttggagtgaagcccataacatgaatagatgggtgcgtgagggataggtgatagatggatgggtagagagatggttgggtgagtgggtgggtgggtgagagataggtgatggatgggtagagagatggttggttgggtgggtggatgggtgagggacaggtgatagatagatgagcagagagatggttgggtgggtgggtgaaagataggtgatggatgggtagagagatggttgggtgggtgaaggataggtgatagatggatgggtagagagatggttgggtgagtggatgggtgagggataggtgatggatgggtagagagatgggtgggtgggtgagtgagggataggtgatagatggatgggtagagagatggttgggtgggtgggtggatgggtgagggatcggtgatagatggatgggtagagagatggttggttgggtgggtgggtgggtgagggataggtgatagatggttgggtagagagatgggtgggtgagggataggtgatggataggtagagagatggttgggtgggtggatgggtgagggataggtgatagatgggtagagagatggttgggtgagtgggtacatggatgagtagatgggtgaatgggagggcagagatatatatacacatatacatgtatatgtgtgcatatatatatatacacacatatatgtatatatatgcatacatatatacatgtgcatatatatacatatatgtgtgtgtgtatatatatgtaggtgagtgggtgggagggaggatgggtggatggatggatagatgggtgggtgggtgggtagaaggatggatggatgggtagagaggtggataagtggatagatatatgggtggatggctggctggatggatggggaggtagacggatggatggatgaaaaattgataggtgggtggtttggtggatagagatatgtatatatttattgcttatattaattcaaacataattagacactttctcaaaatactgtttatagcttaagaatcattttgcattaaacctttcccatcttgtgggctatacatttagtgaattgctcattctgtttcttagtcagtattatgttcagagaaacacagtgctaataaaggtctcaaaattatcaaacaaaatcataatgatttaagagacttactatatctggctgaacataatttgaggccaggtaaaacctggaagagctcactacacacagtacatgttttaggggctccctaaagccagcccctcagcctcgaggtagaggcacaggggaacttccaagaaaccagccctgtgtctggccttgagtaggtgggcgcaaaccaagagagcacgctgctgtggtgctcggtaacaaccacaaaatttgacctaaggcaactcatttggcaatcgctattttatagatgaataagttgaaacccttgtagttttaggtgctagctccaaatagtccaattctaatatcaatgccaccactagaatcacaacttcggcgttcttggctgagagccttctgcgaggcacgagtataagtgtgagacccacacgcaggcctgcacctctgtcctttcctgactctgccgctggaccgacccccacaccatagacccacacgcaggcctgcacctctgtcctttcctgactctgccgctggaccgaccccccacactgtagacccacacgcaggcctgcaccgtcctttcctgactctgccgctggaccgacccccacactgtagacccacacgcaggcctgcaccgtcctttcctgactctgccgctggaccgacccccacactgtggacccacaggtaggcctgcaccactgtcctttcctgactctgtcgctggaccgacccccacactgtttgtgcttttactccctgaattgttcctgatgataacttgcctcctccagtcttgttccttgttcactggcgtccctcactctaggcaagcccacagcttggtgctgggctaatccaagctaccgacagaaaaccaataaaaaaatgagctcacgtctggctgctacagaattctctttgcatgcctcattccagctatgtcttcttacagaggagacatcgggaacataaaactccggaattccacgtggatagcataatgcatacctactttccttacacacacttttaattttaccacatttcctgcacaattgtgtattcctgcctctcgtacatgaggcaataacttcccaaaatatctagcctaagagcttacaaaggaggaagaagagagaaccaattcttatttgaatgtatgaggaaacaaagacacacacagttattgcaagataatttaacatcatgcaagccttaatgaaaacataattattaatgatgctttattttcttaaagcattgagcaactgcatcactgtgcagattgtatcttctttgcaattactttgccattacatgggatttgggaaatcctttctgtgccagggaatgtcttgccgcttacttttctcatggagtatttggaagaaaacagattgttcagtatgtatgctttgcctttgaactttagaagcatttgcctcctttgaagttctactgcaggctgctttcctgttacacctgctgggtggcatgaccagtcccaagagaagacccttgttcccccagcacaggggtgggccggatctcaccaggagcagcagaacgctcgccattcccgaaggaccagggccaccccatctgtgttttttctgttttgtttttgtttttgttttcagacggagtctcgcactgtcacccaggctgcagtgcaatggcgtgatctcggctcactgcaacctctgactcccgggttcaagtgattctcctgcctcagcctccccagtagctgggattacaggcacctgccaccatgctcagctaattttttttttaaaatagagatggcgtttcactatgttggccaggctggtctcgaactccagaccttgtgatccgcccacctcggcctcccaaactgctgggattacaggcatgagccactgctcccggcccccatctgtgctttctattgcagcttcgctctcatgatgcttaaggattaatgagctacacaaacacatgactgaattattagtgactaacatttagaagtagaagcattcacccaagaattaggacccaggctttttcccgaagcctcagcagcttggccacagccttcggtgctgtaggacaggcaggaaaggtgagaactcctccccctgagtgttcctgagggctccactgcgcagtccccaccatccctcagggtctcctgggcactgtggctcactctggttttgtttcttgttttacttttgtttctctggacacgcaggctgctaactcccgaaggcaactgccagccttcaaacaactccagtttgcaatcccaaatgaagtgtaacgcacactcatgggccagcatccgtggtgggaggagccgctgggtcctgtaactggggcaggtttatattcctccctgccctgggttgcaggtctcagcctttcctgcaggaggtgagtcctgaataacctgccccgcccatctgccccaaagcctcctgcaatcagctcatgcgcaacgtctctgactggagagacacattcggaagagtgaagtgatttttatttggtcctggtgagaaaaataagaataacgccaagcagggtatctagtattgacggtgtaggtcataagtaaaatgcatattttaccacagtgtttggtgtcatttctatataaatctaacttgttcatgtgtttacatatttcttggcttagacattttattactttaataatgtatctggaaagctaccctttatttggtgttaagtatctgcatacgcagggcatttaattctacaactctgatgtagacattatcgtctctactccatggaggagcacactgaggccaggtggcttcagtaatctgcccagggcctcacagcaagttgagaaaaacagagtcaaacccatgtgcctttgaattcagtctgcccattctttcgtggaatcattcattcactcattcaacaaataagcccctgttatgggccagaaacactctagtcactgatgacgcatgattgagcaatacagactgaggccctgccttcaaggagcgtaggagtgtatactttctggttctggttttgcagagacgaggtcttgctatgttgccctggctggtctcaaaactcctggtctccagtgatcctcccagttcagcccccaaagtactgggattacaggcgtgagccgccgcaccaggccaggagataaaagattcaagtcctatggatgaaagtgcctttacaagaaaactcagaactgcctgggaaactcttcactacctggtgtccagtacccaaatccagcatttacccaatgcttcacacttgaagtgcattgaaaagtctagagaaaagaatgggttcttcttgccaatctgaatccattaacagtagaaattagagtgttttttttcctaacagcaatgaaatagcgcaattgtccagctaacatgtattgcaaacctccacagcagacgttattctagtttttcctagagtctctccaaccctgtcatggcctcacagccgtatacataatttgtggggccctttgttgaagaattgtaagagtctcaagatggtaccagcaaagcatgaaccatgtgtggggcctctaagagccgggtctcagccacatgcccaggccacctccatccttgtggggaaactgaggctcaggaaaataaggaaactgctctcctcctaaatggtcatatcatttcatactaggaaacaaggctccaccaatattttaaacacaaatatctttaatcaaatcatgggattcacttaacctgagaaatgccacctttcactcaaacagaattattatttgcaaatccacagtggccttcccttgttgtctcatcttaaagacgggacggggagttttgacgtactgtgacatttccttgacattccttatttccaggaaaacctcatgtcactgtctcgagacactagcttgcacctttgcaactgcttgtaatattcagacagggcactgaagacgaagcctgggctccgtttgggaaggagagttacataacatgaggccccattccccaccttcctcacttggcaaatccagaacacaggtgaaacaggtagcaacattgcccgtgagggccggagtctgcaggtggtggatacaccacatccagatgcaaatgccatttacccagaccctcccctggggctcctgggagtttctcactgcgggggctcttggctttgagtgatattactaacgcacagcactgtcgctgcagtggttaatctgcactgccctgatgtgtagacaaaattatccagggctttatagtcatcgaggccacagggaaaaccagagagccaacccagggaatgaaggaccattctcacccctcacaggattcctgctgcctacaacatctttgtaaatcccctatgcatggggacaagactaggggcaaaacaatcacaactctgcccccggaaactgaaacatactttccagaagtttcccggcaaaccccagggacttctcccactggcagggtgggagaggggcaggcactggggaaggaggtggaggggcccgggcagcactggggttgtcacaggatcgagcaggcacaggcacctcccgcgccccgtgcacagagaagaccccaacaagaagcatcagggttgagaattcccactgctgcctcttcggtaataacaccgtattcatcaatccagtaaatcacacagatgagaaagtaaacgcttctcccaccaggagagcacatgaagattgatcacagaattaggctgcgtgccccgaatgccccggcggtcctcgtggctgatgtgggagctccaccgaagccatctggaagagaactgtcacagagcccgtctcactgtggactcaggggctcgtgggaatgtgtctttggcatcctttttcccaggagcactgcccacctccccgagattccgcggaaggcggcctggcatcgatcaccgccgccgcagacagccacaatcacgtcgtaaaaacccggctgcggtcactgccggtctgctggcataattacatcacatgctaatgcagttttaatggtctctaatgatgtcataagaaataatgggatttatgtgacagctacataaccactaacaaaacatattcagcataactagcacttccacaaaaccgcaggagagtctgagagtgacagcttgcgcatcctgtccgcctcttttcctttcccggaacaatgagcagctcccagaacatgctctgacaggcagcaccgcgtggccgtgtctcccgcctgtcagagctgctcccctcgagacaccaacgaggcacagcccacacccccgtccgtccctcgagccggtgcatttgccaagtgtgtgcccgtggctgctgggcccgggtgaggcacaggacgtggaagtaaggcttgcgtggtcccctgcacatgagcacacacgcacgcaggcaccagaactcaagacccagcgtggggcagcctctgcctggccaggactggggacctcggagaagcgctggacgcagcaagaatcaggcttcagctccgcaatgtgggcaggggacccgcaaaggatcctgcgggtgaggccaccgggggggctccctggggaggaggtggagaggtccagattcccgaaggctccgagggacgggcggcgggactcaggtttgactctgtaggaaagagggggccgccagtgtcctaaggcgggagatgcccgagggtgacgcttacccaggactgagcctggcaaagcccagccctgctcccggaatgcggagaagccgtccgtgctcagaatccgtcttccgacagcgaaggcggtggccaggagggccaggggcagggagcaggcacgggcgaggcccagctgctctgtgaaaccagaggctccccgaggcacacgcctccctcgcccgccccggcctggcatctgccagtcccaccattttgctgagactctgtgaaggtgaatggggttgcttgggctcggggactggaagaagaaggacgtttatctcgtgaacgcgggacgctccttatgggagaggagtgggagacatgaagcaaagcgtgaccaccgaggagctggggagaaagcgagaaagcaaggaagcagtgggggacggggaacggggccgcggggagggccggagaagatggtagaaggtgacagtgcggggtgcagcgttcctgggtccttgaggggagccgggcttctcagccttgaagacccacttcttctctggcctcattcctgggttccgcatcccggctgcctccccttcctcccccaacacatcccggctgcctccccttcctccccccaacacatcccggctgcctccccttcctcccccaacatcccggctgcctccccttcctccccccacatcccggaggcctctccttcctccccccacaacccggctgcctccccttcctccccccaacacatcccgggtgcctccccttcctccccccacatcccggatgcctccccttcctccccccacatcccggctgcctccccttcctcccaccacatcccggctgcctccccttcctccccccacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccaacacatcccggctgcctccccttcctcccccaacatcccggctgcctccccttcctccccccatccccggctgcctccccttcctccccccaacacatcccggctgcctccccttcctccccccacatcaccggctgcctccccttcctcccaccacatcccggctgcctccccttcctccccccaacacatcccggctgcctccccttcctccccccaacacatcccggctgcctcctcttcctccccccatcccatcagtggtcatgcttcacttcctctccccactcctccctcataaggatcattgtgttcatgaaataaacttattccttctttatttatttttattttccataggttttgggaacaggcagtgttgagttacatgagtaagttctctaatggtgatgtgtgagattttggtgcaccctcctgccacccttttccctgagtctccaaagtccttatgtcattcttaagccttcacatcctcatagctcagctcccacttatgagtgagaacatatgatgtttggttttccattcctgagttacttcatttagaataatagtctccagttccatccagcttgctgtgaatgccattatttcattcctttttatggctgaatagtattccatggggtgtgtgtgtgtgtgtgtgtgtgtgtgtgtgtgtgccacgatttctttatctactcattgattgatgggcatttgggttggttccatatttttgcaattgcaaattgtgctgctataaacgtgtgtgcaaatatctttctcgtataatgacttcttgtcctccaggtagatacccagcagtgggattgctgaatcaaatggtagttcttttagttctttaaggaatctccacactgttttccatagtggctgtgctagtttgcactcccaccagcagtgtagaagtgttccctgttcaccacatccacaccagcatctactgttttttgattttttgattatatccaatcttgcaggagtaaggtggtataacattgtggtttcgatttgcatttccctgatcattagtgatgttgggcattttttcatatgtttgttggccatttgtatatcttctttcaagaattgtctattcatgtctttagcccattgtttgatgggactgtttgtttcttgctaatgtgagttctttgtagagtctggatattagtcttttgtcggatatatagatcatgaagattttttctcactctttgggttgtctgtatactgctgaaagaaatcacagatgacgcaaacaaatggaaacacatcccatgctcatggatgggtagaatcaatattgtgaaaatgaccgtactgccaaaagcaatctacaaattcaatccaatccccatcaaaataccaccatcattcttcacagaaccagaaaagacaatcctaaaattcatatggaaccaaaaaagagcctgcatagccaaagcaagactaagcaaaaagaacaacctggaggcatcacattacctgacttcaaactattctataaggctatagtcaccaaaacagcatggtactggtataaaaataggcacacagaccaatggaacagaatagagaacccagaaataaactcaactacttaacagccaactgatcttcgataaagcaaacaaaaacaaagtggggaaaggacactctagtcaaaaatggtgctgggataattggcaagccacatgtagaagaataaaactggatcctcatctctccccttatccaaaaatcaactcaagatggatcaaggacttaaatctaagacctgaaaccataaaatttctaggaaatagcattggaaaaactcttccagacattggcttaggcaaagacttcatgacaaagaacccaatagcaaatgcaacaaaaacaatgataaatagctgggacttaaactaaaaagtttctgcacagcaaaagaaacaatcagcagaataaactcattccttcttccagtcatctagcccaaacaatcccactgtatacaaagaaagacctcacaccttccattgcaccaaaagagtttaaaacccagctcaccatgaaagccatggagactttaaaagaaatcccacctggtatttaagaaaatctcacccagcacagtagtgcacccgtcagcctcaggtctgctccaatcagtgtggacagcaaagcccctggccaccctgaccgtccagctgttggccatgtggccaaccactcctcccttcttcattctggcccaccctctcccaggggatgttactgggggagggcagagatggccaaagcagtgagcagcggcaggcccatctctgcccgtcactacgccacggtgggccctgaggtcccaggatctgctcacagtgagcagccatggagcttgcagctgaccctggggcccctctcctgtcctgaggatgaagtggttcctctcccaagccccagatcgcaaactggacccatgtggcaggcactgagcccaggtgccaggcagccctcagcccacgccttcaccctggagccatgatgctaacagtgcatggcagccatcagcagcagggcggccaggagggaaccttcagaaaacactgagcccctgtgcgcctgagccacggccttccacgtgctggacagccaccacagaagggctttgccagaggaaaatatggtaaactcaatgcacgcatcccgagctggcccgaggatgctttattccaaagccacctcttgtgactgcctgccctctgcccaattatctcagttatgtgtctgggtgcaacagcttcctccctcccatggctccaggccgccctgctgctcatggaggcacctctcatggtacccaggctgcttcttttccatggccctcaaatgtccctgaggacaatctcacttttaactaaggaggcatccacacctccacacgttcatcagtaattgtgggccttggcagcaacaggtgagtttcccagggctgcagaatcacagagcatgccccatgtatttgatatatggagagaggcagaagggggtgtgggatgggcctgcagctttgcgggtgttggagggatgaggcctttgttgttcaaggactcattgcatcacgcttgaatcacacttgcacttaagatgcaagtgtgcacttgcacacttctctgcagtcactgagccgggttcaggacatagataggcactgaggagctgatggtctggggagaaagacagcacacggctaatgttctgggggccacggtgcagggaaggcactgcagacccgggaggacacacccccaggacagtacctcatgctcctcagcggcatcagagctgagtcctagacagggagcctgacgggacaggagctggggcatcagtccatggggaacccctccttctgaaataagccatcagcaggacccagtaaggcctgggtgtccagacatgcacccgtccctgtctgacagcagaagcaggcgtgagcacctagaacaaagggcctgcggtcattggctgcagtcagtgtgaggctcccacttaccacctgtggcctcatcctccctgtgcgcatggcctgggcccacgatgagttcctgagtcctaaaactaggcgccttcctgggggccatagggagggatagtgccaaagatacaggcctgggatggaatccttcgtggaaaggaatgcagtttgaaccattcaggacacttgatggcaggtggctccttccagttcaaagtaagaggtaaaaagccttaaaataacagcagtaggaaaaagaacgcgaagagccctgcacacaggtgagactcaaagaccatcaggaaaactgcactttctggactaacgtggctgtgcccatggagcagcgatgtccgaggcagggcccactctctgggccccaggagattcccttcctctccagcctcacttccctagcatgagttgtactcagaatgtctgaggtcactggcagttccagaaccttctctagcactgtccgatttgtttgtctcatgagccaggtttcaaacagctcaggggcagggatgagtgttccccttcttacatgtcctgctctgtgccaggtcagtgcaggcccccacttgatgtgatggacaccaatggtgtcgggggccacagcacactgctctttgtaatgcccatgaagtcagatcatcccactcagcccatgatggttagcagcctggacacatttccttctggttcttagagacagattattattattttttttttttgagatggagtcttgctctgttgcccaggctggagtgcagtggcgcgatctcagctcactgcaacaactgcctcccgggttcaagcaattctctgcctcagcctcccaagtagctgggattacaggcacctgccaccatgcccgactaatttttgtatttttaagtagagatggggtttcaccattttggccaggctggtcctgaactcctgagctcatgatccacccgcctcagcctcccaaagttctgggattacaggcatgagccaccgtgcctggcctagagacagatttaaggcaatggagcatcagggcatcctgcctgagatttcttttctgtgcttcctcactatgccctccccagagcagtctgaggcatcagaaggcctgaggaaggccaggatgaagacaatggaggtcaggtgaatctcaggctcaaagactcctgagaaaggccctggaagacacataagaatcaagacaacttaagagcaaagataccgctgtgaaaatcagggatttgtggatggataaaaaagtcatagatgaggaaatagtaagacaccaagatcagcagcagggcccctcacaagatgaaaaaggagatgaagactatagggctcacctaggcagggacagagaggagaacagaagggagaaaagagagagaacaggactgatggaggccttgtcagtagtggaggagagcttgaggaagagccaacaaccacccatgatcacaaccatcccagctccatcccaaaatccatcccagctccaaccagcaccaaccgcagctccatcctcagcactatcccaactccactcagctccatcaaactccatcccagctccatcctcagctccttcccaactccactcagctccatcaaactccatcccagctccaccctcagctccatcccaactccacacagctccatcaaactccatcccagctccaccctcagctccttcccaactctactcagctccatcaaactccatcccagctccaccctcagctccatcccaagtccacacagctccatcaaactccatcccagctccacccttatccaaactccatcagaactccactcagctccatcaaactccatcccagctccatcaaactccatcccagctccactctcagctccttcccaactccactcagctctatcaaactccatcccagctccatcctcagctccttcccaaccctactaagtgtcatcatactccatcccagctccatcctcagctttatctcaactccagtcagctccatcaaattccaccctagcttcaccctcagctccatcccaactccactcagctccatcaaactccatcccaactccaccctcagctccatcccaactccactcagctccatcaaactccatcccaactccaccctcagctccatcccaactctatcccaattccactcagtttcactgaactgcatccgagctccatcctcatcctagctccatcccaactgtgctcagctccgtcaaactccatcccagctccatcccaactccactgagctccatcaaactccaccctagcttcaccctcatcccagctccatcccatctccactcagctacagcagattccatcccagctctaccccaggtacatccaaggcttcaataatccccagctccatgaacttccatccagctccattcctatccatccctactccatcccaagctgaaccaagctccatagacttccatccagattcatcaactctatcccagaccatggagctccatccacctccatcccagctccacctcatctccatccacaaatccatcccagctctatccatctccattgtatctccatccagttccatccagatgcatgccctgctttatccttatctccatcaatttccatcctagctccatcttacgccatgcagccccatccagctccattgcagctccacccagcttcatcccatctccatactactctatacccggctccatcactactccatctcatctccatactactgtatacccagctctatcactgctccatcccagctccatccagttccatcccctccttcatccagctccactgaattccatccccatctctcttctgttttattcccagctccttccatctccattccaactccattcagctctatcctagatcatcactgctccattctagctccatcctgctctgtcctcagattcatctcagctttttttctgagcttcatcccatctccatttccagttccttccctgatctatcttagctctatcccagtccatcccagccccatccacctagcttccccgcagctccctctagcttccccccagctccatttctgctctatctcatttttatccttattccttacaagtggcatctccagctcctttctgagcttcatctcagctcatctccctctctcttgagttccatcccaacctccacctctgctccctcccagctccagcgcagtttcctccaaagctccaccatcacctccatccttggctccagcttctttcttagctccctccctgcctccacacacacacctccgtgtatcatctggaagaagctatttccaccttttctgactcactgtttatcactgctcagaagtgtgccactttgggaatatccaaaacactgataaagaggatgtctccaggggctgatgaaatgagcctctccacacaaacgcctacctgtggagtctgcccttggggatataaccctgtcacactatctgtgccctgctccccgaaggtgatagagtgcctgttacatgattttcactagtgtcccaggtcacaggttcacagaagattaatccttgagtaatcactaaagatgaagtaggcaaacccctctaattttcaaaatataaaactatggcccagagaggaaaagtcacttccccaggatcccataaaaccagattatctaattctccttcagcataaagaggaagattttaagatcctggaagcatctcagctctttcaggtcttgggagcttcttctattttcaacctctgtgaaatctgtcctgtgtggtttccctagagttaatatttcttccctaggaacccaaaacactgactgggagctacctcacaagaaaccaaggtggtgccaacatgcacacttgtctctgttctcacatacacctaagggtccacgtgccccacatcgctgctgccccccttctcttcccttacctccatctcctgatcccatcagaaactgggatcttgctgtccactgtacattaaggttatgtcatatacacctacccagatctgtcccctaagtcacctggacagcaccccttagaagtcatccaggtacctgaaacaaacctatcaatcaaacctgttaggaagctccctcaaaccctcccccctcctaagtccctggtgtgctgaaagccactccatacatttccagtaccctcagtcacatcagaagttaaaacactgaagtatttcctaccaggtgggaaacagctgcagcccctgcccacccgccacctccagaaccccagatgcccaaacatcccaggccactctgggaacaacaggccctccccattgtgagccacagggaaaacacttgactgcccaggggccaccaggacttctgcctgaggccctacttgcctgtttccatgggcaggcatcacactgtgtagatcaacacacactttgcactcagatctaccctcatccttgaagctgcctttctacaattcttcaaatcctgcttcccaggcagaagtcacccagtggccacccactgcagtcacgctgtacctgctctcttccctcacctgcatcttctcgtgtcccctgcccacagcagcccatgaacatgccccctctttcatgtggatatctgcatctgccctgcacctgccccctctcacacatggatccctgcacaccgtctgcccacagcaggcccatgtacctgccccctctctcacatggatctgggaaagtcccctgcccactgcaacttgatgcacctgccccctccctcacctggatctctgcacctctgctgcctactgcaggcccacacacctgccccccaaaaaacatctgcatctcagcatagccccttcctactgcattcaccctgtgcctggtcccactcttacctggatctctgcaaaccacctgcccactgcagccctgagtacgtgaccctttgctcacctggatgtctgcatgagcctgccaattaaagccccatgcacctgccacctctcacctggatctctacagcccactcacccactatagccccacaaatagccccccctcacctggatctctgtgctcccattgccaccacacccgccttgcacctgctccctcctttaccttccccaggtggcctcagggctgctctctctcagctctagtcagaccatctcactgtgttcaccctgtagggtcctctcactctacatactgggtccctaaatggcctctctgtccctgctgagcagtcctacctggcctgcccaccggaccaccccatttcagggaaaccccagcagccctggcatgtatggagccccctgtccctccacatctttcctgtccatggacatttccttgaacctgctcattgcatatgtctgtaccctaggaacggtgtgggccacagtgagcagtgtggagttgcatgtcacatctctctctgggacgcctccatgtgtccttcagatttctacttctagaaacttctgatcccaggctggctggggtgcttctcatgcatgtcccctagtgccctccatgctaatgacccatacactcttctgtcttttcctaataaatggcagaattgaggcagggcccatgtatctcaaaggggatgcccagctcctggtgcgaggccaggttgccacaggtgcccagtgagcatctgctgtgaggagccactgagtgaacgaggtcaacctgtgtgaaggggccagtgagtgaatgacatcaaccctgtgtgaaggagccagtgagtgaatgacatcagccctgtgtgaagagtcagtgagtgaatgacatcaccactgtgtgaaggagacagtgaatgaatgacatcacccctgtgtgaaggagaccgtgagtgaatgacatcacccctgtgtgaaggagccagtgagtgaatgacatcactcctgagtgaaggagacagtgagtgaatgacatcaccccatgtgtgaaagagacagtgagtgaatgacatcacccctgtgtgaagactcagtgagtgaatgatgtcacccctgtgtgaaggagccagtgagtgaatgacataactcctgagtgaaggagacagtgagtgaatgacatcacccctgtgtgaaggagacagtgagtgaatgacatcacccctgtgtgaaggagacagtgagtgaatgacatcacccctgtgtgaaggagacagtgagtgaatgacatcacccctgtgtgaagactctgtgagtgaatgatgtcaccccatatgtgaaagagacagtgagtgaatgacatcacccctgtgtgaaggggccagtgagtgaatgacgtcaaccctgtgtgaaggagccagtgagtgaatgacatcacccctatgtgaagactcagtgaatgaatgacatcaccctgcgtgtaggagccagtgagtgaatgacgtcacccatgtgaagagtgtctgaatgatgtcacccctgtgtgaaaggctcagtgagtgatgtcacccctgtgtgagggagacagtgagtgaatgacgtcacccctgtgtgatgagtcactgagtgaatgatatcacccctgtgtgaagcgtcagtgagtgaatgacgttaccccggtgtgagggagccagtgagtgaatgatgtcacccgtgtaaagagtcagtgagtgaatgacgtcacccctatgtgaaggggacagtgagtgaatgatgtcacccctgtgtgaagagtcagtgagtgaatgacgtcactctgtgggagccagtgagtgaatgacgtcacctgtgtgaagagtcactgagtgaatgaagtcaccctgtgtgaagggaccagtgagtgaatgatgtcacccgtgtgaaggggccagtgagtgaacaacacgtgtaggcaggcacccctcggtccacaggcaggtgggcacacagcccgggccggcctcttgtctcacgtcctctgtggatgtcactctaccctccctcttctctctgacctctccacacccagctgtgcgctgtgggagctcctgcagcttctgcactcagccatctctgctccaagcttcacatatgcacgcatggttcctcaagcacttgtcgtgagacaggtaagaggctgcccctgtgtgtactcacccaccagccctgcatgcctcatgcccacaactctctaaaccaggtcacgctgagaccatggccatgcctgccatggaagctgcagagactcgggatccaaagccaggtctccgaagggcagcgcattttcctgacagccagggacagggccgtgtccacagcaggtgctcatgaacgctgcacagtgttctctggggtgggccctccagaggctcccacacattggcataggacatgtgcagaatgttctagagccttcggtggttacagcaccaaaggtttgacacttggctgcagcgacactgtccttcaggagattttcatccttccccttaaacactggtttccactgcctctaaataacttaccaaagctgctgaaatcacctttcacttctctaaacaggttccctcatgtaattaacaagagccatgggctcgcagctccttccctcccacccagtctctgcgaccaagcaacaggagccaaacagaaaccccagggccccgtacttactccacgtcagcgaacgcactgctgggcacctgcaggaggcgggcgacgtcctccaccagccgccttccttcctcggggcgcagggggctgcggatgacagcagggatggggagcagtcaccacagagccagcagtcctggagaactaaagccctgtggccccacagccccgctccctggtccccacacacaccctgctctcctggcctggggtcagctgccccctcaggcacaaggagtcacctgagtttccagcaacaagacaaacagtgcagtgcggacggggctgtgggaatcgcaagtggcccaccgtgtggagactggctcctctcagccttcagtgaaaatacaataaaggggagaagggagaagggacaggcaggtgcggcggatgctgggactctgactgaggatggggcggatccatggagaaagcatctgtttttaatgggctcatttctgatgtgaaccaggccccagtgaggggcaatttaactacccaatggaagtgtgagcatggaaaccaggcagccagcccactggcagcaactcagggcagggggcgggggcactcccggaaggcactgtggccgcagactccccacaaggccacctggctggggacctgtccgtcaagaggcaagagccgtcaccagggtggtttgcagcttgatgactcatcctgaaggccagcattcaggttgaaagtcacaagttgcctgtgaaatcctgttagtaccactttaatggagtattaagttacaatattatgtaaaagcatgttgtaccgcaaaggctttcaccccagcagaccaaaacgcctgcattcctcatccagtgagcgtgcaggatgcctgcagggcaccaggagctgcttccaaatacagcaatgaacagcaagaccagccctgccctcgaggggttcacattctagagatgctggtgaatagaaatcaatcatgctatgatgggttgaattatgtcacctaaaaattcatatgttgaaatcctaaaacccaaataatgtgaactgatttggaaatagggctatcatagatttagttaagctgaggtcaatagggtgaaccctaagccaatatcactggtgtccgtataaaaggagggtttggactcagagacaaacgcacagggtgtcgcaaagacatggggagaaaccacccacaagctgaagtcatctcaggccagtagcagcaggggcgaggctgggagcagaccctcctcagcctcaggggaaccagccctgcccacacctgggtcttggacttccagcctccaggacagggagaagatggatttcccactttggaagtgtgcgccagcagcccaggcagactagctcctgtcggctgacaagttctctggaggagacagctgggtagagaagtggcatgcagggctgtggagggaagggcagagaggagagactgtcttgtaaagtgggctataggaggcctctccagtggggccccgtttgaacagaggtgaaggagctggaaacagggtatcagacagtgagcagagaaggcaagggggccgcggtgccacatggtgaggaggtgaagtcacagagcagctgggtggacatggcctggagacgagtgcaggaggccgtcagctggggcaggggcctgagctggccaccacggctgtccggtggggagcctggggatctggagggacatctgaggccatgccggtggagtccgctggcactgggaaaacacaagatgggcagaagccccaggaaggcccagctgggagtggtgctgacagagtcaggagtttacatcctgcacacgtggacatggggaccccagcagggcgtccaggctaggtgctgaggggcgacgtgtctgtcagtgcagaggtcaaaggccccagcggggcatccaggctgggtgctgagggcagtgcatccatgtgtgcagaggtcagaggccccagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagcattgagggccccccggcatttagggccccccagcattgagggccccccaacatttagggcaatgaggggaactggcaaaagagaatgaaaaggactgtgacagaggcaagcagcgagctggcaagaattccaagaaggagaagggccgggcctcagattggtccagagagatgaggatggggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagaggggcagtttctgttaagctggaagacgtctaggatgctagcatagggataggagtgatgagacaaggtgctggatgtagggcatggctgtgtgtgcccagagcaggcagaggccttaggcaggagtaggacaatggtaacagaactggcaccagggctggagaccccaggcattctctatccatgacttacactcagggaccccttggggagaggacctcagcagggcctgcagattcagactcatgagcaggcgcatgccgtgactagtctagcctcagagcgcagctgcactagctggagagagagggtagttcttgggggttatgaatccttcctggggacagagagacgcattgaggtggattctcatgggcctcgcacctgcaacaagaaagccatctgatggcgtcgacgctacaagctgttgttgtggccaccagggacacagcctaccatccttggccaggacttcgaggcacgtagcaatccgggaccagctggggcacaggccgccttccactcagggaggagccacatctgagctcaggggctgagcctgtcccaaaagcccggtacctccagggagaccggtggcccctacatctgggtacccctcagagccacctggggagggtgtccaggcccatgcctgtcctgcccagccagtgtggctgcaactggagcccaggacagtgtatttaaaataaaaaaaccaaaccaaacaaaaaaaccctttgtaggtgaaggtgacagctggtccagtttgggagtggttacagcaatggaaaggtgaggctgcatccacgtaccacaggccttccctgcccagtccagggctctgggacctgagtgggccaaggactcaccaggatgggccaaggactcaccaggaatgcagatgccccagccaccctccagcgtttcggagtcaggaggccacaggtcaggcctgggaatctgtgtttctcgtgggttcccactggtgctgacacttgttcaggcatctgctttgggaaccccttggccaaactcccacaccataaaatcagcaacaaagccacatgacttccaaccctagactaacgtaggtcgctcagcttcaggcaatctacacatcagttgggagggatgtggaagacgtgccgcgggaatgctctactcttcatctaagaaatacttcctgagcacttgtggtaccaggctgagccaggagctatggaagcagagatgagagaggaggaggagccagcggcccccggcagcctctaatctggcaggaacaacggtaaagaatatgcattaaaaaacccatggcaaaccccagggaaaagagaagccaccggccacggccctggggcctacatgggagcctggtccaggctggggtaagggagccccagaagggtccccaagaactaccacagggctgagagaatggatcgtgttactagtctaaggcacagagcgcgagaggcagacgcagggatggaaacagcaagcaaatgccctcgggtagcacagtcactcagagaacttgagagaaggggcaggggaggcacggatggctagaaggaagggagccaactacatgggtgctcctcacccattaagggattggagtttatcccaaatacaatggcgagctatcaacagggcctaggcaagggcactgtcccactctcctggtcccagcttctcagaaggctgaggagccaagatcactggagtccaggagctcaaggctgcaatgagctatgattgcacctgtgaataaccactgcatcccagcctgggtgaaagagcaagaccccatatccaaaataacaacaacaacaacaacaaaagttccctcccctggataaagaacaggttggagaccagaggagacagaagggaaacagctggtggcctccagattgtctcaatgagacatgagctcaagcagcatggaccgtggtaatggtgactgaagtggacatggtcatagactgcgatgtgtcagcgggtaaggtgttcagaactgtgagtgagaaaggtgggctctgcagggttgaagggacagcagagcagatgctgttttctgaagcaggctgctatgaactaattgtgacccctaaaatctgtatgttccaatctttagccccaaggtgaaggtgtgaggaggaggggcctatgggaggtggtcaggtcatgagggtggagtctcctaatgagatcagtgccctctacaagaggctctgtagatctttttccttcatgtgagaaaatgccatctgcaacccagaagtgtgcctccaccaagaacccaaaaatctactggcatctggattccaacccctggaattgtgaggaagaaattcctattgcttctaagctgccccatccatggtgctttgttatagcactgcgagtggactcaggacagccccaggacagaggaaagatcctgaggtcagcatcaaacacacggagtctgtgttgccttcaaggcatcaggtgaagatatgacaagactgggtgggccctcaactgtctgcactgagcccatccctcacactccaccctgtgccaccctcagatggaacagggaaggagcctggttcgctcaggtgagtaactgggaacttgagttttataagacaggcccgctctgcacaccctgcatggagcggtgaagtaaggacctcacccacgtggggtaggctttggctactgcaccatgcacctctccctgcacatggacacaagtactcattccacaagtagattctacattggcattaactgcatgaatgaatgaacacgagaatgtcaaaaacagcaaaaaatccaacattttaaaaatcattaaaatgtaaactattaaatgaaccccactcaatttataaagtttctgtaaaactaaagtaaagcatgaattagttttgggaagatggtgagtaggaaacaccaggaatctgtctcccacctgacaacactgtgctagtaggatctgtctgatgtaactgatccttgaactctgaagcctaatgaaggcctccgacttctagtggaaggtctggatacaccttgcagtcaatgtcagctttcatcacagtaggagctaccgctactcaccttcagccctgtggcaagcagctgtgcacatgttcctggagcagcctgcacacactggcaggagccagaacaggcaatacagatgttgtcctccaaatattgggaatctgcaatctcactgctgattgctgcttctcatcacagaggtgcaggaaaggaggagggcaccattgtttggccacctcctcattgttgttgctcctccccctctggccaaaatgacttacaggggatttaaaatgctaacacccatttttcccaccttcatttttctctttttccgcttttgggagccagaaattaaagaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataattgtctctaaaaaaagacctgatggcagatgtactaggcaaagactttaaaacaattgtcataaaaatgcttgaagaacaaaagaaagatgtaaagaaagtcagaaaaattatgtatgaaaaatgaaaatgtcaaagagaaaacctaaaatataaaagaaattctgaagctcaaaatacaatagctgaaattaaaaagttcactagagagattcaaaggcagatttgagcaagaaaaataaagaatcagtgaacttgaagataggacaatggaaattattcagtctaagaaatagaaaaaaagattgaagaaaagtgacaaaaccctaagggacatgtgggataccactaagagaaccagtatatgaattgtgagaggaaattgtgcccaaaagaaaaaaaagagataaaggggcagagaaaatacttgaagaacaatacctgaaaacttcccaagtttgatgaaagacatggatataagcatccaagaagctcagtgaactccaagtaaaattaactcagagacacattttaactaaattgttaaaagacaaggacaaacagagaattctcctcttacatttgaaagcagcaagaaagaagcagttcatcacacaccaggctttccaaataatattatcagcagaaactttgcagaacagaaagcagtgaaccaatatattccaagtgctacaggaaaagaaaaaaaaaacctgtcaaccaagaatcctatatccaacaaaattgcacttcaaaagtgaagaagaaattaagacattcttagataaaccaaagctgagagagtttgttatcactagacctgccttgcaagaaatattccaaggagccctgcaggatgaaatgaaaggacactggacaataactcaaagccatataaaaaattaaaatctcaataaaggcaaatatatggtgaattataaaatatagtattattgtaacagtggtttgtaactccttttagttctctatatgatttaagagactagtacatatcttaaaaacaattactagttaaaactagtattataactttggtttgtaactccacattttgttttctacataatttaagaaacgaataaattttaaacaattattagtttatatcctgggacatacaatgtataaggatgcaattttgtgatatcaatagccaaaaagggtgggtaaatagcataaaggagcataatttttgtatgttattgaagtcaagctagtataaatttaagttagtgttgtaattttcagatgttaaatctaatcctctatgataaatacaaagaaaatagctacataatacgtacaaaaagaagaaaggaatttaggcatttaatttttaaaaatctactaaacacaaaagaagatagtaatgcagaaaatgagtggcaaaaaatccataatgcacatagaaaacaaatattaaaatgacagaagtccctcctcatcattaattactttaaatgtaaatagattaaactctccaatcaaaagacagagattagcaaaatatgatattccacagatcttttaaggactatttctatagtacacaacaagggatatctatttgcattaactataagcataaacatgacagtctttgttttcaagcatgtcaataatgtcttctttttttgtcgcccaggctggagtgcagtggcatgatcgttgctcactgcagcctcaacctttccaggctcaggtgatcctcccacctcagccttcccatttgctgacattacaagttcatgccagcatgccttgctaacttttctattttttgtagagatggggttttgccatgttgcccaggctggtctcaagctcctgggctcaagaaatccaccactttggtctcccaaagtactgaaattataggcatcagccaccacacctggccaatatcttcttttaatataagagatagcactgtgagtgtattattgctacatttttagtttaacgtaaaatttctcattttgactattaaaggaaagtaaaatatttacatcactatttaagaaacctcataatgtacctagcgtgtatagagtactcttaaaactcaacaacaaaaatacaaacaataccatttaaaaatgggcaaaggacttgaatagacattttcctccaaagaaaatatacaaatggccaaaagcacatgaaaagatgctcaacatcactaatcattaggaaaacacaaatcaaaactacaatgtgataccacctcatacctatcaggatggccactgtaagaagaaaaaaacccagaaaatagtaaacgttggcaaagatgtggctaaattggaactcctgtgccttgttggtgagaatgtaacacggtatatcaagtgtggaagagtatggagactcctcaaaaaaatgaaaaatagaattgcactttgatcgagtaactccactccttggtatctacagtagtcccccattagctgcagtttgttttctgtgttttaggtacctgaggtacagtacaagaagatatttgaaagagggagagagagagagagagagacaccatatttacacaacttctattacagtaaattgttataattgttctattttatcactactgttgttaatctcatactctaatttataaattaaactttatcataggtatgtatgtataggaaaagccatagtttatatagggttctgcactatctgaagtttcaagcatccactggggttcctggaatgtctcccccttagataagggggagactactttgcccaaaagaattgaaaacagggtctcaaagagatgttagtgcctcacattcacagccgcattattctcaatcactaaagcatgggggcaactgaagggcctagtgatggacaaatggaggagcaaagcgtggcctgcaccaaaagtagaatattatttagccctgaacaggaagaaattcagacacatgcgacaacagggatgaaccctgaaacatgatggtaactgaaataacctgggcataaaaggacaaattctgtgtgtctacccatgtgaggttcctagaatcctcaaattcagagagacacagagtagagtgaaggctgccaggggctggggtagggtagtgtttaatggggatgaaacttcagttttacaggatgaaaagagctctggggatggacagcggtgatggttgcacaatagcacaaatgttaacgctactgaattctatgcttaaacatgggtaagacagtaaactttatgttatctatatgttaataaaatacaagaaattgggaagatgaaacaaggtgattagtataaaagcaccatgacgtgtggctgctccccacatccaaggcagtgtaccagccttcgtccaatctctatttcagcagaacactccttgtggctcacggagaaagctgagccaagttcctgctggatccctggcaaagctcctttctgctccctgtctccaaggaaagcctgtggcgtgttctttaaagtggatttttcaaggctgcattctgtgtaattttacaattgagaaacaagccattttcctttaaagagtggctgctggaaggggaggggtcccagatgtcctctcttttcctgtacattttggatgtctgctctaacccaggtcagctcctgtcccaaaacatcctccagggccatctgaacagcttgtgaagggcactggtgccagaaaaagtgtcagaatggccagatgttgggccagaagggaggcaacagggaagggagccaggcggggctacaaagacaaactcaggctgcagctggacagagcaatgacccaccacagccggctcagctccaccccggctgagaccagcccaggctgctgggaactccagacttgcatccaaccagcctccctgctccaagccaaaccctcctggcaggcaagtgcgatgcttccagatgagcccttcctttttttcgtgtggctgcaggttccttcctcccggctcctgtgctccccagcagcctgggcttttctctctgcctgggcctggtggtgactgctccaaagggccagcctacctgctcccatcgctgacctgccttgcctcagccccctgcaccccagcctccctgggcctccccatccttggagccattaggaagagggcaggtgcagaagggcaggtggagaaggctaggaccgaccacaccactccaatcagcaaagacagaaactgctgctcttcaggctttccctaaaactccctgtgtgctttgatcagcaccactcagctcatgacttattttaaaaggtctccagtactttcatattttaatcctgcctccccctacaaactgcaaactcattgagggcaggagccacgtgtcatctgagtttgtttcttccaagcctactgccccctgcggagcataagccaacttcccaatcaatgtttgctaccaaattccatgagtctccttttctagcatgtttcaaaccaaggggatggtatgaggacatgggaggggctccaccacgaatcctgggcccagccctctgccctccatgctccaatatggaaaccaacagaagcatccacaagactcctacaacaccctgaacacaacaaggaagtccacaagcccagaatgtgtttgtgaacccgctgcctccacaagccaaggtgtccccagttatacaaagtgtacgggacgtgcagtccactcccttccttcctcagcctggcaagggtgacagtgccggccaggtgggcaggggcatcacggctcctctgtaaagcagaagagtgctggctccattctgtaaagcagacaaacaagacagggctgactgtgctcacaatgatcacgcagccattcctatttcatctctaaagccacagccatcatctgtcattccgaggcctgaacttccttagaaagcagttggacgtcatcctgaaaatgagtgggaggatccagcaggtgcgacgtgctgtgtctgcatgtggcggcttccaccctcaatacctggacactaatattgccgtagaagagaaacaggcatgagaacttttatggggtcagggtcagagctaggagtgcctgtgagggcagtggaaaggactttcaaagctgaagatggcgtctcctctctctagagtctttcagttctgaaggacagtggcaagtttgtgacgtctctaagctcaaccacgttggacaagcctgttcctatggatctactgaatcagccacatgggaggccctaaggcctcggcaagcactcactggagggaggctcagagtaagaagtgacagtgtccctcttccacggtgtcctctcagccccggcacagtgctgggtcttccgtgtggcatccacatcaccccgaaatgagtgcacgggtggacgcatgagcagaaaatgactacgggagtgtcacccctaaaaatcagactagtgaaaagtacgtaggggtcggaaatataaagagtagtaaaaactctgggaagctcctgtgctggacgccacactgaggccccacacagcggtgggatctggcattcagcagacccctgaggaacacactattattggcctcatttaaaagagaaaccgaggctagagaaactaaagtcattgcccaaaattacactactaggaaactcccaggagaaaagctcaaacggaacactttatcattcaggctatgttccaacgtaggtgcccagaaaggtggggtgagcccggggacctgttgcgacctacacttgttcttaacaaaaccgaaggaagcctgcataaaacttctccacgtctcattttggcagccttgttactgcctcttccttgtgggccagatgaaatcaagccaagaacaggacccgccatgaccgaccctcctgctgaccatgctctgtgcttctgcagcttcaccagcccgatctgggacattttactatttactgcaaaacccaccaggagctagggagccaaatgtgaagggaaaatgagtcaactttgatataaactcttttgataagacaatactcaaaaccaatagataaacgaggtttcttgggatcaaccaattattctagttatccctgttcatcattaaaacaaaccatgaaatttattctatttaaatcatcttataaagtagttaaaatgtttccagcccacgggaacctcccccatgcagagaagcaacgcttcgagggtggcaaacagtgggctggggaggtgccctgaccaacgcgtggtgactgacaggcgccacagtatcctacagacaccacggtgaccgacgccatggtgaccgacgccgcagtgaccgacaccatgtctgtctccaccctggatcccctgcacgcccactctcttcctgcaggagtctaatgtcagggtctgggagaaggaggttttgatgctttgtgcacccaaactgaaccttcctcctgcggaccgccatgcagccccggagctcgtgtgccgcacccaggccaacgaccctggaccactgctagtggggctgtccacaccatcgactcttccaggcagaaaatcaatagaggaaaaccactgtattctgacaacttattttttggcataaggatgagactgtactgctcactataaacactttttaaatgccagcagctaactaaagatctaggtacggaaggtctatatagcgtcacctttaaaaagtgtgccaaataggatcgggaagtgcctccagcaggagccgtgaacccgtgctgacccaggcagagctggttctctaatctgattggatctcagatcccgtgccgacccaggcggaacaggctctctaacctgatttgacctcagatcccgtgccgacccaggcggagctggttctctaatctgattcagcctcagatcccgtgccgacccaggcggagctggttctctaatctgattcgacctcagatcccgtgccgacatggaccaccaagttaccatgggacctgagttgcccatcatgaactgaatgttttccgacccaccaagccagaaagttgggtgtacacagcagcattccatcatcaaatggaagtggtatgtgtctgggcctaagtaggccctaaaggcacaagttacataaagaagtgccgccaatgccaacggtccccactcccgctatgctgccttctctctcccagcctgcacctacagtctcctggagagttccctaaaatcagctgacggaggaagacctgggcctggtttacagatggttctgcatgatatgcaggcccccacgttagtggacaactgcagcactactgcccctttctggaacatccttaaaaggacagcggtgaagggaaattctccaatgggcagaactataggctgtacatctggtttactttgcttggaaagagaaatagccaaatgtgtgattattacaaattaataggccatggccaatggtttggccagatgctcagagtcttgaagaaacataatggaaaattggtgacaaagagacttgggaaagaggggtgtggacagacctctctgaatggggagaagacgtgaacaggaagctgcctcccagacgggacaggtgcagagctgggaccttctgcaggagcccagctgccggggcggagggagggcctggtggagtgtccccaagatgcacctgcagagctgctggtcagcctgggccacgctggggctggggtctgtatctcaggaccagtggagtcacagccagattccaacaggagagggtgacggggccagatttggttttgtcgagtcctctttgggttcaacgtgcacggcgggtgagaaagaaagagccgtgatgctggtgcgcaagagagaaggccccgcagtgcggaggcaagaggctcagatggcctggaccagggtgggagaagggaagaggggagaaggggagacagcatggatggagccataggaggggagacagctggccatggagggagccgggtggggcacagagcccactgagctgccgggctggcgagacatggctcaggcccaaccatggccacccccctgcctcaagtgcctcccacggccgcctccctgtctcgagtccctcccagggccacctccctgcctgaagtccctcccagggctgcccccctgtctcgagtccctcccagggccacctccctgcctcaagtccctcccacggccgaccccctgcctcaagtccctcccagggccacctccctgcctcaagtccctcccacagccgccccctgcctcgcgtccctcccacggccacccccctgcctcgcgtacttcccacggccgctcccagcaggatgggctggactgtcggggatgctgaggtttgggagagtttttgtttacttcttcttcctctttttcctgccccacccccatgccactccttctcgccttcttctcttctaatgtacaagcaaccgtgaacatgtttacccatcggggctataaccccacaccacctgaaatcttcttaaatgataataaatccatcatgctacagatattcttttaagaccacaaagcaaagaggagcaagtgacaaggcagggcatgtccgccctcaggaggggcctctacagaggtgaggactgcgctttctgaacaggaagtcacaacacagcgtggaggctgaagaacaaaacagaacccctgaaatctgccctggcgccagaaacacagaatccatcttcagcatcctcagggtttcctttactctaacaaggaaggacgagcaggaagcatcagtccggacctcggctgcaccccgtcctggcaccctgctggttctcgtgatgcgctcttctcgctgaacccctgaggggctcctgagcggtgaggcctcctgggcagccactaggattggaacttcctctccaccacaccagccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccaggacagcggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccggagagcgggcggcggaacttcctctccgccacaccagcccccaggacagcgggcggcggaacttcctctccgccacaccagcccccggagagcgggcggcggaacttcctctccaccacaccagcccccaggacagcgggcggcggaacttcctctccgccacaccagcccccggagagcgggcagtggttcctgagcactcggtgggtttcacatttcacatctcacagtgagccgaggaaggggctgggggaacctgcagggccagggcactcactgagggtggcagatggagagaccgaagcccccacctccttccagacttctggttccaaagttcctctccctggccggcggatccctgccttcactggcctctctgaattccacattccaactgaacccccacagaggtgagcacgcagcagcccctaacggtggcccggtaccatctgccattttgctgcttgccttctccgaggtgcaagaaagttttgtcataagaaacacttgaaggaagaaacatttcagctgcagctgtctcccttgttagcattgagaggcatcggagaggtcaacgccgccccatgccactttttgcacattcttccctcagccggcctccccgcaagactcagggctccaacctctccagcttcccctcgtggaaatccattggctcctcctctttcaagcaacactgtgttcttcccactgctgacagaggctgctcatccgtgcacctgtgccctgcgtcctcctctgcgtgcaccctgcgtcctcctctgcttgcgccctgcatcctctgcacgtggcccgggctctgctccacctgagccccgttcatctctccacagtccaggagccacacactgcggctgccactccagagaccaggaaacccaagcacaggggcgtttgccacattctaggtctcggggctgccgtgggaccctgaccctggatgccggacttccgtgggtcaagggcccaggccaccttctccaacagcactgtggccgccaccccagactcaagcctctgcctcagctcccatgttttcctgactacaggtttcacttccccaaaatccacctcactggctcagcgtggtcgttccgcagaatacatcccaatccagtggggtctggggtaggcagagagaggcatgtgtgtgtgagccgtggtctctgaagctcttgcctctggatttagaaggcaggttcctctttgctgagaggtaaggggctccctcctccctatacctggtgtccgtcctgtgattccttctggaaacctaacatgaaatcattttaaagttgtccttggaggactggggcggctgtcctgcccttcgtccagtcttcaagaatccctctagtttgtaaaaaggataaaaatgtaaatggcaaaggattactgtgtccatcagaaaatgtgagagagaaaatcatgcctggaaaagccgagccctaccatcctcccatctgaacctcagcaccaagagcatgtggatgctgaggtgacaccgagttctaaaccacattcctctcctttctgtgggacaaccaaatgtacaaaagtcccccttttttaaagaatgccatctgtgtcttggaaattaatagctgatctgttaaggtttaagctgaaatctggtgaaaacttgcccaagagaatcacaaattattagtctgataatagggcaaaaacctcaatctccttgcaagaagagaggagacctcacctagtgcatcacaccttgctcaagcagtacaaattgctgacaaaaagctgtgctgtcttcaccagatagcttccaaccagttgaagtcgcaaaggaaaagaaaagaagtcagccaagataacatgatgattttttttttctttaacccactgctcataggaggtaaatattccagtccaaaaggcatggccggcaaacccactacaagaaaataaactcgaatgcaaagaaaagccctagcttttttctactggaaagtcacaagcacagacaggaaatgacccaatgtgataggtctccttccccagaaagtgcgaggctgctgcagacaggggccctcctgtccttccctccagggtgagcccattagcagcaatggcacaggattgtcggctctgaaggttccctagcaaaccacaccggcctcctgctctccgggtgaacacctcggcatccatttggaaagcccttaaaatgaccagatcactggttctctggggcactctcctaccccggggcagggatgggcggccgtccccctgcaagggtggctcaagtccccaggacacctgcagggaaacacacagtgtccacgaacacaacatgggggccttcaggagaaaagagggctccagcacagagtgaggagacacaggcaaccaaacacacacacacacacacaacataccccacaccacacctacaacacacaccacaccatgcaacacactatgtgccacacacaccacatatacaacacactgtgcaccatgcacacacaccacaaatacaatacacaccatgccacacactacacaccacacacaacacataaaccacacagcacaccacacactacacacatacactacacaccacacacatacaacacataccacgccacacactacacaccacaaacagataagccacacagcacaccacacacgacacacaacagacaccccacactacacaccacacactacacaccacacacaacacataaaccacacaggacaccacacactacacacatactgtacaccacgcactacacataacacacaccacacagcacaccacacacaaacaacacacaccacacactacacacaacagacatgcaacacataccacaccatgcagcatactacataccacacaccacatatacaacacactgtgcaccacaacacacagcacacacacacaccatgcaacatactacacaccacacatacaacacacactacacacaacacacatgcaacacataccacatgcaacacacaccacacatcactacattaccacacacacatcacataacacccacaccacacacaaagcagtgtttcctagggagggagacgtccacagcacagggcgtttgaccacccataggaatcggtcatgataatggtctgcgtcacccagtgctgaggcaggcgcctccccttggctctgctggtgcagacacgcagcctcagaacacatcacttagggcctgcctgtgattctccactgggcttgagagcaaagaaatgaacagccatgagaagttcctgactctacaaacaggagagcaagggcacagacagacacgtgggacgcctcctccaagcaaagagcctggaaacgggaaagctcatcctgacttatgtaaagcagtcttgagaaaatggagtccatattttagtgtaagcttcaagtttctgctgcttacaacttacctaaagatacaactaagataatcacctacagctgaaaatcatcttaaattttaatttggctttgatacacactctgcggtttgagctcaagataaaatatttctgcccaattatgatatgcagctaattctccctgatgaaatgtagcatctgcagcacagcgacagcaccagcccgagcactgcgaggctcgcagagcccgcaggacagatgggttctagctgtcatgcagctcccacctccagtgcgaatgatcctcaaaataagaggtacttcttcaccaaggaagaaatacccgaacagacgcacatcatactgatacacatctacccgacacacacactcatatacacacatgcacatatgcacacacttctacccaacacacacactcatacacactcacacacacacgtacatacagatacacatctacccaacacactcatatacacacatgcacatatgcacaaacttctacccaacacacacactcatacacacacacgtacatacagatacacacatctaccccacatacactcatatacacacatgcacatatgcacaaaccaatacacatctaccctacatacacactcatatgcacatatgcacaaaccaatacacatctacctgactcatacacacacacgtacatacagacacacacatctacccaacacacactcatatacacacatgcacatacgcacaaaccaatacacatctacctgacatactcatatacatacatgcacatatgcacaaaccaatactcatctacccaacacacacacatacacacacgtacatacacacacatctacccaacacacacactcatatacacgcatgcatatacgcacaaaccgatacacatctaccgacacacacactcatacacacacatgcatatgcacaaactgacacatctacccaacacacacatatacacaaacacacatatgcagaaatcgacacactacctgacatactcatatacacacacttatacacacacgtacatacagacacctgcccaacacacacacttatacacacacgcacatacacagatacacatctaccaaacacacactcatacgcacatacacacatacacacacaaatacccgaagatgcacatcataccaatacacatctacctgacatacacactcatatacacacacgtacatacacacacacccaacaaacacacatacatacacacgcaaatatgcatagacacaaatacctgaacagatgcacatcataaaaatacacatctaccccacatacacactcatacacatgcacatttgcacaaaccaatacacatctacccgacacacacactcatacacacacgtatatacaaaccaatacacatctacccaacacacacacgaacatacaaactgaaacacatctacctgacacacgcactcatacacacacacttatacacacaaaccaatacacatctacccgacacacacactcatacacacacacgggtacatacaaactgatacacagctacccgacatacacactcatacacacacacgaacatacaaaccaatacacatctacccgacatacacactcatacacacatgcacatacacacaaaccgatacacatctacccgacacacactcatacacacatgcaaatatgcacagatacacacacatctacccaacacactcatacacacacatgcacatacgcacaaaccgatacacatctacccgacatacacactcatacacacacacacaaatacgcaaatacacacatctacccaacacacacacacacaaatacctacaaactgatacacatctacctgacatacacacacatgggcatatacacaaaccaatacacatctacccgacacacatacacacacatgcaaatacgcacagatacacatctacccaacacacacactcacacacatgtaaatatgcatagatacacatctatgacatatacactcatacacacacaaatatgcacaaaccgatacacatctacctgacacacacacacacgcacatatgcacagatacacacacctatccaacacacatacacacacacgtacatacacagatacacatctaccaaacacacacacatatacacacacacgcacagatacacacaacgaaatacccgaacagatgcacatcatacggataacacatctacccgacatacacactcatacacacacacacgcacaaactgatacacatctacccgacatacacactcatacacacacatgcaaataagcacaaaccaatacacatctacccgacatacactcatacacacacatgcaaataagcacaaaccaatacacatctacccgacacacactcatacacacatacatatgcacaaacatatcgacacaacacacactcgtatacacacacgcacgcacatgcacatacagatgcacacacatttacccaacgtacactcatatacacacacatgcatacacagacatctatccaacactcatatagacacatgcatatgcacagatacatgtctacccaacatacacactcatatacacagatgcagatacacatctaccctacacactcatatacacacagatacacacacatctacccaacacacattcatatacatacgcacagatacacatttacccaacatacactatacacacacgcacatacacatctacccaacacacactcatatacacacacatgcgtatgcagatacacacacatctacccaacatacacactcatacacacacacacctacccaacatacactcatatacacacacatacaaacgtgtgggtgtgtgtacatccaggcagacacgtccttctctttgaaacaccaattctatcacttgaagaaaacacaacacttgtacaaagcaaagcatcaaatgtcagattcattaacggggtgacctgagaacgggccagccacttgtgccttgctgggcccgtgatgtctgaattctgagactcgttaagttcagatcgacatgagggcggggaaagaggctcgctgctgtgaagccccttcttccttctgaagggcgcccacgccaggatatttgggccactttggtgcaaaacagataaagcacctggagtccttcctaacaggcaggaggagtccggggtgcagcagtttccagggccgcgtcccatcccgcattcccgcgcgggccgtgctcaggctttgctgtacacttacctgccccgagaccccaccctgcctggccgccgctgaaggtgattctgacccgcagagaggcgcggcctgcaggtgaccagtcaggaccaaaaacccaggaagggatttgcttggtttggttttgtttgatgcccttcagagaacggctctccagctctggagcccagctcagaagcatcaggaggagccactgtccaggcacctggctgccctccgcgcctgagactccagggatgcctgcaccccattattcagttgaagacacttaaaagcgtatgcatccgccacagcaaggaggcgccccacctccagcctgctgggacaagccctccctcggcacacaggagcttagccagggctgctactcactctctgtctgtcacgatgtagccccgcgcctcttcctcggaaggctggacctccaattgcaggccgtcgctgagggcctcctgagcacccgctggaaggctctgctcctccttcgagggcccaggcatctggttttggagctccccaaacgcagcggccccgggctccgaatgcggctgctgccccagcagatctttggaatacgtctggctcttgacgttctccactccggcagtctcctcttctgaagacagggaagactcagggtgctcggacttcttcctctccatgtcgaggggccttgcaaaggggagggctccaggtaagagtcgagacccgtggtcctgcaggaggcccccgagtgtggcactcagacgatggacctgacagagaggacattccgtgagggacgtctgcgaaaggaatgctgatgtgacacatgcaatcaagggctgcccgggacagagtcactgtggggatgacatgggcagcctggaaggagagtgtgggaggaaggcgaagtgtgtgcagtctatatttagaatgatgtctagccgagcatgaggtgtgagggcgctgagtatccgaatcacttacgtgctgttttctcctccctcccgctccctctcacacacatgctcacacacacacctctctgaagaatcagattttgtagagtttgtgtaggtctttggcattgatatttttaaaaataaactgtgtgatatcaagatcccaccccagccctctagaagcaatgaacactaaataataataataataataacaaatttgcaacgactgagctcttccagcacacaaaggcactgtactaaatgcgttatctgcatgaacacactgagtcctcacgtaagcctgtgggtggggcaccctcagtaaccccagttcacagaaggggagacggaggcacaaagcgattaacccacaagtgggcacatcacagggatgtgtaattgattctaacgatacctgagggatctgtggtcctcacacgggctacagtctcccagccggatccccttttcctggacaagccatccctcggaaccccctggcacctctgctgactatgcaccgggtacagatttgctttgtgtgggttctcatgtaattactactccaaccccataaataaagggtgagtttcacctttaatttgtagactctggagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagtcttatgtctacttggcagggtttttttccaaccatgaaattatatcttcaatattatattagatgtaaacaggaaaatctgattcactttacaactcactttgccaaaacacacttttaagaaaattaaggaaggactatagaggcaattattcccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaataagaagtcagaaaatacaacactcacataccctttttgagaaacagaattgcttgaaaatacaccccaaacaacagagaactgagtcagaattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcccacaccatgaacaaaaagatcaccaacttccacatttaacatgaaacaaacaccagagacgtcatcttacctcttggtaaagtctatcatcgtcgtcctgcactccgtcatctgtaaaagacaccagtgttaccaagaccctcatcaagaatgtcatcacagggtgccacagacataaaaagggtgaccctgcagacccctccatacgaaaggtgaggtgtgatgacgctggcctaagtcctgccatagagtaaaccttttctgtttatagcacaaaatggcattctgtaaacttcgcgagagcggaggggactgaggagctaaatggtagacgtgaaggcagccacaatgacctcacccagctctgggggtctcacgtgatcgacaaagttaactcacggcaaaaaaaaaccccatcgtaccgagcagttcacgtcatgaaaaagcaaagtgaagccttcgccaaaaccacctcacaattaagatggcttcagaatccactgacttaggttatttcactgtggtcagcgtttctctctaaataggtaccccggctgggcgcggtggctcacgcctgtaatcccagcactttgggaggccaaggtgggcggatcatgaggtcaggagttggagatcagcctggccaacaggcgaaaccccgtctctactaaaaatacaaaaaattagctgggcgtggtagtgcacacctgtaatcccagctacttgggaggctgaggcatgagaatcacttgaacccggcaggcaaagtttgcagtgagccgagatcacgtcaccgcactccagcctgggtgacagagagagactccatctcaaaaaataaaataaaataataaataaattaattaatatcctactttcagtgcccaaaggtgcgtgactcatggcacctgaacagtgcccctggagacagcacgcacaccagggcctcctgcatccctcctagccatggtgcgggtcccgattccttcaaccactgggcgaccacctaacacaggccctcccggggtgcagttccactactcccctgcaccctgcctgtcagccaagtcaggcttccagcttccagcaaggccccctctgcacccgtgcagagagaggggcacgtctgtcatttggttttcagcacgtacttgtggggctgccatgtgtggggagctgagctaggtgctttcttgcagctccacgctgtgagaagccatcaggctgcagaagtcctggctgacccatggggcctccacagggctccggatgcctgccggggtagtggtgctgaggggctgccttctgcttccccagcagcctcagaggaccaatgcacgccccaagcagacatttgaatgatcccctctcactctgctattcaaatatttgacaatattcaccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttccccagaggtggaaaacccacagaatggaaggacagactcatccacgcgctcaggaggatggaaagcacagcttccagaaaacactggaatgaccaagccaggaagagagatgggctaggcaacttcaccatgtcctccagaggataaaagaatgggatgagctgtgtccccctcacttggcagaaggagaaacaatgcctggcaaggacagcgccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagcgaggagacaaggccatttgtggagctgccataaccgcggagagatgtgtgcacccgctgctcagcagagtggggaaattaaaacagaatccaacacacattctgtaagtgaagagcacggcgtctgaaatttaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggtgggaaaggaaccagaaacacctgaaagaaagcccacaagtctctcaaatctgggaaggattgtcactcagggactcaagacagtcactaagttccacgataataaaatgcaaggagaaccacgccatgacttcagctgagctactgcaagtcagagatggagaagattcctggaaagcagcgggggcggggcggggggaagacacgctccacacatgagaatggaaagggtcccaggagcgcagaggccgccagacaccctgcatgtcctgtaagaacaacgtatttcatacaatgtgcagagtcaggcatttgacgttacagataatgaatgccacatttgaagggttgaaagaaaaatcattcaatccaggagtttatatccaatgacaatatccttcaaacgagagggtaaaggagagacattttcatatcacgtatgtgaacaaagctgagccagtgggtccctgtgggcctgcacacaggctgaagagaaacaccaccacacagaagcccagagctgcgggaggagccaaaaagctcctgaaagggtaaatatgtggttacataaacaagaaagaccgtcttcttttctcctcttactttatctaaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatcttccgtattacccagaaattggactcgtaagtatttacccgagagaagtgaaacccgtaaccatgagagttaaatgagactgtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaaggatgggcgaggtctgcccagggcaaccagagccgcatcacctgcaggtggggctggggcaggaggaagcgtcgggtgtgagggtgtgccgtgcagcgtggccgctggttccaggcccacatgcgtccaacgcgtcatcgtgtccacctgcggtctgcgcatctcgccgtgtgtatactccccctcaacagcagcaataaagactctgccctaaagaaggttcatgggcccatttccgagctttgaaggaaaacctgactttcttttgtattcagtgttgaaatctctgtcctcataaaggtttatgtaaaatagctcatggccacgtctctaccttcccgaacgacaccggcagagtgacgcagaggggacacagaatgtcctgacctcagtggggtctcaccacgaccctccactgtaggggggtcccgctgccaccctccacgctagaggggtctcaccacgaccctccaccctagacaggtcccgccgcaaccttctgccctagagggatcccactgcgaccctctgccctagagggatctcggcacaatcctctacaatagaagcggaggaattatttctgctttttacaaattaagaaatgtaggcattttaggttttttgtctgcgtcaaatgcatcaccaggcctgggctgcagcctgcagtgtctgcacagggctcgacagtggcactgcctgtggcacccccgttcactcagccgcacgtcccgtcctctctccacagcgcaggctgtgtctagtccatgccgaggcagcggggccggcacccggtccccacgtgccccgttcactgcatacgcaggacaggagtcagtgtctggggccgcctagactcgcatgactttccaaacacaagtgccgatggcctgtggtgggttctttgagtgaaaattttttaagtgcagtctctcttgcccattaattgaagctggttcttcagggggcgtcttgctacacggctgtaaggacacattttttgaagtgttttgcttcatttctgaacactctctgctgcaccccatcccccaccagggtctcgcatggaaagggtcacagccatgaccctctgattttcccctttgaaaacctgagtcctgtcagcgccactccagacttgctgttgatgactaagaccctctgatgtaaaggcctgaacgtccatgacaggcatttctgagacagcattatgtgtagtttagcatgggatgaagcggacagagtcctttaaagtcaatctgtacacgaaatgtgtgacggacacgggcgttctgatcggagcgtgctgggcgttcactgccaccgatgtcccctgctggggtggccgagtgccccgctctggccgacgttgaggcctctgaattgttcggcagacagtggcggcttctttaccttcgggttgaagtgtccgtattaaccccacatttctgatgctctgacatctggggccctgctgaccctgggggctgcccctcccacgaacagccaattcccagatagtgaacagtcacccactccacgcaggctttccacatgcaaaccctgcgatccggagcccacgcccgcctccgcctctgtgggctcagactccaggccgctgccctagtcaccctggggcaaggaccagacacgggcagcccctggccccggagcggctggaactattcaagctgggcagtcctgtccctgacgaccctgccttgccctcgcccagcctccggactgacgctggcgcatccctgtatcgacccatggcgtggcctgccccctcctctcaaaatctgtaagtaacaaactgttgtttcaacagcagctgtacccagatctctcgggcttgccgtcctaaatcataatgaaacctgccgtttaaaacagaagaagggaaacgcagggattggcatggaggccgcgtactcttctgttttttcattagccttgagccttggaggggagggccagcctcccttcgccacacccccagggcccaccaacccccacacatcagccctcaccatgcattcactgatggaatgctaccttcaaagaaagcttccagcaacaaactcaggaaaatacatctcactttctcacaaacaaaaacatgcctaaaaccgcagcaaagcctgccttcaccgctactcctgtctgcaggtgacaaagggctgaagggctggacagtcccaggtcaacggcacccatgccccagctccttccacgctgacaggctcacgttgtttcacagagaagataaaagatgtgctccggaattaaaggtgcgtgtataccacagccctcggtgctgttttgaaaatgtgctgctcattgcagctttcagaatcagaagagccatctcagcctcgcaaccgagccaccgagccacgagcccagagcaaccttttcattctcattcactgcagtctcctcccaccacagatctttttctttcccagcgattatcatcgcgacagtcttatctcgctcgtccacgtccacaggtccaatgctggcaacaaagggctcactcatcccaaagaaaatggaaataaggaagtgcagggatcgggaggaagagctgtgtctggaaaagtaggcggccacaggcaagagcctgagttctgaagggtcccgggctccaccaggcggagcccagaaaactaacagccccagagaactggcaggaggcaccggagcctgcggcaggaaccggcacagctgcagggagacctgaagggccctcggcattgggcatggctgtccccagcagtcggcgtcctccgtgcttaggaggcgagggatgtctccacacatgcctgcactagccaagatgtgtgtcagagtcggcccggccatagctcacggtggacaccagtccccgtgatggaatttcatcggagggaaagaaacagggaggtgaggaatgagtggtggttgctaaggaaaggtccttcctgtggacacgaaccaatgaacacaggctcggctgcccagcggcctcctcatcaggtgagtggggcaggagggccccagagtaacgacctgaccagaggcctcgtctggggcaaagtccattatttctgatgtcacgattcgcaggaagtggcagggcctccaagtgtggtagaacaattcacttccaagtccaaagatcccttctgccctcccaaaaggacaaaaggactctccacacactagcttggcacagcaggcaccacaaggcctgggagcctccacctgcatctgtagacaccgccttcctgagctcccaggcagcagagtggccaccgtcccccccgcagccggagctccccaggactgcagccccgggccaccacctgcccagacgaccccactgcagctccagagaaggtgacgtggtccgtgcggggacaagtttgggacagagttccattaaccgttcttctgcaaggccctgtgtttcctaagggggctgaaaagctggttgtgatattttgacaaatggtgagagaataaaaatcatgtgacttctcaataaagaaggttaaatgttctcgaattcggcatttccagtgaaaatgaatcatgttttgccatactgatccacaaataaacttttctgagccccccaaggtttataaaaatgatgtgcacaggccagggtattcaattcagagtggctacagtgttgccagcaggaaaatgccaaaagaaagagaaagcagacatcagccggacgcggtggctcacacccgtaatcccagcactttgggaggccaaggtgggcggatttcttgagcctaggagttggagaccagcctgagcaatatagtgaaactccatctctactaaaaataccaaaaattagctgggcatggtgtcaggcgcctgtaatcccagctatgcaggagactaaaccaggagaattgcttgaaccttgggggtggaggttgcagtgagctaagattgtgccactgcactccagcctgggcgatagagcgagagaaggggaaggggaaggggaaggagaagggggacatcagcaggcatcccggggtggagcgctcaccctctccctccagggcaggctggcgcttctcccaccaccccgagggaagaggctgcggtctgtgtttctaacagcaaacaccgtcactgtcaacactgatgagtcctgcttaacacaaagacaggtgtgtcgacccaccctgaactttgcaaaatgatgcttattcccctctcaaacccacacagaggccaagtgcctgctctgaaggaggaactgaacagcaagccacgtctccagaatgccacggctcggcaagacttccctcacatcatcgcaagaaggttccagaataccacggctcggcaagacttccctcacatcatcgcgagaaggttccagaataccacggctcggcaaggtttccctcacatcatcgcgagaaggttccagaataccacggctcggcaaggtttccctcacatcatcgcgagaaggttccagaataccacggctcggcaagacttccctcacatcatcgtgagaaggttccagaataccacagctcggcaaggtttccctcacatcacggtgagaaggttccagaataccacggcttggcaagacttccctcacatcatcgcgagaaggttccagaataccacagcttggcaaggtttccctcacatcacggtgagaaggttccagaataccacggcttggcaagacttccctcacatcatcgtgagaaggggcggcagtgcccggtacagcgtggtacagtgagcgccacactcaaccatatgaacagcctacttgtatcgacagagagcagctgggaatgtagagtttggggaactggcaggcatccacccttgagaaactgaggctccatggtggaccaggaagggaggaagaaatggcaacgtgagcagaaaggccatcaggcacggcgggaaagccagagcaccctggccagacgcggccaggcttggcgtggagctgccagtactgaaccaacaggggctcccctgccgtggctgcagctgcctgcacactttctcaggcctgattattctagaatctgtagggtgttagctcacatttctttttccatcattgcagctaggaccttagacacatttaaagttcccatcaatccgatcatccatccttgtgctgccctgccctgggggatgccaggctggactcccatgaagaaaggctgaccatgctcccggagtcttggccccagcgctcatggtctgtggtttggggcaagctcgctcatttcttcatgcctcagtttccatatctgtaaaatggtgacaagtgaggcatgggcccagcatactgtaagtgcttaataaattataactattatcatgaaacaaggagaggatgagaaatcattttagttttccactcttttccccctttcccatccattctgaaaacaaatacttggttctccatgagaagctctcgccacagctcattgtgatcctcaggtgagaagtgaggaacacagtcagagagccccttagatgctcagtcacacaagctgacaggcaccttccaacttgctcaagatctaattcaagattatgcattttgaaactattttctgccaaaatattaaccaaaatgttaacctatatttaaaaaaatatgaacctctcattaaagtcaaagcccagtctccgtccatccctccacccactaacctacccattgattgcaccaacctgtattgggcatctattgtgatcaaagcctgggaacaaacattattctaagaaataataggctgggcttggtggctcacacctgtaatcccagcactttgggacgctgaggcatgcggatcacgaggtcaggagatcaagaccatcctgactaacatggtgaaaccccatctctactaaaaatacaaaaaattagccaggcgtggtggcgggcgcctgtagtcccagctactcaggagcctgaggcagaagaatggtgtgaacccaggaggcggagctagtagtgagctgagatcgcgccactgcactccagcctgggcgacagagcgagactctgcctcaaaaaaaaaaaaaaagaaagaaaaaagaaacaatagaaaattaaaagcttcattttcttgagggctacaacattgttctcacaccagcacagacacactaaaatgttttggaggccagagagacttgaccaatggatagaacaagcaaacagtttacagggaaaatacaccattaagatcctgtgaagagactgaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccttcaatgacaccccatctcacgccacgtgtctttccccttcaatgacaccccatctcatgccacgtgtctttccccctcaccgacaccccatctcacgccacgtatctttccccctcaatgacaccccatctcacgccacgtgtctttccccttcaatgacaccccatctcatgccacacgtctttccccctcaatgacaccccatctcacaccacgtgtctttccccctcactgacaccccatctcacgccacaggtctttccccctcactgacaccccatctcacgccacgtgtcattccccctcactgacaccccatctcacgccacgtgtctttccccctcaatgacaccccatctcacgccacgtgtctttccccctcaatgacaccccatctcatgccacgtgtctttccccctcactgacaccccatctcacgccacacgtctttccccctcactgacaccccatctcacgccacgtgtctttccccctcaatgacaccccacctcacgccacgtgttattccccctcactgacaccccatttcacgccacacgtctttccccctcaatgacaccccatctcacgccacgtgtctttccccttcaatgacaccccatctcacgccacgtgtctttccccctcactgacaccccatctcacgccacgtgtctttccccctcaatgacaccccatctcacgccaggtgtctttccccctcaatgacacaccatctcacgccacgtgtctttccccctcaatgacaccccatctcacgccacgtgtctttccccctcaatgacaccccatctcacgccacgtgtctttccccctcaatgacaccccatgtcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcactgacaccccatctcacgccacgtgtctttccccctcaatgacaccccatctcacgccacgtgtctttccccttcaatgacaccccatctcatgccacacgtctttccccctcaatgacaccccatctcacgccacgtgtctttccccctcactgacaccccatctcacgccacaggtctttccccctcactgacaccccatctcacgccacatgtctttccccctcactgacaccccatctcacgccacgtgtctttccccctcactgacaccccatctcacgccacgtgtctttccccctcaatgacaccccatctcacgccacatgcctttccccctcaatgacaccccatctcacgccacgtgtctttccccttcaatgacaccccatctcacgccacgtgtctttccccctcaatgacaccccatctcacgccacgtgtctttccccctcaatgacaccccatctcacgccacgtgtctttccccctcaaggacaccccatctcacgccacgtgtctttccccctcaatgacaccccatctcacgccacgtgtctttccccctcaatgacaccccatctcacgccacgtgtctttccccttcaatgacaccccatctcacgccacacatctttccccctcaatgacatcccatctcacgccacgtgtctttccctctcactgacaccccatctcatgccacgtgtcattccccctcactgacaccccatctcacgccacacgtctttccccctcaatgacaccccatctcacgccacgtgtctttccccctcagtgacaccccatctcacgccacacgtctttcctcctcaagtgcacgagtgtctgggctgacctgctctccaagctggcaccaattatagtacagggaacccaatttccaaccaaaagacctccaaacttttataaagcaatgtcatcaatgtgtaaatcactgcctatatttaacccctggaaattaacaactacattgacataaacttaaatctaaccagtgtcttttcagtataaactcttaaaacataaaatgtataagatgttaccttttctcaagaggtaaaaaaaaaaaaaaatccttatttttaatctctaacaaaggcaatccaattaactcactgatttttaaaaagataagcccggctgggcgcagtggctcatgcctgtaatcccagcactttggggtccgaggtgggtggatcacctgaggtcaggagttcgagaccagcctggccaacatggtggaaaccccatctctactaaaaatacaaaaatgacccaggcgtggtggcgcatgcctgtagtcccagctactcaggaggctaaggcaggagaattgcttgaacatgggagacggaggttgcggtgagctgagattgtgccattgcactccagcctgagtgacagagcaagagtccatctcaaaaaaaaaaaaaagataaacccaagtgatgtctcttgaaaaaacaaaaaaattactgtggaatttttgggatctaagttatgctgaacaaaaagtggcaagaatatattttaaatttaatataaaataaataaaacatatgaaaaataaaaatagaaagtaagcaacacaattctttgctgtttgttaagcctcattacagacacatcagatttaggtggcgtagtgtggcatcaagggcatgaatgataagaaaacagagtcatctgagggaagaggccgtggggcagaaggctgccgtgggtgttctgctgagctctgaagcttggccggcaacaatgctgttccctgcaggctcctgttgcctcaagcggggcagtgtgtgtgagacccaccttcatgcttcaggaacactggccaaggcagaaaaatagatggatgtattcatgagagatttttaaacaagttgaatccaggctgtttctgctaaaggctaacgtaaccagaacattcagctgacaagcatgttccatttctgagtacctgggctcaccaagggtgtaccccagtctccgccctccacatgcagggctgagatgtccaccctcagcagctcgaaaagtggcagctctgccgccctgacctggcactgacgcagcaggcggatgttcctgtgtcccctgcactgaccttcactgcaaagctaacccaggtgagtcccagtattcaccagctcctggagcccagaaacaagtgggcatttctagaaggtcaaggagcatctatatggaaagaccttttctccttaagatctcggtgtcatctcctgcccctctaattccacccttgtgaacataacccaggggggtcactgaggtgagatctgtcatgcagagggaagaatgtgggtgatcatggtgatctgcaaagctctcttctttcctggtctgtgagacgctgcgtatctgcagcaccgcgacccagcactcctctccctccgtgtcctgtgaactctcccatgatggttgcaccccagccactctggcctcctttctgttcttccaacccaacgtgctggtggaattatcctactggtttgcagcaaatgggccccacacaacaccgagaagctgggaaatattattctgtgcatcccaccctgcttacagcaatgtctgttcctctcagcacctcatgctgcctcctatgcgggaagccaggccctgtcactgtcctgcccctgcctgcccacactgcccgcctttccactcttgcccctgcctgcccaaaccgcccgcctttctgctcctacccctgcccacaccgcccgcctttctattcctgcctctccctgcccacaccgcccgcctttctgctcctgcctctccctgcccacaccacccaccttctattcctgcctctccctgcccacactgctcacctttctattcctgcctctccctgcccacaccgcccgcctttctgctcctgcctctccctgcccacaccgcccaccttctattcctgcctctccctgcccacaccgcccgcctttctgctcctgcctctccctgcccacaccgcccgcctttctattcctgcctctccctgcccacaccgcccgcctttctattcctgcctctccctgcccacaccacccgcctttctattcctgcctctccctgcccacaccgcccgcctttctgctcctcaccgcacgtcctactccaggcgatctgcaggcagcctcttactctgcctgtggtggggtggtggtggtgggtggtatgagccacgccctccccttcagggacagatgagagcttcaggaggtgaaatactcccccgccccctccttcttccctcttgtttcctttcccttctttcttccttctccccaatcttcctccctccctcccttgctagctgcattctttccttccttcctgccacaaatatttactgcacatctcctttgcaccagctacctttgaaggcgcagagataaatccatgagcaaagtccttgcttttgtgtgacttccatctatgttagaaggaacaggaaacaaataaaaaccatgaatgcggccgggcgcggtggctcacgcctgtaatcccagcactttgggaggccgaggcgggtggatcacaaggtcaggagatcaagaccatcctggctaacatggtgaaaccccgtctctactaaaaatacaaaaaaattagccgggcgtggtggcagacgcctgtagtcccagctactcaggaggctgaggcaggagaatggtgtgaacccgggaggcggagcttgcagtgagccgagatcacgccactgcactccagcctgggtgaaagagtgagactctgtctcaaaaaaaaaaaaaaaaaaccatgaatgcacagaatatgtggtggtgattgatgctgcgaagaaataacccagagtatgaaggatcgggggctggagcactgctctttcataccgcactgccagagaaagcctcattgagaaggtgaagtttcagcagaggcctgagggaggtgagcatgggcctagtggggcctgggaagctgtcttcaggcaggagtagcagtgagcactaaggccgtgggcagaagctgcctggcgtgttgggttggaagaacagacaggaggccaaagtgtccagaatgcagccccacgtggagagttcacagtgatatgggagtgctgggaaggggagagctggtccctttaaatgatatagaagtgtgaagggaagtgctgggttgaggaaggcaggtccctggctggggctccatctccacagacctaggtgaggacaggcactcctgccttcaccaccaaatgctgcatttcccaagaccaccctggcccctaccacactcccatcctgtgcctataaaaacccccaagaccctggcaggcacacacacaagtggctggatgtcaagaggagcacgttggcaaaagagcagaccaacagacaccagcatgccagcaggccaccgactggtgggacaagagcagaccgacagacaccagcacgccagcaggccaccaaccagtgggacaagagcagaccaacagacaccagcacgccagcaggccaccgactgatgggataagagcagactgacagacaccagcacgccagcaggccaccaaccagtgggacaagagcagaccgacagacaccagcatgccagcaggccaccgactggggggacaagagcagaccgacagacaccagcacgccagcaggccaccgactggggggacaagagcagaccgacagacaccagcataccatcgaccagcggaacgatgccgagtgtggccggggcagtctgaggagagcccaggccatcaagcattcggactccaggggaaaatcatctcccttctggctcccccatctgctgagagctacttctactcaaaacaaccttgcacttactctccaagcccacatatgatctgattcttccagtacactaaggcaagaacccagcattcagaaagccctctgtccttgtgataaggaaggggtctgattgagctgactaacacaagccacctatagacggcaaaattaaaggagcgaaaccaaaagagcaccctgtaacacatgcccactggggctttaggagctgtaaacattcacccctagacactgccatggggtctgagcccacagcccacccgtctgtcagctcccctagaggtttgagcagcggggcactgaagaagcgagccactcccccatcgcacgccctgtgaggggaataagggaacttttcccgtttcaacaggacacggagggagaggagtggtgggtgggggtgccacagatatgcagggtcttgcagaccaggcaaacagctttgatttttactgagtgtgatgagaagcccgtggtgtgctctgagcagtgggatatcatctgattgacaaatttacaagaaccactctgcaggcctgagacaaggtcagaggcaggaggccaggtctggtcagatctggttaggggtggtggtcggggggacagagagcagccggctggtggggaggagggggcaccctgggtgtgctcgctcggaaggcaggtacagcagggtctgccaacagactggacatggggggacagaaagaaaaggacctaaatggatagtggccccacagccatgctgtaggaaccatgggagggttcgttcaaggtgtggggtccgggctgggctgggaggccctcaggagcccggcaggcacccacactgccatgtttggtcttgtgccagtgcaggtgggatgagagtcctgctggtcacaggcagggaatgtcagggcagaaaccctaaaagattcactgccttccagaaaaggcagcgtaacgcagagacaggtgttctccggagtcagccaaaccgggctcaaactccaccccaccattcaccacagttgggactcggggaaacccatccagcctcttccagcctcatgagccctctgtgtgaaactgaatcaataactcccactcgaatgggttgctgagaaaatgaaatatagtaagtgtgttgtctactacctgctaatgctcagtatttgttgacaggaagttgtgtcccctcttctaacaccgctgtaacatttaacaactcagaaaaactctctcttatggctgctacgcatcccttttcctttgactccctttggttcgagtcttgttaaatggatgggagagcagaaatacaactgccctgaaataaaacttcatgttctttatggtaaagatcagagaacaggaggcattttcagtgggcctcttagaatcactataataggaaacatccaccttcaaaatggaataataaagtacaattccaaaaactacttcccctcatctgaaaaagaaactttttaggttatcattaatgaaaaataactttaaaaaaaatcataagtatataagagaaaattctaagttgctgggcagcttatgggagaacagttaatgcatactagggatcccctcccatgtaacctctacaaaccacacacacagcattttatgaacatgctgagttatctcagaagcatccactacctgccatttgaagatgaagagaaatgaggaagtatgttttgcagcatccagtgagccctggtgggttgaagaagggcggcagcacagagcacagataacaagaatatcaaagtaaaacgttgtgttccatcaactgcaccacgtaattctgcaatctggccagttcataatgacattttaagtagctttcagtgctccaactgggctctcataaggcaattacacaaaatgtcaggatattaaatgtgtaaagcctggagtaagagatcagctcacatgactctgcattctcaactgccacagccaggcctattgaaattatatgtcattgtagggccttccaaacaaaatggtacaagctttaaacaatcagcaacagcctgcagataacctcgccacaacattgttttcacaaagacaatgggaatcatgcacaacagcttttgctcctaagtgcctttacaaccatgtatatatgaaggtacacagttagccacatctgaacacccatcatcaccatcagtagcaccaccatcaccaacaccatcatcaccatcatcatcaccatcaccatcatcatcaccatcaccatcatcaccaatgccatcatcaccatcaccatcagcactatcatcaccatcaacaccatcatcatcattgccatcatcaccatcaccatcatcaccatcatcatcaccatcaccatcaacactatcatcaccatcatcaccaccgtcatcattgccatcatcaccatcaccagtgccatcatcaccatcaccatcagcactatcatcaccgtcaacaccatcatcaccatcaccatcatcaccatcatcaccatcaccatcatcatcaccatcaacactatcattaccatcatcaacaccatcatcatcaccaccatcatcaccatcacccaccatcatggggaatggactgtgctcctttggtttagaggacatacagcccatttaattgctggggtccaaaacttgggtatttgcagaggattcaggtaaattcagtaggagctcattatcgcattctctcctcatttgggcttccacagggagaaactgacataatcatatgccagcatgttgtctattttcactggaaacaacacaagtgtagtaaaatatattctgcttccaatatgagggggtaaggaatcacagctgagtagtgtgcatctctccctgactaatgaaaagtgcccatgctgcagcctgggatgaagcttctcctgcactgtcatgccgcaatattttgcactcacagggctcagcattcacccagtctgacactttctctattgaatgcaatactgaggcaaagaagaaaaaaatatatccaattagctctggcattaatgacatgacttcagtggggtgtggggattggcagtcaaatggctttctaaagactgcttcctttaggttcatgttagtgtgagtttgcacactcagaacgtgaactgacggacgacaggtaacgcagctcaccgtggactgggtggcaggtaagaccagaagagaaaatgttttacagatgtcagagggttgggacttcggagctgcccacattcgctaaatgagctaagccgacatctgcagaaacgccctcgtaatgggaacagttacctcgaaaagttctagaaatgccggtggagagggcaggtgaacacacagctgcagtcagacgctcggcatgatcagacccaaagcaaaccaactgctgcatagaacgccctggggcttcgagcccccagttccagcctgtgacgcactcacccgtgggaaggggaaaggctcccccagtgccttccctacacctgccctgtgccctcagagcggaagcatcaccatgtaatcagcggtctccattaaccaccagcgttcaggttggaactggggagatttggaaaagtgacaggaaggatgacatcatatgcagaggatgcttatacagcggagagcacccctgttccatgtggctctggaaggcctccccattgtgctaacacagcggacagcacccctgtaccatgtggctctggaaggcctccccattgtgctaacacagtggagagcacccctgttccatgtggctctgaaaggcctacccattgtgcttacacagcggacagcacccccgttccatgtagctctggaaggcctccccattgtgcttacacagcggacagcacgcctgttccatgtggctctggaaggcctccccattgtgctaacacagcagagagcacccctgttccatgtggctctggaaggcctcccccttggagccatggcagaaggtggtgggaggaaaacctcaggggttgggcagtgacagtgaggtgcctttaggtgccctgccaattcctagtcagacagaggcaaatttcaacccaattctcaaagtaaaaatctttccagcaaatgcagctggcttacagcagcatggacctggcaggaaagcagtgacctcagaggtgtttaagcagagtctgtaaggacatcagccaaacaccggggaagagatttctcacatgggggcagtttatgactcttacttctcccaaatctgaaagcagtgactctgcactagtgcagaagtcggggagcctcctccccctgggagaagacatgagctgggtggagccgagcagtgcaggtccgggactgccagccacacgcaggtccgaggctgccagccacacacggccgctgccaccccgcactgggcgcatccacgtcagggttgctgagcaggtgggtgtgtcctcaaggtgcagtgagacgaaccctgttcccgctatataagccacagagtgacccccccagcaccccgggtgccctctcctgcgcctgctcccctgggagagagtgcgctgctgctgactccacggtgtgctgacacacaggaagaaaggcctcaggcagtgcacactgagcccgggactgtttcgctaggatgaaaggcactttgataacataggtgccttctcctcctgctttagagggtgctcgtgaactccagccaggggcatggatccgagattaacaatttatcagtggcttcctcctggagcagcctgtgagaggcggcctctgtgtgccagtgattaggtggccaattctcttctaattttttttttttaagccaagaggcgtgcttgggtttagagcactgagcagcactgggatgcattcaaatatgaatgaatttcttcaaaaacgaaaaggcagcaggtgcttcctttcaagtgaaaatgaccccaaaagtgtgggcatattttctccaaagtgacagaagcattggtatcagttatttctgtgttataatctactgctgtcaccgtgaaaagtcaaagctttggttcagtgccctcctgagactgggctgcggggaacacgcccttctctgtgagggttttcaggctgggattcccaccaccaacacgacaaggaagtgggcaccccaccagccaacgcaggacctcagggtcacggaaggctcgaaggagaagaggaccagaacacgcttattttggatgaggggagagaactgggagcggagcccatgtgattggccaggacttcgcaagtgctttctgagtgaatgagtgaactcaggagaatcaggagcccgtgtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagggctttctgaatgaatgagtgaactcggaagaatcaggagcccgtgtgattggccgggacttcgcaagtgcttcctgaatgaatgagtgaacgcgggagaatcaggagcccgtgtgattggccgggacttcgcaagggctttctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaacgcgggagaatcaggagcccgtgtgattggccaggactttgcaagtgctttctgaatgaatgagtgaacttgggagaatcaggagcccgtgtgattggccgggactttgcaagtgctttctgaatgaatgagtgaacttgggaataaccacgcgaagcgttgcatggctggagagttgcacggccggcagcagaaacaagttcttccagcttccacatgagtttccgagtgcacttcccacatgaacaccacgggccccatcttaggacagaggctggctgggtggagacccgtgattaccttggccatacaagcgatagtataataagacacctgaatagaagaaatatcaggtatgttgggatgaggttgcaatgtgaaattcagaaccaaaagtcagtcgtcatgatgtgaattagggacttgtaattcccatccaggctctggagggcgcagaaccaagatgatgaaagaaagggttctaacaggttggttaccggttttgtttcccgttcagtgtggctggtgtttgatcaatgagcaaggattacaacagtggacaccccacacattatttgtcattggttcatttagaaaacggtgtctgatgcatctcctaaagtgatttccaaaacgctttcgctgtcatcagagtcttgagctgaaagtatggcattacacaagtaccgtatctatatgaaaaaaaactacagcactgatgaaagaaagcaaaagtaaagaaatggagaagcagcgtataaatattacatgctcatggctagcaggacatgggtttggatcataatctcaaaagatacagtcccaattgccataatcccaaatagtgaaatccccaaatatctgaatatcaaaatctctaaatagagtctaaatcccaaaagtctagtgttgctaatgtttaaaatcccctaaatcataaccacaggagagttgcatcctgctgggtggagctattagcttgttattgtctttatttggaaattaagcataacttaaggagttgtgtgtgagtgccaagttgacaaggggtgaaactgtagacttcgttttaagtgtcaacttgactgggttaaggaatacctagaaatccagtaaagcttcattttgggtgtttctgggaggtgtctccagggagattggggtggagtctgagagggctgggggaaggtctgcctcagtgttggtgggcgggcactgtccaaacagctggggcccagagagaacaaacacagagggtgaattaggctccctctgagtgctggggcagactttccttctgctgccctggacatcagagctccaggtttggcggcctttggactccaggactcacaccagccgtccctgggtcttcagactgagagttacatcatcagcttccctggttctcaatgcaaaaacactgcaacttcctcaataaatgaagaatgtcctttttgtacatctgcatttgcgaaagatacaatttcttgagatctcagctcttcgactgtttatgcagcagtgacccatcagggtttttgactcatcttgtcaaaagccttaggttgttcatcagggtatttcagatgcctgcagttatacagctgggtgcacacaattaccaagcagagggacatgcttttatacatctcccttcctgacctatgtcttcataaacacagttcatctgctcataagtgtgatgcccatgcaactgtcgtcaagatatctgagggcttatgtctgcaaaaatacgaatgttattattgcttattttattgtgtaaaatggcctatgaagtgttttgtcacgattttatatattttgcaaataaattcccttttaaaaatgtaaataaatgtcttttaaataattttttccagaattacatttttgggattttgatattttgagactgtgattttcaggattttagggaccttagggattttgatatttcaggatcttaacattcagaactatggcattcaggattgtgtctttcaggattatgactggctcccaaagactcaatattgtcagcatgtcagttctccaacttgatctatggatttaatgaaatcccagtcaaaatcccagcaagtcattttttggatacaagcaagtttattctaaagtttatatgtagaggcgagtgacccataacagccaacacaatactgaagaagaacaaaggcggaggacaacagcacccatcattaggatgcactacacccattgttacgactcactccaactccacaggaatccaggcagggtggggttgatgacacagacaaacagatcaatgaaacagaacagagagcccagacatgggtccacatacatgaggtcagccgagctttgaaaaggagcaaaggtgatgctatggagaaaggatcgcctcttaacaaatggtgctggacaactggatgtccacatgtacagaaacaattccagatgcagaccttacacctttcacaactaactcagaatgggtcacagacctcattataaaatgaaaaaccataaaactccttaaaggtaagagaggagaaactctggatgaccttgggtttggtgatgactttttaaaatccaacaccaaaggcaaaatccatgaataaaataattggtaagctggacttcattaaaataaaaactaatgctctgcaaaagacgctgtcaagagaatgaaaatacaagccacagactggagaaaatgtttacaaaagacatatctgatatctgataaaggaccaatatctaaaatattcaagaactttacaaactcaacaataagaaaacaaacagcctaattaaaacatggcccagagaccaccacagacacctcaccacagaagatacacagatgaaaacaagcatgtgaagatgctctgcttcctccatcatcagggaaatgtgaatgaaaatgacaacgagacaccaccacacacctctcagaagggccggaacccagaacattgacaacacccaatgcaggcgaggatgtggagcaacagcagctcattcaccactggtggcacgcagaatgcagaatgccacagccactggggaagacagtttggtggctgcttccaaaaccaaacattctcttactatgtgatccagtgattacactccttggtacttaaccagtagaagttaaagacttatatccacacaaaaacctgcatgagggtgcttatggcagctttatgaataattgccaatacatggaagcaaccaagatgttcctcagtaggcgaataaactgtggcccatctatacaatggagtgttatggattataatgtaataatacaatactattcagcactaaagagaaatgagccatcgagccatgaaaagatgggggaatcttcaaggcatgtgacccatctgaaaaggccacatattgtaaggttccaactccaggacattcaggaaaaggcaaactatggagacagcaacaaggtccatggttgccaggtctcgagtggggaaactggagacgctgaactagatgagccccaaattccttcaccggccactgcacgtcacctgttgtcctccccgtcaccccaccttagataggccttccactgaacctgctttaaagctctttgaaaggagaccagatgtgaattatgaataagtgaaggaagagagtctctttttaaagcttttaccaggtaaacttttgtcatatgcgttcagcccgcagcctcgttgactgactgcttctttgggagcaggtacgcgtgggtcttctctcccactctctgaagactaaacagcaagggtctcatgttggacccgaccgtgcgacaggagggtggccctgttctctgacctgtaaagaagttttctgttccctggcattatcacagggtcctcccttcctgctcgggtgcagttgctctttgtgtgttgagaatgtctgtctagctagggcctcacatcttcagaaatcattcgatgtctggatttgctttagaatcatcccagggcagagcagggggctgtagtgggcgcagaggagcatcaggaaagcctgagagtcaccacttgtgggagacaggtgatgcctgtacggggttctcaatattctctgtatatttcataggtgatgcctataccaggttctcaattctctctatttcttaggtgacgcctgtacggggttctcaatattctctgtgtgtttcataggtgatacctgcacggggttctcaattctctctatttcataggtgacgcctgtacggggttctcaatattctctgcgtgtttcataggtgatgcctgcacggggttctcaatattctctgcgtgtttcataggtgacgcctgtaccgggttctcaatattctctgcgtgttttgtaggtgatacctgtacggggttctcaattctctcttcttatttcataggtgatcaatattctctgtgtatttcataggtgacgcctgtacggggttctcaatattctctgtatatttcataggtggcgcctgtacggggttctcaatattctctgtatatttcttaggtgacgcccgtatgaagttctcaattctctctgcttatttcataggtgatcaatattctctgtgtatttcataggtgatgcctgtaccgggttctcaattctatttcataggtgacgcctgtacggggttctcaattctatttcataggtgacgcctgtacggggttctcaatattctctgtatatttcgtaggtgacgcctgtacggggttctcaattctctctgcatatttcataggtgatcagtattctctgtgtatttcataggtgatacctgcatggggttctcaattctctctgcgtatttcctatttgccgttttacatgaggcttttctaaagcgcacagtgcagtttggaagtcagtttttatcagaatatcaccagcatcgcagggtagctcaggaagaatgccaagcacattgtgtaactcgtagggatcacgggagagtggagagagcacggtcaggacgcttgttccgaagatccacaccctggggtgtgggaggaacgagaaggcgccaaggcagggaggtgaagctccccggtgcataagaaaggcacacagaacaggagcgcgcaggaagggctcgcagagcaggagcgcacgcgtaggaagagcacgcagagcaagagcgcgtgcgtaggaagggcacgcagagcaggagcgcgtgcgtaagaagggcacgcagagcaggagtggcgcgtaagaagggcacgcagagcaggagggtgcgtaggaaggacacgcagagcaggagcgcgcgcgtaggaagggctcgcagagcaggagggtgcgtaggaaggacacgcagagcaggagcgcgcgcgtaggaagggctcgcagagcgggagcgcgcgcgtagggagggctcagagcgggagcgcgcacgtagggaaggcgcgcacgtagggaaggcacgcagagcaggaatgcgtcctattctctctgtgagctcaccctcacccggctctccagctgggtttccctccctctgatgggggcgacgatgtttattgctttctgttcccaataatgaggacagaggtgaatggggctttttaagctgtgggagatgggataggagagagaaaagggaggttagagaaggaagaggacgacccaaagtgaccccactagaaggagtatagaggtgggagaatgcaggtagaggggcagccggtgccggggaggggcaaggaaggctgagatgagaagctgaaggtcacctcagccatgtattcaccgcctgtggccaagggctgaggccacactgagctggaggagaacaggaagctcggcagctacacggacccaaggtcgcaagtgaagaccccctgatagcgtccaggacctacgagagtgcaggaggcagtgaagacccccgatggtgtctagtacccacaagaggcagtgaagacccctgatagcattcagtacccacgaaagcgcaggaggcagtgaagacccctgatggtgtctagtacacaaagagtgcaggaggcagtgaagacccccgatggtgtctagtacccacgaaagtgcaggaggcagtgaagaccctgatggtgtctagtacccacgcaagtgcaggaggcaggaccatcaaggaaaggggtttctcggagtagagcatggcttagaacagaggagacgtcgtcccagagggagaggtgctggagggaaagtggccactccaggcgggcagctcccgtagcaaacagcaccatcaatgctccagcagcactcactcaagtgcagcatcggcctcctccgccgtccttctcctccaagagaggaacaaggagaaagcatcggtaatggtcacacgtccttccctctaattgcaatttcacattccttctatttaaaaactgccataacggctgcatgaacaaagaaagagcgagggcaggagagctcccggctgcagacagcagagaagctgatgctcgctctcagcggctcccattcagccttcacttaaggagcagagagtgctcacataacgcgatgctcaggcaatgtttgtgaaattttagtatttgttatctccaaaagggaagtcatgttttatcagaacccactgcaggatggtcttgggaaaaggctgttgggaaataaatgggtcggaaccttctccatatcacaaagagtcgcaggaacccgcaaacgcctttctcccctgggcccgccctgacgtggcttaactcaggtagcgacaccggaagccacggtcttggcagagcagtcacctcgaggccgacactgttcagctagtgcatggtgagcagcatgaaatccagacagggggcttcggaggatgtggcaaaccgccataaatatgggctacggtcacatgctgggccacagggagaggtgagttcagcgacaaaggacactggacttaacgtgttcagagtcaattttccaaaacagatatggatgacacaagctgtgggccagacccgtcctgcaagccatgttgcccgccccatccatcagcttcagcagtagaattgtgaaatcataaaatctggggaagggatgaacaagaagtgagaagggaacacacactgtcctcacaccctcaggatcatctcctcctccccctggctgccgcgttccctgtcctcacaccctcaggatcatctcctcctcccccccggccgccgcgttccctgtcctcacaccctcaggatcatctcctcctcccactggccgccgcgttccctgtcctcacaccctcaggatcatctcctcctccccccgggtgccgcgttccctgtcctcacaccctcaggatcacctcccctcccactggccactgtgttcactgtcctcacaccctcaggatcatctcctcctccccccggccgccgcgttccctgtcctcacaccctcaggatcatctcctcctccccctggccgccgcgttccctgtcctcacaccctcaggatcacctcccctcccactggccgctgtgttcactgtcctcacaccctcagcagcgccttctccatcccactgtcaggatcacctcccgcctctcactggccactgcgttcccaggacgtgaaatgaccacatactccttcccagcacagagagggtatgagggccgaagggacccttccctacatggtgccccattcctgccacgcgtcctcgggggagtgcggtgtgcagaccccacgtgtgggaagagcatggtgcgtctgtcactgggaggggctggacagaggacagtcagcaaacaagaaacaccaagcggggctggctcaccatcgcctgtgctggaggggtcttcggaatctcccagaggtgaaggccacttctggggggcggctggtgccagcaaaggcctgggcattcttgagggtgcacgcagaaggtactgtggctccaggctgccctccccggggggagctgggggcctctgggcagcataggcactgagggccgccatcagatggtgtctgtccacaccactgtccaccttagggctgagctcatctggctggagctggccgagggtccgcggcaggaggtcctcgcggagctgggtccgggacccgggagggtaggtcagcgcagacgtgtgggccacataggtcaggatgctctcggagaagcggtcatcaccctgaaggaaaggagagcaaaacagagcaagagtcacatttccatcgtcagctgggggcaccaagatgcccttcagtctcagttttcaaggtcctaaacagccctgggggtacaaagatgcccttcggtctcaggttcaaggtcctaaacagccctggacatctctgaaatgtaaagccaaaacaggactctcattttcacactgaccaacccaggtccctatttcatatttgttcctgcattatttttaatatcagctttatggagataattcacccacatcagcagtttttagtgtattcagagttgtgagacatcactactaagtccagaacatccgcatcacccaaaaagagactttgcagtgttcccattcctccctcccaccctgacactgctcattcgctttcagtctctatggaggagtctcttctggacgtttggtgtaaatggaatcacaccatgtgtggcatctgtgcctggctcatttccctaagcataatgtcctcaggtgcacccatgctgatgctggggcatgggccaggacatccttcctctttcagccaagtactatcccactgcatgtatatcccacattttaaaaattcacctatcagttgatggacatttgcttttttctaccttttggctattttgaataatgctgctatgagtattcatttatgagtctgtgtatcaatgtgttttcaattctcttgggtttattcgaggatattacatggtaactcgacatttaactgactgaggaactcccaagctgttttccagcacagcagcaccacaaacaatctcaccagtaatggatgcagatgccagttcctctgcatctttgccaacacttgctactttccttctgtttttactatggttgtcctagcagttggaaagcaataccgtgctgtgtcacttgcataatgcactgagcctagtatgtcctgcacctggagcctccaactcagctttaactaaaggtcctttgcacggcagctcggagttactgcattcacagcaatgagaggagctgctcccagacacattcatgaggctcggcggtgcctccctggtggctaatgatgctgcatctttgtgtgcccttattgaccactcctacatcttctctgaagaaatgtctgtttgtattttttgcctgcactggtttttattttaaccctgaaaagctgctccccaatagctgaatctctctttcagcaaccctcagcagaggcctcaagtgccttgtctggaggtcttcactccaacttctttactgaagacctgaaacatgtttgctgcctgctcttttaactgcagtgtgctgcagcagggaagatgccagggtctcttgttcgataattacctatcacatcatttactagtcaatgccctggctaacagtctttcatgggatttctgtctatattttctcctcactcatttagtaaaattccgttaagaggacatgtcctcatcacactttgtgtcactagataaaccaaggcccagctgtcctcacctctagggcagctgtaaaaatgtgaaaagtccccacattgtacctctgacttgggcttcatcaaaatgtcatggacaggctgagtatgaataatttccagcttagagactttcgaatcctggacacacaagctgagctccctggaggcgtgcatgggtgtgtggacaccccagtttaaatcccatccgttcatattttctacttgcacctccttggggcacatgatcaatgtcatgtcagtggaggtggacacctcggcactagctaagggtgtgcagccatcactgacagtaaggtaagggggtccagctcctgagtctggctatttccgaaaatatttgggttcatcctctgagttagatttttgagtagcaacctgggagttgggaagtgggttgatagaggttggggttgtttggtttttctgggtttttttgagacagagtctccctctttcatccaggctggagtgaagtggcacaatctcagctcactacaacctctgcctccttggttcatgcagttcttatgtctctgcctcccaagtagctgggaccacaggaacacaccaccatacctggctgcttttgtgagtgtgtgtgtgtgtgtgtgtgtgtgtgtgtgtgtgtgtgttttagtagaaatggggttttactatgttggccaggctggtctcaaactcctggcctcaagtgatccgcctgcctcagcctcccaaagtgctgggattacaggcgtgagccaccgcgcctggccaggttgaattaggttctgatttcagttctcatatatgaacttgggtaaattacttgacccctaaagactcaattttcttctgtcaaaaaaggaaatcggacattatctctaagatttttttttttcttttgagacggagtctctcactgtcgcccaggctggagtgcagtggcacatctcggctcactgcaacctccacctctggggttcaagcgactctcctgcttcagcctcctgagtaactgggattacaggtgcccttcaccacgccctgctaatttttgtgtttttagtagagatggggtttcgccatgttggccaggctggtctcgaactcctgacctcaagtgatgggcctgccttagcctcccaaagtgctgggattacagtcatgagccactgtgcccagccattatctctaagatattttaattattatttctaaagtgatgtgactatagctatcatccaaattgcttaaatttgtccaaggactagctgaaatcaactattcttcccttaagaaagagaatatgtgagagagcaagagcgtgagaaagagcgagagcgagcgagcgagagacagtgaatgccaccacaacaaacagcccctctagcaatttcccacaaattgggtgtaagtgtcaatctccagctcagcctgcactccctcttgcaaaggctgtctctgaacacctggtcagccaccgtgctggggggtggggatctgcgtccaaatccctcgttatgtgcctgcaagtggctttcccctcattgctatgaatgcagtaacctggagcttccacgcaaagggcctttaattaaagttgagttggaagctccaggtgcaggactgactaggttcagtgcattacacaatcacagcagagtgtgatctgtgcagtagacttggataaacaatctatttttggtttatgttctgaatcaaattaaggtgaagaggaaaaagaatatttcagtagttagcacaaacaacagagcctgtagaaataatagcaaacatcggtttttgcaagccactccggctactcaatagatgattgcagacactggggtgtttctcaccaaggtgaggtgaccatcccataaccaagagggcctgagagttgggaacatgggcagtaaagaaaagtattctcacgctgactggctctttcacggtttgaggtccccaaggaaaaggaactggctctggagctgcctgggtttaaactaccaccaatgctacgagcttaatgacctttgcttcagcacactatttaagtaatctgtaaaacaaggataataataatagtatctggcacggaagtgttaatggctatgactactactattattacaattatttactttaccttatccttcatatatatacatacatatatatatacacatacatatatatatacacatacatatatatacacatatatatacacatacatatatatacacatatatacacattatatacacatatatatacacacatatatatatacacatatatatacacacatatatacacatatatacacacatatatatacacatatatatacacacatatatacacatatatacacacatacatatatatacactatatatacacacatatatacacacatatatatacacatatatacacacatatatatacacacatatatacacacatatatatacacacatatatatacacacatatatatatatatatatatatatatatatatatatatatacacacacacatttttttaagacatagtctcgctctgtaacccatgctggagtgcaatggcgtgatcttggctcactgcaacctccacctcctgggttcaagtgattctcctgcctcagcctcctgagcagctgggattacaggcacgcgccaccaggcccagctaacttttctgcatttttagtagagatggggtttcaccatgttggtcaggctggtctcaaactcctgacctcaagtgatctgcccgccttggcctcccaaagtgctgggattacaagcgtgagccaccatgcccagcctataccttcatattctttaaagcagtcaggaaatccacatctcaactgaggagaaactatccaattagactttttcttctactctcagctctgagtttaaaattctgtgactcattttcaaaccccctgttgtgaagatgttttcagtctcagttcaacataccaatgaagggaggtttcctaagacaatgtggaataatttttaagaccgtagctgcccaaacctggaaattagcagcctaacggcatagacacagactaatttccagtacaggcgatggacattcctgtgcatgaagtcttcaaactatgtgtaagagaaatccggctgagcatctctggggtagcccagctgtggatatgaagcattcgagagcttctgccaaagtctgatgatgtttaagctgacatgatattctactgggaatattcttcaacccactgcatttccatatgacgagaagcagaacccactcgcccacacactgaaaaagccagcaggaaagaaggctcactgaaagactggcccaatcctgtcagttctgtgtaacttgtgtaagtttggaccagttatctaacctcttgaagtctcattttcaccacctgcaaaactagaaaaataattctgttttctttaaaagccactgtgaggattagggagagtataggtaaaagtgccttgctcagcacacaactcagaggaggaacttgataaatggcagtcatcagcagtatcattatcaccattagtgtcactgccaccatccacaacagcatccccaccatcatcttcaccatccacagcaccatccctaccatcatcaccctcaccatcagcatcatcccaccatcaatagcagcatccccaccatcatcacttccaccatcaacaacagcatctccactatctccaccatccacaacagcatctccactatctccaccatcaacaacagcatctccactatctccaacagcatccccaccatcaccatcccaccatccacagcagcatcccaccatcatcatcttcaccatcatcatcttcaccatccacagcaggatccccaccatcatcttcaccatccacagcaggatccccaccatcatcttcaccattcacagcagcatcccaccatcatcatcttcaccatcagcatcatcccaccatccacagcagcatccccaccatcatcaacttcaccatccacagcaccatccataccatcatcaccttcaccatcagcatcatcccaccatcaatagcagcatccccaccatcatcacttccaccatcaacagcagcatccccaccatcatcatcaccccatcatcgacagcagcatcccaccaatatcatcttcaccatccatagcaggatccccaccatcatcaccccaatcatcaacaacagcatctccactatctccaccatcaataatagcatcccatcaccaccaacaccaccagcgtccccaccatcatcatcaccccatcatcaacagcagcatccacaccatcatcaccctcaccatcagcatcatcccaccatcaatagcagcatccccaccatcatcacttcctattgggggaaccagcccccaatatttcaacacaggttcttttctattttccctaagtgttggccagtctgagaaataaagagaaagagtacaaagaggtaaattttacagctgggccttcaggggtaacatcacatattggcaggttctgtgatgcccacctgagccacaaaaccagcaagtttttattagggatttcaaaaggggaggggtgtacaaatagggagtaggtcacagggatcacatgcttcagagggcaataaaagatcacaaggcagggggtgaaattagaattactgatgagtgtcccactgggcatgcattgtcttgataaacatcttaacaggaaacagggttcgagagcagacaactggtctgactagaattcaccaggctggaatttcccaatcctggtaagcctgagggcactgcaggagaccagggagaatttcatctcttatcttcaactgcataagacagacactcccagaacggccattcatagacctacccctgggaatgcattccttccccaggattattccttgctgggaaaagaattcagcaatatttctcctacttgctttctgcaagaagaaaaataaggctctattctgcccgaccccgcaggcagtcagaccttaatgttatcttcccttgttccctgaagatcgctgttgttctgttccttttcagggtgccctgatttcatattgttcaaacacatgttttacagtttgtaccattaatgcaatcatcacaggatcccgaggtgacatacatcctcagcttatgaagatgatgggattaagagattaaagacaggcataggaaattataagagtattgagtggggaaatgataaatgtccatgaaatcttcacaatttatgttcagagactgcagtaaaaacaggcataagaaattatgaaagtactaattttgggaactgataaatgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatcatcatcttcaccatccacagcagcatccccaccattatcacttccaccatcaacatgatccctgccatcatcacctcaaccatcagcttcccaccatcatcatcatcagcagcagcagcaccatcatcatccacaccatccacagcagcatccacaccatcagtgtcacccccgccatcagcatcatcaaacccctactgctgctgtgtgccaagccctggacttctatgaaggaagaataactcagatgtggccctgtcctcaaacatcttgcagactgaactaggagttgagtcatagacattaacaaccgtaattgaaagaatgctattagaaagggtcagaaaagcaatcctggttttggaagaatgtgattctcttcagctggaggaaatcagagctgcttcctggagccagctgatgcagttcacagagccacgccctgcaccatacccctcacctgtcaaacagtgacactgctgaggaagtgactctcctcgctcccaactttactggggccgggagtaccagagctaaaaatcaggcctcttcctttgacaaacatgcctctcctggagatccacccagcccagtcccaaaggcacaattatgagttcaggctgacaggaaggcctggaggtccggggagtcccacatgccgggagactctgggtggaggagactcctgtgtgtgcactggtctctgcccatgctcatcagctattctcctgcaccgaggatccaaaacaaattaggaagcccaagttgggacatcttttgaccacataacacacgttttctccctgtctcactgcccgccggcagcactgacaggcaccttgatcacggcgtgcttgctgccagcctgacaaagcacacagcctcagtgctattcacaggcttcctaatgagccggcaccggatgcggccaggtttgggagctgaggtgggaacgctgcagctccggctccggctcgtgaatgtggggttgggatgacttcactgtgcctttctgtctcgggccttagagaggtgattctggcagctcatttattttctctgtctctctctgtgtctctgtctctctgtgtatctctgcctctgtctctgtcttaacacagtagaaagtgtcagtgtttaacagtgctcaggctctaagtggcccactcgtgtggaggggaaataattgtggtgtcattcttaccaacagtgctgtcgccaagacaaaataacttttttgcattcagggaagcaggggggtctcacacgagcgtatacggtgctatctctgcagccaaggtatagagctctcagactgaaaaataagaccccaaacagttttcagagttcacaaaatctatgaggttgaagaggttaagtcctaaactacttgggatcaacaaatttgtagcgagttgacagtatcacggggtgccaatgtgaactcctggatatctgctaatgatgatgcattctgagagtctggaattatctgaagactcgtgacaccatgaggccagtgctgctctcagtctgccctgctcaagactcgcgacaccgtgaggccagtgctgatctcaccccgccctgctgagactcacgacatcgtgaggccagtgctgctctcagcccgccctgctccgagactcgcaatgccgtgaggccagcactgctctcagcccaccctactttgcccgccactcttccttctgtcactcttctggctcctgtttgcgttttggcctttccagaagctgcacccaaaagcctcctacctggcaagtgaaaagcacagggcatgattaaagcagcgagttccaatccatgtcccgtccaccttggcctggggttagaggtcagttggctcataaccacccagaagatggagggacagtcatcgccacggggctcttattcactgagtgctacaccaggctgttttcggctttacatgccttaattttctctaaccctttcaatgactcgatggtacagacatgattacccacattttgcaaatgaggaaagaagatcctgcagtgaggaaagggcagagctaagatgcagcccttctccctaggctgtgtatgtctgtcgagtgacagacaccaaacacgccgagtgaacagaggaaccgtaagcaggtcggcttccatggagcacaggtctgggtgtggagggactgctagtgcagggtgggtggtagctgtcactgtgagtgttcagtggagggcagggacaggactgtctgggaggaaaccaggggagacagtcaggatgacggtggccagcatgcatcaacctgctctgcctcagatgctactgtgtatgctgggagcagaacaccatgccctggggccaattttccaccagagctccgcttcccaccaaaggtcataagaacaatcacatgagggggcaaacttttaaaaaactcaaatggacatcgtgaatgtggcatccaacatgtggaggccacggtcctcatcgctgtgtgcctccacacctgctcctccaggtggcatggctaagcagagggctgtgagggaagctgtgctatctctgcacaatctctctaggtggccctcctccagaaacagggataggggaaggtgggcttgttgaccacatctgggtggtgacagtttggggctgttctggatagagccactgtgggcagtcatgggccagctttcctgtgaatgcaggcgtccctcctcttggatagacatccagaggggaactgctgagtccaaggacagacgtatctttagcctttaagcagcttccaaatacaggttataacagcttgcattgcattccccctaatttgagaatttctatgtcctcatcaagagttggttttatggatttttttttaattttagccaatctagtgacatgaagtggttgttctttatggttttgtgaataaggatgctaagcacctttgatgccttcattggccatttgtatatctttttatgaagtatccgttcaaagtttttatacatttttgcatgggattgcttgcctcttttccctttggagcactactgagatataattgacatacaataaacagtacaggaggcatgacaatgaacacgtccgtcaccctgaatacattccggtgcccctggagacactgccctctcccatccctgtccacagctccaggcaatcccgaccagctttctgtcccttataacccagtttgcattttctacagctttccaaactggaattataacaatagctcctcttttgtcttttggtcaacagaaatgagactcactgtgctgtttcatgcatcaacagctcactccagtttattactgagtagcattccattttgtggatcaaacaaaatttctttgtccatttctgatagacatttgggttttttcagttgtgggcatttactatgaaagctaccatgaagatacgtgtgtaaatctttgaatgcacacatgctttcgtttgtcttgagtagaagtgggatggagggatcacaggcaagtaaacatttcacttttgaagaaactgtcaagacgttttccaaatcgttgttaatgttttacatttccactggtggcatatgagaggtccagctcctccacctccttgccaatacataggatggtcagtttgtattttgtttttttaaattttagccattcttataggtttgtagtggtatttcactgtgatttcaattttcatttccataatgaggaatgatactgaatatttcacattaaattgtcactcatttatcctctttggtgaagtgtttattcaaatcttttgcccattttttaaatttcaaaagcttttggggtacgcatggtttgggtcacatgtatgaatttaatagtggtgaagtctcagatattaatgcacccatcatccaagtaatgcacattgtacccaatatgtaggtttttttatccctctcccctctcaccctcccgcttctgagtctccaaagtccattagatcactctgtctgcctttgcatacccatagcttggctcccacttataagtcagaacataaggtaatcgattttcctttcctgagttacttcacttagaataatggcttccagctccatctaagtggctgcaagagacattattacattctttttcgtggctgagtagtattccatggtgtatatatatactacattttctttctttttttttttttttttttttttttttaagatggagtcttgctctgttgccaggctggagtgcagtggcacaatctcagctcactgcaacctccaactcccaagttcaagtgattctcctccttcagcctcccaagtagctgggactacaggcacccgccaccacgcctggctaattttttgtatttttagtagagacgaggtttcatcatgttggccaggatggtctcaatctcttgaggtcatgatccacctgcctcggccgcccaaagtgctatgattataggcgtgagccactgcacctttagccactcatcagtcaatgggcacttagactggttccatatctttgcaattgtgaattgtgctgcaataaacatatatctacaggtgcctttttgatatattgatttcttttcctttggatactcagtagtgagattgctggatcaaaagggtagatcaacttttagttctttatgaaatctccattctgttttccatagatgttgtactaatttacattcccacctgcagtggataagtgttcccttttcaccacagtcataccaacatctattgttttgtgactttttaataatagtcattcttgcaggagtatggtggtatctcattgtggttttaatttgcatttccttgatgattagtgatgttgagcatttttttcatatgttgttgcccatttgaatatcttcttttaagaaatgtctgttcacgtcatttgtccactttttaatgggatttttttttcttgctaaattgtttgagttccttgtagattctggatgttggtcctttgtcagatgcatagtttgcaaatattttctcccattctgtgggttttctgataatttcttttgctatatgaagcttttcagtttaattaggtccaatttatttttgttttagttgcatttgcttttggggtcttacccatgaactctttgccaaggccaatgtccagaagattttttcctacttaatcttctagaagttttatggtttcaggtcttagatttaagttgttgatccatcttgagttgatttttgtataaggtaagagataatgaggtaggaggcaggactcaacttcagaggccgggctgggttactgaaccaaattgaggactagttaaaacagggccaaggtggaagcaggtttccataagtctcacccaccaatatgccatgtcagtttacacttgccatgacaacaccaaggagtaactgcccctttccatggcaatgacctgatgacccaaaagttactaccccttccctagatatttctgcataaaccactcttaaccctcatgtaattaaaagtagctataaatatgactgcaaagcttccctgagctgctactctctgcctatggggtagcctggctctgcaggagcagtcacagagctaaaacactgccagagttgtaacactgccttttcaataaggttgctttcttttatctccagcttgcccttgaattctttcctgggcaaagccaagaaccctggtgggctaagccccactttggggctccttaccctgcatcaatagagatccagtttcattcttctacatgtggctatccagttttaccaaaaccatttatcaaacaggtgtcctttccccagtttatggttttctatgctttttcaaagatcagttggttgtaagtgtttgggtttatttctgggttctttattctgttccattggtctatgtgcctactcttctaccagtaccatgctgttttggtaactctagccttgtagtatagtttggagtcaggtaatgtgatgcctccagatctgttctttttgtttaggattgcttttgctatttgggctattttttggtgctatatgaaaataatgttggtattttgataggaatttcattaaatctgtagattgctttgggcagtgtgggcattttcatgaaattcttccaatccataagcatgggatgtgtttccatttgtttgtgtcatctacagtgtatttcagcagtgtcttgtagttctctgtatagagatctttcacctccttggttaagtatattgataggtattttatttattttctgaagccctcgtacaggggattgagttcttgatttgattctcagcttggtcattgttggtatatagcactgctactgatttgtgtacattgattttgtaacctgagactttcctgaattcgtttatgaaatctaggagtcttttggaggagtctttagggttttgtaggtatatcatatcattggcaaacagcaatagtttgacttcctcttttccattttggatgccctttatttccttctgttttctgactgctctggctaggacttccagtactatgttgaatagaagtggtgagagtgggcatccttgtcttctttcagttcgcaggggggatgctttcaacttttccccattccatataatgttggttgtgggtttatcatatatggcttttattattttgaggtaagtcccttctgtgccgagtttgttgagagtttttatcatgaagtgatgctgggttttattgaatgcttttcctgcatctattgagataatcgtatggtgtttgtttttaactgtttatgtgacgtatcacatttactgacttgcatgtgttaaaccatccctgcatccctgggatgaaacccacttgatcatggtttattatctttttgatgtgctgttgggttcagtcagctagtatttcgtagagggtttttgcctctatgttcatcagggatattggtctatagtttgcttttgttcattattttatccctgattttagtgtcagagtgatactggcttcatagaattagttagggaggattctctctgccctgatcctttggaatagtttcagtagaattggtaccaattctttgagtgtctggtataattcagctgtgaatccatctggtcctgggctttttttgttatgggcaatttttaagttactgattcaatctcactgcttgttattagtctgttcagggtttttattccttcctaatttaatctaggagggttgtatgcttgcaggaatatattcgtgtattcatttcttctagattttctagtttgtatgcatagaagtgttcataatagtcgtgaataatcttttgtatttctgtggtatagttgagcttattttaatcttcactcttcatttcttgattaatctagctaatggtccatcaattttgtttatattttcaaaaaaccaattttttgtttcatcttttgtatttgtttctttccttcaaattgatttagctctgttctgatctttgttattttcttcttccagctttgggtttagtttgttcatatttctctagttacttgatgtgtgacattaggttgtcactttgggctctttcagactttctgatataggcatttagcacagtgaactttcctcttagcattgcttttgccatatcccagaggttttgataacttgtgtcactattatcattcatttcaaagaatttgtaaacttccatcttgattttactgttaacccaaaaatcattgaggagcatatttttttatttccatgtatttgtgtagtttaaaaaattccttttggagtggatttctagttttattccactgtggtctgagaagatacttgatataattttaattttaaaaaatttattgagacttgttttgtagcctagtatacagtctttttttgtttcattactttttcttctaaaaagacgggatacacgtgcagaacatgcaggtttgttacctatgtatatgtgtgccatggtggtttgctgcacctattgacttgtcctctaatttccctccactctccccccaaccctcagcaggccctggtgtgtgttgttcccctccttgtgtccatgtgttctcactgttcaactaccacttatatgtgagaacatgcagtgtttgattttctgttcctgtgttagtttgttgaggatgatggcttctagcttcatccatgtccctccaagggacatgatctcattcctttttatggctgcatagtattccatggtgtatatgtaccacattttcttcatctactctattttggagaatgttccatgtgctcatgaggagaatgtatattctgcagttcttgattagaatgttatgtaaatatctgttagatccatttgttctagagtgtagactaagtccattgtttccttgttgactttctgtctcaatgatctgtcctgtactgtcagtgaagtattgaggtcccccagtgttggcatgttgctgcctatctcacttctcacatctagcagtaattattttatgaatctgagagctccagcatttggtgcatataaatttagaattgtaatatcttcttgttggattggcccttttatcatcatttaatgaccttctttgtctctttttactgttgttgctttaaagtctgttttatctgatattagaatgctcctgctcacttttggtttccatttgcatggaatatattttactacccctttaccttaactttatatgcatctttatgtgttaggtgactatgttgagatagcagatatttggtttgtgtctttttatccattctaccaatctgttatcttttaaatggaggatttaggccatttacattcaacactaatattgagatgtgagatattgtcccaatcatcatggagacaggaagtgtggctttcagaccacatctatcccagtccagcagcaaagccaggctcccagatcctgtgtttgtggctgcagcgtgcttcccactcccccctgggttatggccaagggagtttgtccccactcaagattagattgcaaatttcagttgggagcttctctcaacccgtggccactgactgagttggttggcagacttccgcaaggtcccctgtgaggcagaatggcttccccaatccatgctggagactgggaatgcacacagggctctttctactgcttctcctactttatattctccactgctccctaaatcagttccaggacttggtagggttaaggtcccgcccccatgggctgaattctccagtgggggtgcatatcttggaggcagtgtctccccctcacactgtggggcttacagttctttgcttggctcacagtgtaggctgcagcctgccacttctttcaaaggttctgtggtttcttttagttttcctgtcaagttctggtgtcgcttcttggaaaaaagttcacagtgtgaatctttacacactattttgtctttccaagtgggagaggcatgctaacaccgcttctaatccactgtcttgaaaaaaaatgcccatttttaatgtgctgcttttttagtttttagagatttttatacattctgaaattttttatcttaaaaagtgctatttgcaagtatttttctaagtatgtggcttgtcttttcaatcttttgtgtgtctttcgaagaagtgtcttcttttgaagaagaaaatttttaaattttgacaaagttctagttatcaattttttttaaggattgtgtttttgtatcatattgataccaatttggaggtaatttctaccttaacactattgagtctttagacacatgaccatgtatatatcaccattaatttgtcttattgttctcatcaatgtattgtagttttcattgtacattgtcttacacatattttagattcaacctcaattatttcataatttttgatgctactatattttttaaaattcatatttaattgttgctagtatacagaaataaattaatttttgtgtgctgactttgcactctacagcattgctatatttactagttttagtagcttttctgtaggttccaccaaatttttgacaaaggttatgtaatctgaatgcctctcatttcttcttgttttattgcactggctaagatcttcaatgtgacaggcagtggatcacctgaggtcaggagttcaagaccagcctggccaacatggtgaaacctagtctctactgaaaatgcaaaaattagccgggcatggtggtgggtgcctataatcccagctactcgggaggctgaggtaggagcatcacttgaacccaggaggcagagggttgcagtgagccaagattgtgccactgcactccagcctgggcaagaagaatgaacttccgtctcaaaagaaaaaaaaaagatcttcaatgcagtgttgaattgaagaggtaagagcagacatcctcgtctaatgccagattttaagtggaaagcattcagcccttcaccagttgatgtaatcttagatgtaggtttccgtcatggatggatggatgctgggttttgccaaatgctttttccagtatctactgagaccatcacatggtctatgtaactatggtgagttatgttggttgatgtttaaatgttcgatataccctgcatatctgggataaatctgccttgattatgatgcagtattcttttttatatattgttgaatttaatttgataaaaattgtttagaatttttgtttctatatttctgaagaataataatctgcagttttcttttaaaatctttctctgtatgattttgatctgttgacatttattgagacttattttatggcccagcatttgatctagtttgggaaatattctatataacatactcaaaaagaatgtgtgtttagcagtttttaggtgtatcattctataaacatcacttagcttagactggttaatgctgtggttcaaatcttctctatccttactgatactttatctatttgtttaatcagttactgacagaggagagtttcaatcattaatgatcatgatcgacctgtatgttcctctctttagtactctcatatatttcctttatgtatttgaagctctgaaattggttcataacatttttctatagcatcttaatgaattgaccatttagtcatcataaagtgtctctgtcatgaataacacttttagtcttgaagtccactctgtctaatattaacatgaccacaccagctttcctgcctttcgagtttccatcgtacacattttccatcctttaggtctaagttgccttcttcgcccaggcttggatctgggctccagtgagactcgagatccctttatgctctgcactcagccgccaggtttctgaaccatgggggagctctctgctttatggtccaagtgtcagtttgtgagtttctgaagcttctcttccccgtcggtcccaccctggctttctgcacccttagaaagattcaacagatctttttccaccatgctcccttgtccccagtcttcagaaggccacatggggcactccatagaggcctggtgctccttggcaggatttctcccagccctctccctcctccatccctagtgccgcatctcacatactcagcgaaagcccacaggaaagaggcgggggtgcagacactcgctttgcacagcctgtctctcaaatctgttccatgcacctcaagagtttcttaaaatttaggccgaattctccccacttcctgtgactggcttctgcttcttccattccaatgcgcatgaaagaagctgtggtctcctctccttggaatgggttcatccatccctttctggaatgcagttcatcctcttttcctgtgtcctcagctctggcagatttctcctggggctcactcgtgttgttggggtgggagggggatagtctcctggcagatttctcccgggggctcactcatgtggtcggggtgggaggagaatgggctcctgacactctgcaccctacgtccatcgtacacctgcaggaggtgtctcctggtcgtcccccaaggccgtcctcttggaagcccacctgggccacctaccccctctggcatgagtacgcctgggctcacctgccccctccgtcagaagcccgcctgggccacctgccccctctggcatgaacgcacctgggcccacctgccccctctgtcagaagcccgcctgggccacctgccccctctggcatgagcgcgcctgggcctacctgccccctctgtcagaagcccgcctgggccacctgccccctctggcatgagtgcacctttactttctgtgttccctccatcacagcacttgctttaattttttaattatattttttgcttgcttgttttctccctcctacccagcaaaactgtaaaatcctaaaggacagaaactaactttccttaatcatttccttaatctagcaccatttcttgtatgttaaatatgttttttaaacatttccaagataaatcagctagttaatggtattggtaagtaatgaatttctgactaaacctcctcagtaacagagtggacagggaatttatggtgttctgcatgatgagttcaaggactgtgaactggtgctaccacagtcaataaaacaggaagcgttaccaccctcacaatgcagaagtcgtaacgacaccttgatttagtgatcaataagtgctcaattagtgtttaaacgaggagaaagctctgagtcatctcgctaatgaacaaagagaaagagcatgattatattcccagtggaataaaataaaataattctgttatgacgtcaccagcatgaaggccctgaaaggcaatatgtttaggatatttctccatctacgctagagtttcatttttgatgatgggtacatagaaaacaatgatttataaaataattcacaggaagttgattgtaccttcaaagatcgtcagtatataaagcttaaatttccaattaaaatatttcatcagctgagaggggaggggagaagccggggcccagatctctaagtccctatatttacggggcagcaaaatctgcacggcagcgctgcagcctctggtcacgcacttcctgtgcttattcagtctttgttcattagcaagatgactaagagctttctcctcatttaaacactggacagaaaagaaaatgagttctgggttttcatgcatttttttaaatactgagaagcatctatcttaacaaagaagaaaaatacctaagccaaaatgccaccaagtgctcattttctgaataaccgtttgacagctgtgctaaatgtctgtgtgctggaatgaccacggagctcattaattcaaactgggacacctccgagtgggaaagaatgacttcctgataattatgctgagtaacagtagagaccaggactgtgaggccgaccatcgtgtgtaggagattccaaggtgacacagccaaacttatcagaaggtggaccctggctgctggtggaatatttgacatgaccggtgcccacgcccctctcccattcctctttcttgaaatggagagcaggcaagatgggggcagtggtggaagatgctcctcctccatgcacccagcagccctggggagcggcagggtcgcaacccaagagatgaacccccagtggccccgtcacgagctcccaacggaagggatgtcctagtgcagaggcagccaccacgctcgccccctgtactgggaaggccgccacgctcgccccgcgatggggaaggccgccacgctcgccgcctgatggggaaggccgccacgcttgccccgcgatggggaaggccgccacgctcgccccctgtatggggaaggccgccacgctcgccccctgtatggggaaggccgccacgctcgccccctgatggggaaggccgccacgctcgccgcctgatggggaaggccgccacgctcgccccgcgatggggaaggccgccacgctcgccccctgatggggaaggccgccacgctcgcccccgatggggaaggccgccacgctcgccgcctgatggggaaggccgccacgctcgccccctgatggggaaggccgccacgctcgccgcctgatggggaaggccgccacgctcgccccctgtatggggaaggccgccacgctcgccccctgatggggaagcccgccacgctcgccccctgatggggaaggccgccacgctcgccccctgatggggaaggccgccacgctcgccccctgtactggaaaggccgccacgcccgccccctgtagggggaaggccgccacgctcgccgccttgtatggggaaggccgccacgctcacccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacactgtgctcggcctaggaaggcatcctgtctctggcaggaacttgctttccccaggggctgctatgagccatctcatggggcatcactaggatacctcccaatggctcatagcacgaattgctcaatatctaccaaagaccttcactctcaacgagttcctgcaatttgctacggtttgtttctaatgtgtggatgttgcggctgcttggccgacctcacgtctggctgctgagggcagggaagcactgcagccattccatttaccctcgaggcgaatccatgctgcgccttgtcccacaggcaaattccattctaactctgactcttttattttagtgccagggctatttaataaaataactgaaaccgaaggaggagcatgatgatgggttcaaaatggaacaactgaggctcccattgaatgaaaccaaatgctgtttgcaggtgacgactcgctcactggcccatccaaggcacattggacgagcctccaaggctacgctcctgcctttctctattcagtagcccgtgaagagggcccttggacgtcagtctaggtgagcacgccactgtcaagtcaggggggaaagacaggaaactgcttcacagaaaagtgtcaactgatttcccttctctcaaacttcttccgagtctctgaaacttttaatgacgcctcccccttccctcgtatgttactaaaaccatctctggactgcacgtgggttactttactgatcattcacttccagcgtctggggacgtgacgtcacggcgccgttacagaagcctgaaatctcccagcagcagtggaggcagagcacagggccccacagcccttctgataaagacacagcggggcagaggaggaggacaaagcaatgatttcagagctggaggtgctaaattaccaacgttcaagagggtgggagaaatgccagtttccaccgtgctgtgctgagacctgctctgtggtgccgaggcacaggtgtgcggagggaatatgtttgccagtgtcctggcgccctctgattcctctcatcagagtcggagacctccactgagcctggttcagactctcaacctaatttctatttcattttttaaagattattttatcaacgatagttacggttacagctattgctgactgggcactccatgaggagcttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcgcaccagacgtgcttagttgctctcagttaatgaataaaaactttaaatttagcctgtttaaaatagtgttaagtggaccagaccctctagggttaggcccacacagagagactcccacaggctcctggaaggctttggggcatgtttttcaggccagccagtggtcctgatgggaggtgggcctggcacagagcagggctgggactggcctttcattgtgagcctaaccttagagggagacctggggcccacagagccctgtgaccctgtacttccacgagggctgaagacccccaccctccaccatgaggggtgatttcaaccaaccaggaaacacagtccatgatcaggaaaaacacaaatatggcccaggtgccactgggccctcctgagcagcctctcaactgtggcctgtgggtctggcaccccgtggcccctgcatggctctgggccagcatcagggctctgtttggcggccgtggacagactggcttctgcattcaaacgtcattgtgacatcctcctgaagaggcaaggccacagcaaagatggctgcccaggagctgccctcggaaaggctccagagaaccatggggccaaggccgggccttccccaggcaccacctgctaagacacagaagtgcctcagcttcctcacctgcctgcacagaacgtgccaccttgtggggccaacttctgtggaaactcaccctgtggttcccacgcttggtgcaaggttccaggaagcccctaagctggcctgggattgagcttagtggccacgcgtcctctgggaggactctacctttcgaggtctgtgggggttgcccagagttaacttaagtcatttcaatggctcgatggcaggaacataatagaaactgggcccacattgcttcccacacatatcccagggccacagctcctggtgagaccccagtggagtccaagaggatgcagagggtcctcaggctttcctgtctcacaccagcatggcttccatcttagaaaggaaagtgtgtcaaattagagctgatgtaactaacgtttggcagaaaaggagtgtgtgagcgtcgccatcaaacccccaatgtccccagggccatcctgggcctcaacacctggtccaaaatcctatcccaggaagctggcagggctgggctccaaaggtgatttctgcagctcttgtccctccctctttccaggcaatgtgggacctgtgaactctggcctaacaagtcgtcataaaaatcatgcctgcttttccatttacaaaatttactgagattcctaattccgtgtccttaagatgttgagtgggcttcgcatagtgaagggtcttgggtggctctgtgatgcgggtccttgcagctcccactcgccctgcataaacactcctggggttcgcctccgagcctgtctggggtctgtgtgcccagggcatcaccttgtgttttggtgcccagaccctcatgcccacaggcagatggagcccttacgctgccctgggctgcccccggggcaggcttgccggggagcaggagctttccttggatgcagtagttgcacctggtgccccctaattccagccatgttcatggcccctcagtctacctcagtcaggtttcagtgtccactgctgtcccggatcctttctcaaagggtgaagagcagccacctatctcctctacctccctggtgtgcatctgtggtttaaatggtgggctttctggagtcacgacaccttgtcccaagaaagatcctacagagcctcacccagaggactaagcatttgtgggggtggctggactgggagcaggtgtcgctctaaggggccccaggaacaccgaagccctgttcacaggatgcccgctggcccgggaaacaggcgcaaagccaagaggagccagcgactaaggaaacatgcccaggtacctgcaccctgaaggaaaagccaaccccggcccggggaggaagtggaagggtcacctcagcggggggtctgtcctgcgccgtatgggtcctggcgagcacgtctgaggctggggcctgggacagggcctccaggaagggcaggtggcgtcggagggcgttggccagggcagcaccgccctcccgactgtacctcctctcgctgccaacgctgtgttttgagggcctgaaaaagcaaaagaaaccagacatcaaccgcatgtttgctggtgcctggagctgctctgtcccctgtggtgcctgggtgcatgcaaggggctgggagccgggctctcggtggccggcctggccttgctgctccatgaccatgggtttgaacttctcccgggcccccgagcctgtgtcctgcacgaggatggctaacagcacctgcctcgtggttgtggggatggacgattgacccctgctgagagcagaagacaggaagcaaaagcaatacatgggaaacaaggggaggggagaaagggaggaagctgcaggtgttggctgcaggctcagcaggaattctccaggaggctgaggcagccagaggccgggtgggcatggggggcccaaggcttggcatggcttctgctgggtttgtgggtagaccaaggaaggtggcggcccagaagctggaaaaggcaggaaccaggttctcgcctgataaatgtgcattgttttaggccttaggttgatgtacttcgccacagcctcgggacgtccatgcagtgctctcagcccctccgctgcagtccctgctgttaaacagtgattcacgcaccgccatcgcgtgcaccatgcagggcagggacgccggaggctagaaggacaaacacatgggacgcttcccgtgggcagacacatgtggtgcccaccctgctgagggcggcaggggtagggccagcgaggacaaggccaagaaccaggcacggctggccaggggccccatgggacagctgcgtgctgaaggcataaatccaggaggcagctggacgtgtcagccacatgtggcccccactaatgatgctcagagtccctgagaaagcagccacttgccagtggggcccccatcaccagcttgtgcagccacacggaaaggaagagcagaaccagggagattcactggaaaagtcgcggtaacgcccaacaggccccggagagacagagtcaggactccccatgtttatggggagccctggtggaggcctgggcatgcacagaggatgtccgtggccccctgagcctgcgccctgtccccctttaccctcagctgtggcggagagcttgcctgagccacggggcagcgtctcagcctgggacacgatgggcatggcctccctagggatgggcatggccctccctgcccagctcacccgcagactctgccgctggtctctgcacccaggactcagccgcccagagcttcacagcccccacggaggcctttgcttttttgcacatgaccaaaagggcccagagcatgctcctaaataaggaagataattcccataggagacgcctctaccagccaggtttaagaacacctgcgtgagtgactgcaccccacctccacattccagcaaggctctgtctcaaaaaaaaaaaaaaaaaaaaggaatataatgtgaggccggcatgggggctcgcagctataatcctggcactttgggaagtggaggcaggagggtcactagagcccaggaacttgaggctgcagtaagctacgatagcgccgctgtgctccagcctcaggcaacagaggaagaccctgtttcaacaacaacaaaaaaagtgtgtgcacgcgcgcgcatgtgcgtgtgtgagtttgtgtaagtgtgtgtgtgagtgtgtgaggggtgtgagtgcgtgtgtgcgtttgtctgtgtatgtgtgcgcctgcacgcacacaccatgcttctaataaaatgcaaagatttcgtagacatggagtttagacacagaccaaagagcttttaattctggttatttttagtttgtataattaattgagtgcgtcatttatgtccataaaagaacgggcatcaccattaaaaagatgggccagtctgggggcccttgctgtccggctctgctgcccacagacaagggcagggccctctgtgaacctgccgccctcagcaatgctcccaaatccccttcccgctgagagccatgctcagcgatgaccaatcacttcaggtccgacttgtgctgcagtggacggtccagacgccacaggccccggcgtcatgccccactgccagcacaagactcaggcctccctcataacaggctttacaggtgcggtcagctgccatctgcttctctcaggccagggagaggctaggtccgaggtggaggcaggtactttcctgagcgcccaggcactggctgcctcagagccctggggcatggctccaccttcaccttctcaacatctaagtctagatcctcgttagggcaagaagcccaaattacagatagtgtataactgtcacgtttaactgaccacaggttgcctccaagggacatcacaccacttaacatatgaaatacgagccttaaatagatccttgcaattctccctccagctctgatgcggtgttgacatgaattctgttgacagctatgttatcaacctcacaatacactttcatcatttttgtttaatcaacttctttaaatgtgatttaagtgacaggaaaacaccatctatcggtggatgcagttgccttcgcgtgttctctcattggtttccatctggcacctttcccttctgccagaacggcggctttaccagccctggtcatggagctctgtgggtgatgatgtccttcagcgtctgtatttctgagaaagccaataattttacctttgtatctgaaggatacttccatgggatatggaattctgggttgatgtttgtttgtttgtttttcctttcagtactttaaaaatgctttccatcgtcttctggcctggagcattctcaaggagaaacctgcagtggccttcatcatctcatctctctatgaaatgcacctttttttcctctggctgcttttaaggttggctttttatcactggttttgagaaattttattatgatatttcttagtcttcatgtttcttttttagggggcttattgagctttctggctctgtgagtttatcatttttatcatattgaaacaattttcctcattatttcttcaaatgatttttctgttcctgtctctcccgccttgggactccagttatacagatatttggcctttagatgtgtcccatagctcactggtgttttttatttttttttaattatccttccttgtttccttatggatagttcctattgctgtgtcttcaagttcactaatattttctaccacagtgtctaatctgctattcattccacccatgaaattttcctgtctcctacttattgtgtctgtgtcagttctgtgtctacactgatgaattttatgagttgcattttcctgctccttttcatgccagataatccatgtctatatattcacattgtgaattttaccttattgggtgatggacatttgcaatcccataaatattatttacctttgctctggcattcagttaagttccttgggaccagttcaaccctctcggttcttacttttaagtcttgtttggcagtatcagagcagcaattatctatgacaaattactccccactactaagacaggactctgtgggcattctacccaattatctggaaattatgaggtttgcaagtcttgataggtttgaagaagcactatgtcgcaccctgtgtgaatgtcagatactgtttgctctcatttttttggatggttcttttccctcatagacacaaggtcatcagtcatctaccaaatcctcagcagtggctgaaaatctccagggctctctgtgcactcttctcttttatactctgacctgtgaactcaagctgccttggtttccccagaccttcagctctgtctcatcaactctggcaggccactgagcaccactgtccctgaggcagctgggggcaagtgtcatcgccacacagctgcgtcccctcccaaaatggccctccaccatgggggtctgcctcacccacgtttataccccatctagggaggtctgcatcccacactggtccccagcccctgaggaggggtgagggctcctgaggcctctgtcatgaccacactgagtccaacctctcctcggccaaacccgtctcttcacttccccatgaggggtcttcccaagaccctgcatttggacttcaggactacagagtctgctgtccagacacccaaccgagatgtagctccccgggcacccctggggccctgcccacggctagtgaggatcttgggggacttcaatccagtgcccccgatgccagtggaaaggcgactatagatttctccttgagaagtgctccaggccagaagacgatggaaaacatttttaaagtagtgaaagaaaaaaaagtaacccagaattctatatcccatgaaaatatccttcaaatacaaaggtagacttatggctctcttagaaatacgacactgaaggacatcatccccagcagagctccacaatgagggatatgaacagcccaggctccctaggcaggcacaggaggtagatatgagtcaaggagcacctgtatacgtatatatgtatatacatgtatgtgtgtgtgtgtgcgtgtgcatgtgtatctcctttcacagaatttgatgctacattctgaacaaaatcgtattcagaaaaagtctgggtatgtctccaaacacagcactgtggcatcacccaacagcctgagggaggtgcagctcagactttgcaggtgctgagtgaggcagtattacttcaaatagaacatacactttgctaagaacaatttccacttctgggtatcagcaagaagtgtcttctatccaaacatgaccatctggtacttgtatatgggtctttagtgtgatttagaaacactttaggaaatacactggggcttgagtggatgtggaactcattacaaatttcccacatacagtaatggaataggtttccaggtactgtttccatgtaggatgttgattttcaagaacagatcactaacattaggtgtgtgatacctgcatggggcttataaaaaaaatcccatttttgcttgattatctcaattgataaacccaccatgtttttatttctagtgcctttttgtattactttgttcccacactgctcataaagatatacctgagactgggtaatttataaaggagaggtttaattgactcagttcagcatggctggggaggtctcaggaaacgtaacaatcatggcagaaggggaagcaaacacacccttcttcacaaggtggcaggagagagaagtgcaaggagcaaaggggaaagagtcccttataaaaccatcagatctcgtgaaaactcactcactatcatgagaacagcatggagacagccacctccatgattcaattacctcccactgggtccctcccatgacacgtgcagattatgagaactacaattcaagatgagatttgggtggggacacagccaaacaatatcacttttcaagttacactgatacagatgtaacaggcatataaattaccaaggcttttgcagttctttgcatctcaaatcatggctataatttccttggccattttttaattaatgaaatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctggggacttgtttgtgatgctgcagtatgttacggcaatgagagggtttatcattatgccgcgtggtgttgtagcaattaacttgcacattgacttttgctctgtcatccagcttgaagtaggtcaaaacttcatacgtatgaattttgtactttaaaaagatgaaaaatgttttacacttagtagctattcccttctccattggcacacactggccttaggctcacgataatatgagatagtctagattgtcacccagtttgttaaaggaaaaaattccacattacaggcccatcttatgttttatatccaaccttcatggccacctgaagttctctgtgaagtcatcggtgctcatatacacagctggtatttgttgtccctgttcctgcctcaggagcatttagcatgatccctggttctctttagccattagcatgatccctggttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcagatcctccttagcccttagcatgttcccaggttcttggttatcttagcccttagcatgttctcaagttctcagttctcaggttccccttccttgactctcttagcccttagcatgttctcagctcctccttagactttagcatgttctcaggttcctggttctcaggtcctccttagtccttagcatgttcttaggctctcagttctcaaggtctcttagcccttagcgtgttctcaggttcctggttctcaggttctcttagcctttagcatgttctcaggttcctggtgaccccttaggtgcgagctctgttcctcacactgggcactcatacctactgctttgctgattttccacactgcgtctctttctggctttctctcatggggcttactctgcttaagggacctcatgtgtgggaagagaagaaccagcaggagaaatgagcttgtggttgccactctggtaagcccaaaaacagggctggggattctgaagacttcattctaatgtcgcctttatttcatgaatggatgattggttttcagcaagttactcaatctctggagattaactgccttatgtaaagaacaccagctactatgtcactggcccatggtggattcttgttcagctgtgaagctcagaatgctctgaatacacatggagtggagaaagccaggtgacattcttcgttagtgtagctacccatgcaagaattcaaaggcttgggcagatcacgcattctgtccttcaccaccatttatccaacaaatgctggcccagggtccatctggtgaagggcacaggcaggcactaggggagcctggttagaagcagctcctgggagtggggagtgaggatgctgaaagccaacacggttccttatcatgcagcaggaatcagaacatgatccctttaatgaggaatgaaacaaatccattactataaaatcgcttgaaaatctagaggtgatggccacaaattaaatccaaaataagacaaaattacgaatactaaagaagaggcaaacgagccacaatccacgtatgagaaggcaaacaagccacaatccacatatgagaagaaaaagccccacagaggaatcagtccccttgctgctataactcgccctccgacctgacccaaggggctttggaaacaccacttgatcttataaaagctgagtttcaaacagaaccagtctcaaaggtcaaattctgaagatagccatggattaatcaggcaacaaaaacaaagaggaagcaggaaaggccctactcatttaggaaaatggaatccaagacaacaagcattaagggagatgcaggcaccatttaaacaacaatccactaatgatggacgccgaggacgagctgacgcagcccccgtgtgctaagcagcagagcctcagagcctatgaagctaaacacatcaacccccaaagaaaactcacagattactgtttttgtctgagaaatttcagaaagtcacaatataaataaggacatgttgaagtaatacaattgacacatttttacctaattacacatcatatatatataattataaactatttataaaagtctgtatcctgcaaatagttatacaaatatatttttgaagcgccaattgaagattaagtatggtatcaattaggccaaagaaaacctcaaaattaccaaagagtaaaagttgaacaaagtcacattctgactaaaatgcagtagaattagacactaatttgaagtttaaaaacaacacataaatatgaaaaagtagaaaagcctaccaaacatttattgtttcaaaaggatataaaatgacaattacagataatttagaacaaaagcaagtgagaattcatcagttatagaatgatgttaaaattatgctcaaaagcaaattatttatgtgatttcattatttttttaaaaatgaataaatagcgtaaataagttttactgaagaagttttatttaaaagagaacagcaaaaagaagaaaatctaagagataattctttttaaaaatcatgttacaagggtgaaaaaaaagtggttttttttttttgagacagggtctcactctctctcccaggctagagtgctgtgtgtgatcatgactcactgcagcctcaatcccccgggctcaggtgatcctctctctcagcctcctgagtagccaggcgccaccacacctggctaaagaaaacgtacgtttacaatgcaaaggaatataactacacaagtgctgagtaattttaaaaaccataatagtgagaactaagctctgattttttctcttgtccaaattcctatctaagaggtctgggaagtcataccccacaaaccataaattctcatcagatgggttttatttgaccctatatatcgtgactgacttttcagtctgactctggcagaacattatgagacaaagggaaaaaatcaaaatatttaactctaaaatatatttccttgcaatacctggaaattgccctgcaaagtctcttgtgggaaaaatccacattctatagggatctactttcccctttgttttccttccttcctttccagatccaggagataatcaaccaagagccaggcacccttttaggtccaataagaagcatcttacaacctgctttctctgaagtctgctaactgagagcttcctctgcacaataaaacttggtctccacaatcctttatcttaactggaacattttctattgatcccaggtcttcagataaactcaacgagttgtcaaccagaaaatgtttgaattcacctatagcctggaagcccctgctttgagttgtcccaccttctgaaccaaaccaatgtatttgattgatgtctcacgcctccctaaaatctataaaaccaagctgcaccctgagcaccctgggcccatgttctcagggcctcctgagggctgcatcacgggctatggccactcatatttggctcagaatacatctctaaaaatattttacagagtttgactcttttcatcaacaagagaatagcatccactacactgcatttacaaatgtggaaatcgctattaaaggatagcttataaatatcccaaatcacacaacagtgtaagcatattttaccaataatcgtggaagacaatgaaaatactctataaatgaagaacattcctaaaaaatatactagaaagtagatcaatggtaaaagaagttttccagaaatgttaggaaaaaaagaaaaacgatcacatttccatgaggaaatactgtgggcaactgttgaggaagacgatgggccacactgtttcttattctctcctgggcagggcctcatgggaacctccctcagtaggtgtcagagtcgggcatgaggaaggcaccggcaggactggggaggcctttgggtcagcaggagggacagcatgagagggagtgattgtccccaggcagtcatgtctgggcctggggaagagctggggaacatgcccagactcctctgccctccatgctgggtgcagcttgttccaaaccccaccaaagccagaggcccagaggacccgatggagcttacaggcatgaagcccatagcagggcaggggaagggagtgtggaggaaaggagtctggagaatatccagccaatgcctccctaaatgggcctctgttttgtgggcagggataattgctcttgcctgggttcaacactcacaaagaaagaatttagaaatccaacctacagaatggtaagagctgtttttatttgtaaccatagctagtgccatctacgttccaggctgataaaaatatttttacaaaatataatatgtgaaaagttactagcctgaaatataaagaacctataataaaagaaacaaacagaaaaatacaaaaagtcctttttatacagacaaagaccatatacagaaaattcacaaagaaaattccaatctcggccagatgtggtggctcatgcctgtaatcctagcactctgggaggccaaggtgggcggatcatgaggtcaggagttcaagaccagcctggccaacacggcaaaaccccatctctactaaaaatacaaaaattagctgggtatggtggcgcgcacctgtagtcccagctactcaggaggctgaggcaagagaattgcttgaacccaagaggtggaggctgtagtgagccaagatcgtgccactgcactccggcctaggtgatgaagcaagagccaaaaaaaaaaaaaaaaaaaaaaaaaagaagaggaaagaaagaggaaagaaaaaggaaggaaggaagggaggaaggaaggagaaaattccaatctcaaagcatatgtattttaaacttttaatctcacttataactcataaaacaaagataacataccatttttcataataaaactggcactgttttaaataataaaaactggcaatttttccaaatgaccacatttaacgttgtttagaaggcacaatccaggcgcctctccatggttgttgctgagtttgatttctcagaggcaggtcctccctggattgttctctatgtggcgcccctttcctcccacgtttggcagcttctgtttgccctgttctgcacccccccagagtgaggaggagccatcccttgcttggttttcccaattcttccagccctctattttttgcccttcttggccgtccaacccatccctatacttgatggagttcaaggtcattggggcagtgcacaacgcccccagtggaatttagagaggagtataaggagtttgaacacatccaaaatagaaattcaacacagctcaagttgaaaacattttggtgggtttttgtttggtttcctacagaaaagtcttacagactataacagcacattctctttgataaaggaggtattaaaggtagatacaccaggcacagaagcacaaagaggcagcccctgccctcagtgtgcgccgcgtgctgaagtcgcagcccctaacctcagtgtgcgccatgttctggggaaagacgcagcccctgccctcagcgtgagccgcgttctggggaaagacacggcccctgccctcagcgagcgccgtgtggtgaagacgaagcccccgccctcggtgtgcgccgcttgctggggaaagacgcagcccccgccctcagtgtgtgcggcgttctggggaaagaagcagccgccgccctcagcgtgcgccgtgtggtgaagacgaagcccccgccctcggtgtgcgccgcttgctggggaaagacgcagcccccgccctcagtgtgcgccgcgttctgaggaaagaggcaacccgcgccctcagtgtgtgcggcgtgctgggggacggttaccagttctccacacgttctcactcttgatcctgccaggacacttaactgctttccctatcagatggccatgagcatgaaagcagatatctaaattttgtgttactggaatctttctaaagactatgactctagaattgtctgtcagggaaaaatgaacttttcaaactaaacctttaggaaaggtcattttcatgtttttttttaaaaaacatgaaaaatagcacaatggctcaggaatccgacagtgccagctttcttactgtggtttgtctttagactaattttttaacctccctatgactcaatttcctcactttcaagaatcggtatgacattagtccatggtatgtatgacattaccacatcgtttgtatgacattagtaattaccacatagttttgagtacaaaataagataatatggaacaatatatttagctcagtatacgttgctatgctctgggaaaggatgataaagactttcacaattctgttttttgtctaaagcaaaaataatttcttactgagaaatgagaattctcgacttatctgctttcgaccaaggccttgaagatgcaggatttttctaagagtctcatggaaaaacgaagaacccctgggcatgtctcttactggagggtcaccccaatatcgctttctctcatgggaaccaaacttttccttacagacatcctaactttctgaaacgtctgcaccagaaagatggtgggtgctttgctacattaaaacaaacaaacaaacaaataataagtgtaatggctatggactgtgtcctgggagcaaggagcaacaagccacgtccacacttacctggctgggctggatgcttcaggacgcctcaggtaggttttcgggaggtctgcaagttcctggtccatcacatactgagtatagtcatcctgccacgtgaaacctgtggacaaaaattgcaaaaattatgtcatcattttggaaatttagccaaagctcttgcttcagtctcacaattagttgcatttcagcattaagttgatggtcccatcagcaaagtaagcctccctctcactgcagtttatcaagatctccttacagaaattccagctttctgaaacttctaggccaaaaagaaaactgatgctctgctgcattaatagtaataaaaaggcttgggtgagagtggagaaagctggccaaatagaagcctctaccaatcatcctccctgtaggaacaccaaattgaacaactgtccgcacagcaaagcaccttcatacgaaccaaatttcaggtgagtggtcacagtacctggttttaactccatatcattgaaagaggcactgaagagggtggaaaagatcatttggaattgctgatgtcacccctcacccatccccctgcagtggctgtgtgccccagagagagaacgcatgcacttgggagagagagcacagtgatagtgggacttggtattggaactcggtgctgccctgtcacagtaaaaacaacaggcaaaactcaaccagagcccatggagggaatatttagaccagccctagacagagcagtaccacccatcccagtggtcagaatctgagttctgacaagcctcaccaccatgggctaaagtgctctggggtcctaaataaacttgaaggctgcctatgatggaaggactacaattcctgggcaagtcctggtgctgtgcttggcttgtagccactggacttggggtgcagacaacctagtaaggtactagctggcacaactaagggtgctagtgtcacccttccctcaaccctaggcagcacagctcacagctccaaaagagactccttccttctccttgaggagaggagagggaagagtaaagaggactttatcttacaacttagataactgctcagccaagtaggatagggcactgggcagagtcatgaggcccccattccaggccctagctcccaggtgacatttctagacacaccttgggccaaaggaaaacccactgccttgaagggaaggtcccagtactgaaaggattcatcatctcctgactacagagcctttgggccctgaataatcaacagtggtacccaggcagtaccccatgggccttgggtaagactcagagatgtcctggcttcaggtctgatctggtacagtcctagtggtggggtggccacagaggtgcttgtgtcacccgtcacccagctccaggaagctcggggagggggggagagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaccccatcaaaaagtgggcaaagtcttttcaaatacctggaaagccttcccaagaaggatgaatacaaacaagccgagattttagcgactacaataaatacctaactcagacaccaacaaacatccaagagcatcaagactatccaggaaaacatgacctcaccaaacgaactaaataaggcaccagggaccaatcctggagagacagggatagatatgttacctttcagacaaagaattcaaaatagttgttttaaaaaaattcagtgaaattcaagataacatagaaaagacaatcagaatcctatccgataaacttaacaatgaaattagaataattaaaaacaatcatgcaaaatctctggagttgaaaaacataactgacccattgcagaatgcctcagactctcttgacagcagagttgaccaagcaagacaaagaattagtgagcttgaagactggctagttgaaaatatgccgtcagaggagaccaaagaaaaaaggattttaaaaaatgaagcacacctgcatgatctagaaaatagcctcaaaaagacaaatctaagatttatcacccttaaagaggagggagagagagaaagaggtagaaagtttagttgaaaggataataatgagaacttctcgaacctagagaaagatgtcagtgttcaagtataggaaggctataagaacactaaacagattcaacccaaataagactacctcaagacatttaattatcaaactcccaaaggtcaggaatgaagaaagaatcctaaaatctgcaaaagaaaataaacaaacaaacaaaaatacaatggagctgcagtacatctggcagcagacttttcagtggaaactttacaggccaggaaacgggattgttatttaaagtgttaaaggaaagaaacccttttattctgaaattgtatatccaacaaaaatgcatttcaaatatgaaggaaaaatactttcccagacaaacaaaagctgaaggattccatcaacagcagacctgtcctataagaaatgctaaagggatttcttccgtctgaaataaaagaatgttagtgagcagtaagaaatcatctaaaggtacaaaactcactggtaatagtaagtacacagaaaaacacagaatatcataacactgtaattgtggtgtgtaaactgctcatatctggagttaaaagactaaaagatgaacttatcaaataactccaacaacttttcagatataaagatataaatagaaacaacaaaaagttaaaaagtagggggatgaagctaaagtgtagagtttttattagttttctctgtgctggtttgttagtttgcttatgtaatcaatgttaagttgtcatccgtttaaaataatgggttataagatgttatttgcaagccttattgtaacctcaaatcaaaaaacataaacagatacaacaaaaagtaaaaagctagaaattaaaacataccaccaaagaaaatcactttcacttaaaaaaaaaagtaaggaaagaaataagaaagagaagaccacaaaacaatcagaaaacaaataacaaaatggcaagagtaagttcttacctatcaataataacaaatacacatggactaaactctccaatcaaaacacacagagtggttgaatggattaaaaaaaagacccaatcatctgttgcctataaaagacacacttcacctataaagacaaatatagactaaaaagaaagggatggaaaaagataatccgtgcaaatggaaaccaaaaaagagcaagagtagcagtacttgtatcagacaaaatagatttcaagacaaaactagcaaaagagacaaagaaggtcataatgataaaggggtaaattgagcaagaggacataacaattgtaaatatatatgtacccaacactggagcatccagatatataaaacaaattttattagagttaaagcaagagacagaccccaatacagtaacagctgaagacttccacatgccactttcagcactggacagatcattgagacagaaattcaacgaagatatattgaccaagctgcactgttaaccaaatggactgaattgacatttacagaacatttcattcaatggctatgaaatccacattcttctcctcaacacatgaataattctcaagaatagcccatacattatggcaaaaaaatgcatctttaaaaattcaaaaacaaactgaaattatatcaagtatcttctctgaccacaatggaataacactagaaatcaataacagggaaaattttggaaactatacaaacacatggaaattaaacaatatgcttctgaatgaccagtgggtcaatgaggaaattaaggagaaaatttagagatttcttgaaacaaataataatacaaacacaacataccaaaaacctgtgggatgcagcaaaagcagtactaagaggaaagtttatagctataagcaactacatcgagaaaaaagagaataccctcaaacaatctaatgatgcatcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcctggctaattttttgtatttttagtagagacggggtttcaccgtgttagccaggatggtctcgatctcctgacctcgtgatccgcccgcctcggcctcccaaagtgatgcatcttaaagaactagaaaagcaagagcaaaccaaacccaaaattagtaaaagaaaagaaataataaagatcagagcagaaataaatcaagttggaatgaagaaaacaatacaaaagatcaatgaaacaaaaagttggtttttgaaaagataaaattgacaaaccattttctagtctaagaaaaaaagagaaaagacccaaataaataaaatcagagatgaaaaaggagacattacaactaatactgcagtaattcaaaggatcattagaggctactatgagcaactacatgccagtaaattagaaaacccagaagaaatggataaattcctagacacatagaatctaccaggactgaaccatgaagaaatcaaaaacctgaacagatcaataacaaataatgagattgaagctgtaataaagtctccaagcaaagaaaagcctgggacttgatcacttcactgctgaattttaccaaatatttaaagaagaatcttgctcaaactattccaaaagatagaggaggaggaaacacttccaaattcattccattaagccagtattaccctgataccaaaaccaaagacacatcaaaaaataaaacttcacgccaatatccctgatgaatattgatgcaaaaatcgtcaacaatcgtcaactgtcctggggataggacagtctcttctataaatggtgctgggaagactggataaccacatgcagaagaatgaaactagactcctatctcttcctatacaaaaatcacataaaaatggattaaagacataaatctaagacctcaaactatgaaacgactaaaagaaaacactgggaaaactccctagtacactggatagtgtaaagatttatttagtaataccccatgagcacaggcagccaaagcaacttgagtaatgctccacaagcacaggcaaccaaagcaaaactggacagatgggatcacatcaagtgaaaaaacctctgcacagcaaaggaaacaatcaacaaagtgaagagatacccacagaataggagaaaatatttgcaaagtattcatctgacaagggattaataaccagaatgtataaaaagctcaaacaactctgtagaaaaaaatttcaataatctaactttaaatgggcaaatagatataactctgaatagacatttctcaaaaaagacattcagacggcaaacaggcgtatgaaaaggtgctcaacatcactgatcatcagagaaatgcaaatcaaacctacaatgagatatcatctcacccagttcaaatggcttttgtccaaaagacaggcaataacaaatgctggcgaggatataggaaaaagggaaccctcatacacactgttggtagaattgtaaattagtacaactattatggagagtagtttggaggttccttaaaaagctgaaaatagagctataatataatccagcaatcccactgctaggtttatacccaaaaggtaatcagtgtatcaaattgatatccacactcccatgtttattgcagcactgttaacaacagtgaacatttggaagcaacctaaatgtccatcaacagatgaatggatttttaaaaatgtggtacctctacacagtggagtactattcagccataaaaaggtgagattctttcatttgcaacaacatggatggaactgaaaatcattatgttaagtgaaataagccagacatagaaagacaaactttgcatgttctcaccgatttgtgggaactaaaacttaaaacaactgaacttatagagagtagaacaacagctaccagaaggaagtaaccattgttactgggaaggaaattggcagggggcggggggcaagtgggaatggttaatgagtacaaaaatacagttaagtagaatgaataagatctggtacttgatagcacaacagggtaactacagtcaacaataatttattgtacatttacaaataactaagagtataactggattatttgtaacacaatgaaaggataaatacttcaggtgatgaacatcccatttaccctgacgtgattattatgcattgtatgcctgtatcaaaatatcccatgtaccccataaatatatacacctgtgtacccacaaaaattaaaaattaaaaaaatagacttaatgggtgctgactatggctagacagcaaggagccttacaccaaatacaagtttagttagaagacagatttttatctactatgaaagatggaaacatcttccatctacatggaaatattgtggtcacagcaaagatactcctcatccacaataagcacatagtacccgccactcacccactcctctacctgcccgccaccatatcttaggtattttgttcttcctaacaaaatcttaaaagacagcaattggaatggaataaggggtattgttactgtgaaagcaattatcatggggcttaatgtactgtatccgggagccaattacattatatttatactcaaatgttatgacaaagagctttataacaagggtgaagtagttatgaaggcaaaatccatgtgattatgcattaattacatgcactgtggatcacatgataattatgctcaaaattaccaaataactctcaagaataattattatgcaatttgtacatgttagatcttatggtaacactttagcacttagaactaccccatgcaattatccataattatctaatcactaaatatcatgtaattacagagatatatttttatgccctgtacaaaaacacattaccaaaatcttcaaatcaggatggctctgtgcttgtgtgtgtgtgtgtgtgtgtgtgtgtgtgtgtgtgtgtgtgtgtggcgtaggaagtccagaacatgatgagaaccacatattctggatggaattaaaagagctcagtaaatataagctatcttcatgaacacacaaatatttttttcacatgcaaatctagattttttaaatgttatagacggcaaattaaagcaattgtcatatttctaaatctcaaaagcctaaatggcattacctgaagtgaagaatgataggaaaattcaccattaggatggcctccaacttactctaagctgctctagttggaatatatcacttagagtataggtcgctgcagaaaacaggccccacactcactactatccaatttaagattaaatgtacttaataataatcaagtctatcccatttgccaaagcaacttaaaaacacccactatgaaatgtacttttgtttatatagctatttctgatccattcttgggagtatactcaactgaaagcacatttgcaatgttagtataatatctattattgtggatttagaaataaggatattttaaccacgccattcctaaaagggattctcttaatattaatatttatcaggaaacagaaaatcaatggcacaaaaagaacttttcatgaaaaatatcatttataaaatttaaataactaaaatttaaaaatttttatctaaaaatcatataagtctgagttatgtcaactttgggatctatgataaaggctcagttcttccagaacaacagttggtcaactactcagaatcatctgtactgggcagtctgagaggaccctgtataccttagcccagccatctcagccttcccggaagtcagaagaaactgtgctcttagatataaaaaacaaacaaaacaatgcagaggtatgggagtttaagcatctcctatgaacttctgtccgtggcatatcttggagaaaatataaccctgggaagaaggaatccactcccagagatgacatacgtcttcccactaagtacaactaaaatctctgagcatacgtaaaacaagcataagactctgaaggatggcaatacgaaggcagagcagagaaggacatggtggtggattccctgggttttctttttgcctcaggtacctcagacttggagtcaaagaggccgcaatccggaaacaccagcgtgtacacacacacacacacacacacacacacacacacaactaaagcagcctctctctaatcaaggagtcaggaaagaatcaactcagcaagacagaaaaatattagatattaacagctctaccccagcaaaacaccacagaaaaaagtacagcctctccctacccatgccaacaaaggccaaatggggatctagacttcctctttcatgaggctgtaataaggcctcccctcaggcctaccaggtagtgtcagagaaggccaagtagggatccagaactttcatctccattgggttgtaattaccacaacccctgcagtgccagcagagaccatctgggaagttgaaactcccacccctctccctaaccaatcagtaaaaagaccccaccttcaggtatcaacagaggcctcctggggaatctagacttccatctccctgtcagttacaaggaatcaccaccaccaccccttacccccagaagaggagtgtccaaaaagagacagttaaaatgcaaggtttaaatgagatccagaatcatgacataatacaaaaatgtccagatttcaaaagaaaataactggttatacaaagaacaaagaagatcacaaaataaatagaaaagagacaatccacagaaaccaacactgagatgaccgagatgttaaaattgcctgagaaagattttaaaccagttacgataaaaatgcttcaatgagcaattatgaacacacttgaaacaaatgaaaaagtaggatgtctcagaaaatagatgatgtaaataaaagccaaattgaaatattattactgaaagatacaataaccaaaataaacaacgcagtggatgcacataacagaaggatggagagacagaggaaagaatcagtgaagtgaggataaaacagtaggaattactcaatgtcaacaacacagagaaaatagtagaaaaacatgataaagcttcagcaactgcggggctataaccaaagatataatattcatgctatcagagtttcaaaaagaggagtgaaagaagacaagatgacaggtctgaaaaggtactcagaaaaataatggctgaaaacttctcaattttggaagaaacatgaacctaaaactttaagaagctaagcataccccaaacagggtaaacccaaatctcctccaagacacataataattaagtttctgaaaacttacaaagaaaaatcttaacagcagccagagaaaaatgacaacttacctacaaggaaaacacaattcaaatgacaggggatttcttatcagaaacaatggaggccacaaggaaacagcacatttttcaagtgctgaaagaaaaatatgtcaacccagaatcccacaagtctatcaatccagatacccagtgaagttatccttcaggaatcagggggaaataaagatatccccagaaaaaggaaaattgtgtttttcaccagaccaactctgaaagaattactaaatttatgtctccatatagaagagaaatataaaaaaaggaattttggagcatcaggaagaatgcaagaacatggcaagcaacaacctgagtaagtacaataagcattccttgagttttatgcttgacagttcaattaaacaccatactactgtcttatgtcattttaaatgcacatagaggaaatatttaaacaattataatataaatgaggggcataagtaaaatgtcataaaggaaggtaaagtttctatatttcacccaaactggtaaaattatgacaccagtaaactttaatgttatgaatatgtatatgaatattatatctagaacaataaataaaagaaagctatcaaagacatacactcaaaaacatagataaagtggatttccaaaatcattaaagtaactcaaaggaagggaggaagaaacaaagaaacaaaaaatacaagaacaagtagaaaatacaaaattaaatgagttttaaatcctaacatgttaataattacattaaatgtaaatgggctaaatatgacaatgaaaacactggctgagtgggttttttttaaaaaaagactcaactatacactatatgaagctcactttgaataaaatgatataggatggttgaaagtaaaaatatttttaaaaatatatcatgtaagtattaatcaaaggatggaagcaatagctatattaatatcagataagttaacatttagagtaaagaaaatggctacagagaagggaattacagagttataaataggtcaacccactaagaagatacagcaatcctatatatgaattatatagatagagcaactaaacaaaaaatcaacaaagatagaaaagaactcaacaataccattaatcaacaggatctaatgaacatttatggaacactgtacccaacaagagcagagtatatgttcttttcaattgctcatagaacacaaaccatgatagacttaatgctgggccataaaacaaacttcagcaaaattataatcattcagagtgtgttctctgaccacaatatagtcaaggtagaaatcaataacagaaagataatggggaaatataacaacatgttataaaataatccatgggtcaaagagaagataatacattacatgtaattaaaataaaagcacaacatatcaaaattcatggcacatacagttaaaactgtgctaagtgaaatttttagcactaaatgcttacattaaaaaagagggccctactggagcacttttgccagtggcccccacccaccctgccagggcacttttgccagcaaccaccaatggggcagtttagctggtggcccctgatagagtgctttcaccagcagcctagctgcaccttgacctcccagtgaagctggtactaaagctcaaggggccagaggacaaagccacaggcctggtcccaggtcaccagggttagagcatacagcccaggagttccaagctgaacctcggccctatgaaaaaattcagaaacaaagccaatcaactatatccaacttacacaacagcaaaactcttatgagaaataacgaacataaaaacaaaaagccctatccccaggacagcaacttcaaaaggataaaagaacatcagcactcacagatgagaaaacagcacaagaactctggcagttctaaaagccagagtgtctttttacctacaaatgaacacactagctacccagcaatggttcttaatcaaactgaaatgactgaaatgacagacataggattcagagtctagatggcaaggaagctcaatgagatacaggagaaagttgaaactcaatccaaggaaatgatttgagagttgaaagacaacatagccattttaagaataaccaaactgaacttctgaaatttaaaattcaatataagaatttcataataaaattggaagcattaacatcagaagagaccaagctgagagaagaattttagagcttaaaggcagttctttcaaatcaacacaggcagacaaaaataaagaaaaaagagtgttaaaaaatgaataaaacctctgaaaagtatgggattatgtaaagtgaccaaaactatgactcactggcatttctgaaagagaaggagagagagtaagcaacttggaaaacatagttgaggatacagtccatgaaaattttcccaatctcactagaggttgacatgatattcaaggaattcagaaaacccctgtgagatactatataagatgaccatccccaaggcatatggtcatcagattctccaaggttgttgtgaaagaaaaactcttaaaagcagctatagagaaagggcaggtcagttacaaagagaacccaccaggctgatagcagacatgtcagaaaaaagcttacaagccagaagagactgggggccctattttcagcatccttaaagaaaaaaaattccaatcaaggatttcatatcccacaaaactaagcatcataagcaaagaagaaataaaatcatttttagacaagtgaacactaaagaaattcactatcattagacccgctttacaaaggtccttaagggagtgctaaacatggaaacaagaaagatacctgcctccacaaaaacacaaatacgtagctcacttgcactataaagcaactatacaatcaagtttacatgaaaaccagctaacaacacaaatgacaggattaaatccttacatatcaatattaaccttgaatgtaaacaggctaaacacccacttaaaaggcatagattgacaagttggataaagaggcaagacccaactgtctgctgtcttcaagaacccatctcacatgtaatgacacactttggctcaaagtaaagggatggagaaagatctatcttgtaagtggaaaacaacaaagagcagaggttgctattcttatatcagatgaagcagattttaaaccagcaatgatcaaaaagaacaaagaggggctttacataatgaaaaagggttcaattcaacaagaagacttaactaccctaaatatttatgcacccaacattggggcacccagattcataaaacaagttcttagagacctataaagagacataaacacaataatagggggagatttcaatatcccatttgacagcattagacagatcatagaggcagaaaacaaagatattctggactcaaactcaacccttgatcaactgggtcttctagatgtctacagactacccaacaacaacagaatatatattcttcttatctgcacatgacacatactctaagatcagccacatgccataaagcaagtctcaaaaaaatccaaagaaaattgaaatcataccaaccactctcttggcccacatgtaatataaatacaaataaaaaacaagaagatctctcaaaactatccagttacatcaaaattaaacattttgctcctagatgacttttgggtaaagaatgaaattaatgcagaaatcaaaaaattatttgaaactaatgaaaactgtgacacaacataccagaatatttgggacacaactaaagcagtgttaaaaggaaagtttataacactaaacaactacatcataaagttagaaagatctcaaattaacaacataacattacacctggaagaactagaaaaaaaaagaacaaaccaatcccaaagctagcagaagaaaagaaaaaatcaaaatcagagcagaactgaatgaaattgggacacaaaaacacaaacaaaagaaagttcattttttgaaataataaataagattggtagaccactagctagattaacaaaaatagaagacctaaataagcacaataagaaatgacaacggtgatattacaagaaaaccttttaggttttctgggttttttccatttcttctagaacaccttgaagaaataaataaattcccagaaacatacaaccttgcaatattgaaccaggaagaaattcaaatcctgaacagatgaataatgactttcaaaattgaattgctaataaaaaaaaaacctaccaaccaaaaaagcccggaaccagacaaattcacagctgaattctaccagacatagaaagcagagctagtaacaatcctactaaaattacttcaaaaaaccaaaaagtaggaactcctccctaaatcattctatgacactaaacagaattgaaaacagaaaccatatgatcatcttaatagatacaggaagggctttcaataaaattcaacatcccttcatgttaaaaaccttcaacaaattaggcatcaaaggacaaagataaaaggaatatgcctcaaaataataagatccatcaattacaaacccaaaggcaacatcatattgaacaggcaaaagttggaagcatttcctgtgagaactggaatgaaacaaaatgcccactctcatcactcctattcaacatagtattggaattcctagccagagcagtcaggcaagggaaagaaataaaaggtatccaaataggaaaagaggaagtcaaattatctctcttcatagatgatatactatacatagaaacccctaaaaactctgccaaaagacttctagaactaataaatgacttcagtaaagtttcaggaaaaaaatatcaatgtataaaaaccagtagcatacaattcacttacccttagcaaaccaaaacaaaaactaaaaaactaatatcatttctacacatcaataatttccaagctgaaatccaaatcaagaatgcaatcccatttacaacatgtacaaaaagaataaaatacctaaggttatagctaaccaagaaagtgaaagatctctacaagaattaaaaaacactgcagagataatacaaacaaatggaacaacattccacgctcatggataggaagaatcaatattgttaaaatggtgacattacccaaagcaatttacagactcaatgctattcctatcaaaccaccagcatcatttttcacagaattagaaaaaaaaaagaattataaaattcatatggatccaaaaaaaaaaaaaggctgaatagccaaagcaaccctaagcaaaaagaacaaagctggaggaatcacactacctgacttcaaaatatactataaggccatagtaaccaaaacagcatggtactggtacaaaaacagacacatagaccaatggaacaggttagagaaaccagaaataaagccacacacctacaaacatctgatcttcaacaaagtcaacaaaaacaagaaatggagaaaggactccctattcaataaatggtgctaggatagctggttagccgtatgcagaagattgaaacttgactccttccttttaccatatacaaaaatcaatttaagatggcttaaagatttaaatgtaagacctaaaaccataaaaaccctagaagaaaatgtaggacacaccactctggacacaggccttagcaaagatttaatgatgacatctccaaaagcaactgcaagaaaaaaaaaaagacaagagggacctaattaaaccaaagcgcttctgaacaacaaaagcaactattaacaggtaaatagacaacctatagggtaggaaaaaatatttgcaaactatgcatctgcattagtccattttcacactgctgataaagacacacttgagactgggtaaactaaaagagcaagaggtttaatggacccacagttccatgtggctggggaggcctcacaatcatgatggaaggtgaaaagcacgtcttacatggcagcaggcaaaagagagaatgaatgccaagcggaaagggtttccttcggatccatcagatctcatgagacttattcactaacatgagaataatatgggggaaactgccccatgagtcaattatctcctaccaggtcccctcccacaagacgtggaaattatggaagctacaattcaagatgagatgtgggtggggacacagccaaaccatatcagcatccaaaagaaatttaatatccagaatctgtaaggaacttaaattattcaacaagaaaaaagcagccccattaaaaaatgggtaggagacatgaacagacacttcttaaaagaagacatagaagcggccaagaaacgtaggaaaaatgttcatcattagtaatcatcagagaaatgcaaaccaaaaccaaaatgagatactatttcacatgagccagaatgaatatttttaaaaagtcaaaaaataacagatgttgacaaggttgcagagaacagggaatgcttatacactgctggtgggaatgtaaagtagttcagctggtgtagaaagcagtttggaaatttctcagagaacttaacacagaactaccattcgacccagcaatcccagtatgggcatatagccaaaggaaaataaatcatcctaccaaaaagacacaagcacctgtacattcatcacggtattattcacaatagcaaagacatggaatcaacctagatacccactgatgatggactggaaaaagaaaatacggtacacatacaccatggaatactacacagccataaaaataatgaaatcatgtcctttgcagcaacatagatgcagctgtaggccatcatcctaatcaaattaatataggaacagaaaaccaaatactgcgtgttctcacttataagtggaaactaaacacggagtacacacagacacaaaaatgaggatgacagacgccgaggactatgaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattctttaagaatctgtaataaaggagaacacaataaacccaaataaagtagaagaaaataaataataaggataagaaaagaaatcaatgtaatttaagtgagaaaaaaatagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacctgacaacatagatgaaatggatcgactccttgaaatccacaagttacctcaattcatccaatgtgaaatcaataatttgaatacttctacactattaaggaacttgaattaataattaaatatctacccagaaagaaataatcaggcccagatggtttcaccaaagaattataccaaacatttaaagaggaattaaaacaaattccataaatatcttccagaaaatagaaggcgaggaaacagttcccaatttattttatgtagctaatattaacccgataccaaaagcaaacaaagacagtaaaaagaaacctacagaccaaaatccctcacaaatgtagacacaaaaatcctttacaaaatattagcaaataaaatccagcaatatatgaaaataatgatacatcatgaggtttattccaggaatgaaaggctggttcactatttcaaaacaaatcaatgtaatccaccatattaataggctaaagaagaaaaaaatcacatgattacagcaatcgatgcagaaaagacatttaaaaaattcaacactcattcatgaagaaaactttcagaaaaatagaaatcaaggggcactttatcaagctaacaataaacatctacaaaaccccacatttcactgtacttaatggtgagtaaccatcaaaagctttcactgaagactaggaacaaagcaaggatgtttgctctcaccaatcttattcaacataaagctggaagttccagccagtgcaatagggcaagataaaaaaaaaataaaagatatgcagacacaaaggaagaaattaaactgtacctatgtcctatttcctgattatctacacagaaagccccaaggactctacaaaaaatataaaaacctctcaaacctaataagttcttgtactatatactaacaatgaaggcatgaaaactgaaattaaaatactatttaaaaccactcaaagaatacctaggtgtaaatttaacaaaccacgtacaggacctatgtgctgaaacacaaacaatggtgatgaaagaaaccaaagatcaaaataaatgacagacataccatgttggtagatcagaagattcaacataataatgatgtcaactctccccagattgatacagaggtttcacataattcctataaaaaatcccagggaaatactttgtagatacagaaaagcaagttatatggaagagcaaaggaactagagtagctaaaacaatttgggaaaataaaaataaagtggaaggagtgatcatatataatttcaagtcttatataggtacaataatcaagactgtgtagtactgatgaacagatacaaataatacaatagaatagaaaacccagaaatagatccataaaaatatgtccaagttatttttgacaaagatgcataaacaatttaatggtaggaaaatttgccttttcaacaaatggtcctggagtgattggacatccacaggcaaaaacaggaacctctatgtaagcttcacagtctacacaaaagcaactcatggacataaatgtaaaaatgcaaaactataaaacttttagaaaaaaacaacagaaaatctttggaagctagagctaggcaaaaagttcttagacttgacatcaaacatcttccataaaaagaaaaattgacaaattggccttcatcaaaattaaaaacttttgctctgtggaaaggccctcttaagagctgaaacaatgagcgcagagttggagaaatattggcaaaccacgtatctgacaaaggactagtatcaggaatatacacagaactctcaaaactaaacattaaaaacattcaattagaaaaagggtgagagatgaaaagacatttcgacaaagaggatctactgatggcaaataaccacacgaagagatgctgaccatcatctcatcagggaaatgtcaattacacccacaatgagatgccaccacacacctatcagaaaggctaaaataaaaaatagggacaacatcaaatgctggaaaggatttggattcagaaaaactgtatcactgttacttttttttttcttttttactgtgaatgtcaaattttgttctggaaaatggtttgagagttcctttaaaaactaaacatatacttatcataagacacaaaaattgaacccctgaccattcatcccaaagaaatgaagacttatgttcaaacaaaatcttgtgtatgaatgttcaccagttttatttagaatagccccaaactgggaaccaccgagtccctcagcaggtggatggttaccatgcagcacctctgcaccacggagcaccacttggttatgaaggaaagaacgattagtacacaccacagcctcgctgaatctccccggaactgtgctgaggcaaaaagccaattcaagaaggatagatgctatataatttcatctagacaacacctgcataaccaactcttgtgtcctatgggaggcacatacggtttgagggcagccacagcacccatcttcctcaagtttgcagtctagtgtggaatgcaggtacgtaattagctaagatccaagttggagtgcaatcattatataataaagttatgagcaaactgctaagggaatagagaaatgaagaggtgaatttgtgttggaaagttaagaaagtttcatagaaacaagtggtatttgaactaagactggaaagataaatagaattctaacaggtggggatggattaggggaggaactctaagataacggagtagcatgggaagggacttggggctgtggcactgagtggtgcactcaggggatggtgtatgacatggggagggaggtgggggcagtgcaggaacagagggaggggagttgcatagtcacaggaggacgtcaaagctacatcaggaagcaccggtgcatctgtgcacagtggggagcagtaaaagctctgcatcggacagaaatatcatccaactgtgtcccagaaggaggataaaagtaacaatattaaaattaaaaatttaaagatacatagcagtttctatttgctgagccttaactatgagccagcactattctaagtccttcctattttaatcctcaggatttgtgaataatgaattaaagataatagggagaagggaaggcattcaataagagttacaaaaacggttcattagagagatgataaggttgtaaactcagagaacactagtgtggatagtttgagaagcagaattggtaaaaataatcagtatatgcaggattaaaggagaacaaggtgtcaaggttaactgcaagagaggttggctaggtcactggggaagaggaaatcacaaagaaggaaggctgggaacacaccaggtttgtgggtggggacgacgtttgtttcttctgcaggctgaactgtgtggcagaggagatccccgtgggaggggcaggtggagaatgccagggacagactgctgagagggaaacggaggcggcagagcaagtggtggcagcgtgcatggtggtcccggcttgcatgcaacacgtcaacacttaagcaggcaagggcatagcaaggacagaaaccaaggtgcacgctgcatatgaggaacgaagacagcgcttcccttttttttttttttttttccggtggtatccaagagtaagatatgcatcttgaagtgagacctggggaagtcccacaacacagcacttaccctaatcgcgtgggagcctctcacgtatcactgtgtcctattatatcatatttattctcttctgtctcactttttaaaatttctggctgcaacaccctaaaactctctcagggtcattaatgggctgtggcttgcagtttcaaacacactggatccaggcgacaggctgtttggagggaggagggagccaggctgaggaacagagatgcaaaggtttgggggtgaagctgaagatgactgactgccaagctaggctccagtggcaccagctccaggagaggaccctgggtcacaggacgaatggaggcctcagagctactcatcagagagtgcactgtgcgtggataaatgggaggagggaggtcagttgggagaaggtgtgagaaaatggaacagtagaaaatctgtcaaagtaaagaggatgggatagatcctccatctgttttaggagaaaaacaataaaaaagaggtgctgagcagaggagcaaaatcgacaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggctgaggaggagcccctgacgtgtgacgggaagaccccaggtggcgaggaagaagtgtcggggaaaggcggtggtcagcacattgcaggatctagattttatgagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggctttgtgaactgagaggaaacactccttaagaagatgacgtgaagtcaattaaagggatcaggtgggctctccttcccaatcagagaagacagggtcatagttccattcctgggctgctcaactgtgcacagtgggggtgcctgtcccaggcctggtcagggccagcacagactccttgacatggttttaactcacattttcacaatccctggaaaaatgcaaagcatttctataaagtagttaaggctttacatgtatatcaaatagaaatggaacctatacattcaagacattaaaaagctctatgcgtattcaaaggtggtagcattgttggtgatattttatgtctctttggaacacatttacaaagacagtttagaaaccagacaataaatcagtcttgttgttatatgttcacacttcacttttacattgaaaacagtgtgacaatcaacttagtcaatgactgggatgcaaataacttatttatcccacctggtatcaactaactttatgccacatcctcatgcatctgccttcaaaaagaagagtcaccattactgagaatgttcagagatcgccctctaccaggttactgaaggaagatcccaaagaagaattttaaacttttctgagcaacatcagaagctttccaaggtgaaatttttgaaaagaaaatattttctccagatacatttcatattccactacacctgttggaaatttctactaggagggacttctggtcccaaaatggtggtgcagtagaagcaaggtgacttcactctgctccacagagaagcaaaaacacacacagcactgacacaatcccagcaatggccacacactcaaatacaaaaggagacagttcccaggaacacagaaaattgaaaacaccccaagcagacagcaaaagcatcagaccaccatgtctgcaccatccctcctcataatctgtttggcatcaagagtatgggaaatttcccctcaactcatagcttctatgctggaaaaagtgagggtgaggtggacaatcagcttctccaacctcttgggggccctggctggagacctgttcctgcttcaacccatgggaagcgctgcaaatgtgtgaagggaaacatccctgaggacagccagagataaaagggggaggtgggactatagtccccagccccacaaactctactctgcaactcggtcaaagaggcactccatcagagtggctgctcacagcaccaccctgtagcaggaatgctccacaggtcccctcagcacgaggccccagccagccttctcacactgctggcatatcccctttgagacctctcccattcagtacaggcagcactcagatctttaaccttcagtacaggcagcactcagatctttaaccagagccaaggtaaacctgggcttaaggtgccatctagtgccgaaaaggagacagggacctagaagggggagaaaaagaaattccacaggtaaattatgtgactctctaagcaaatgtatccaataaaaactaaaacaagccaggagacaagactggagtaaataaataatccttcagtgcaaggacacagacacacatcaacaagaaacagcagcaaatgggaaaccatggccttctcaaatggacaaagtaaggaactagcaattggccctaataagatggcaatatgtgagttctcggaccaagaattcaaaatagcagttttaaggaaactcagtgatttccaagataacacagaaaagcaattcagaaatttaacaaagagattgaaacaatttttaaaaattcaaacagaaatcttggaactgagaaatacatttgctgaactgaaaaattcattatagcctctcaaaagcagaatggatcaagcagaggaaggaatcagtgagctcaaagacaggctatttgaaaatacacaatcagggatggaaaaagaacaaagaatgaagagggatgaagaccacttgcaagacagaaaattacctcaaaacatcaaatataagaatgattgatgttcaaggggaagctgagcaagaacaaggggtagaaagcttactcaaagaaacaataacagaaaacttctcaaaacttgagaaagacataaacatctaggtacaggaaggtcagagaacaccaaacagatttgacccaaataagactactgtaaggcatataataatcaaactctcaaaagtcaaggacaaagagagatcctaaaagcagcaagagaaaagaagcaaggaatatttaaagcagctctcatttgtctggcaaccaactactcaacagaaaccatacaggccaggagagagtaggatgacatttgcaaagtgctggaaggagaaaaaaatgaaaaacctgtcacccaagaatactatatccagcaaagcattccttcaactataaaggagagataaagtcttacccatacaaacaaaagctgagataattcaccactactagtcctgtgttacaaatcatgctaaagagagttcttcagtctgaaagaaaaaaaagtaacatgcaaaaagaaaatatttgaaggtataaaacacaccggtaaaagtaagcactcaaactaacccagaatactccaatactgtaattgtggggtgcaatccactcataaccgtagaatgaagcccaaaagacaaatctgtcaaaaacaataatagctgcagcaacctattaagagataggcagcatacaaatatgtagattgagacaataggaagtcaaagtgtggggggatggacttaaaatacagaggggttttttttcatttttttctttgtttctattcttttgtgatctcagttatctctttaagataacttgttatatgtttaagttgttttttataagtctcatggcaactacaataaaaaaaaactgtaacacatgcactaaaaataaaaagcaatgaattaaaacatactagcagagaaaatcactttaccacaaagtaagacagaaagcaagcaaggcaacaagaatgaggagttacaaaacaatgaaaaaacaaacaaaatagcagtagtcagtccttactcatcaataataacattgaatttaaatgtactcaattctccaattaaaagatatagaatggctgtatggataaagaattaagacccaactataagctgcccacaataaaccagccatatctataaagatggacattgactgaaaggaatagaaaaatatatttcaggctgggcacagaggctcacacctgtaatctcagcactttgacaggccaagttgagagaattgcttgtgtctgggagttcaaggccagcctgggcaatacagtgagactccatctctataaaaaaatcaaaaattagccgggcatggtggcatgtgcctgtggtctcagctacttgggatgctgaggtgggaggatcacttgagcatggaaggtcaagcctgcagtgagccatgatcacaccactgcactcagctgagataagagaatgtgaccctgtctcagaaacaacaaaaaagatattccatgcaagtggaaaccaaaaatgggcagaagcggctgtgcttatatcagataaaatagactgcaagtcaaagactgcaaaaagcaacaaagaacatcactatatagtgataaaagggtcaatcagcaagaggatataaaattataaatatatatgcacccaacaatggaacactgaagtatataaaacagacattaatagatccaaaggaagagatagcccgcaatacaataatggcagggcacttcaacaccccattctcagtaatggacagatcattcaggcaagaaatcaacaaagaaactttagagttaaactatacactacaccaaataggcttgactgacatttatatcatttcacccgactgctacagaatacccattcttttcatcagagcatgaagcactctccagaatacaccacatcttaggccacaaaacaagtctcaacaaattcaaagcagcagaaatcatatcaagtatcttttctgaccaccatagactaaaactagaaatcaataacaagaagaaccccagaaactacataaacacatgggaattaaacctccttctaaatggccaatgagtcaatgaagaagttaagaaggaaatttaaaaatgtcttgaaacaaatgaaaattgaaatatactacaatctatgggatacaataaaagcaatactaagaggcaagtgtataataataaatgcctacatcaaaaacatagaaagacttcaaataaacaacctaaccatgcacctcaaggaccaaggaaagcaagaacaagccaaacctaaaatgagtagaaggaaagaaataatacaaatcagagcagaaataaatgaaattaagataaaatatacagaaaaatcaataaaacaaaaagttttttgaaaaggtaaacaaaattgacaaacctttagctagactaagaaaaaaggaaagaagatccaaataaataaagtcagaaatgaaaaaggagatgtaacaactcagatcacaggaataaaaaggatcattagagacaattataaacaactgcatgctaagaaatgggaaaacctagaagaaataggtacattcctggacactaccaagattgaaccatgaagaaatagaaaacttcaacaaaccaataacaagtaattagatcaaagccataataaaaaaatttaccatcaaagaaaagcccaggacctgatgccttcactgatgaattctaccaaacatttgaagaaataataccaattctactcaaactcttcaaaaaattgaagaggagggaatacctccaaactcattctatgaggtcagtgttaccctgaaaccaaaagctgaaaagacaagacaaaaaaaaaggaggactataggcatagacacaaaaatcttcaacaaaatattagcaaactgaattcaagaacacattaaaaagatcattcaacatgatcgagtgggattcatcccagggatacaatgacgattcaaaatatgcatatcaataaacataatacatcacattaacagaattaagaacaaaactacatgatcatttcaatagatgctaaaaaagcatttgataaaattcaacatccctttatgataaaacactcatcaaaatgggtatagaaagaacatacctcaaaataataaacgctatatatgacaaatccacagctaacaccataatgaatggggaaacactgaaagccttttctctaacatttggagcaagacaaggatgttcactttcaccatttttatacaacatagcactgaagtcctgaccacagcaattaggcaagagaaagaaatacaggcacccaaattggaaaggaaaaagtcaaattagccttatttgcagacatcatgatcttatcatatttataaaacaccaaagacttcaaaacactgtcagaactgacaaattcagtaaagttgcaggatacaaaatcaacatacaaaaatcagcagcatttatatatgccaacagcaaacaatctaaaaaacaataaagtaaccctatttccaatagctaaacataatataagatacctagaaattaatttaaccaaagaagtaaaagatctatacaaggaaaacgatacaacactgaagaaaacaattgaagacgacacaaaaaactggaaagatattccatgctcatgtatccaaataactaatactgttaaaatgtcgatactacccaaagcaattgacagattcaatgcagtccctattagatgagatggggcttgttcagggtgggcatggctgtagacatcagtgtagtccctatcaaaatgccaatgacactcttcacagaaagaaaaatctctaaaatttacataagctcacaaaagaccccaaatacccaaagcaatcctgagcaaaaataacaaacatggaggtctcatatgacctgacttcgaaatatgcttcaaagctatagtatccaaataagcatagtactggcataaaaacagacacacagaccaatggaacagaatagagaatccaggtataaattcacacgtttataaccaactcatttttcacaaaggcaccaagagcagatattggggaaaggacaatctcttcaataaatgttgctgagaaaactggatttccatacacagaagaatgaaacaagactcctatgtctcaccatatacaaaaatcgaatcaaaatggattaaaggcttaaatataagacccgaaactatgaaaccgctaaaagaaaacactaaggaaacactccaggacattgatcagggcaaagatttttttggtaaggcctcaaaagcacagataaccaaagcaaataaagataaaatgagatcacatcaagctaaaaggcttctgcacagcaaaggaaacaaaaaagtgaagaaacaacccacagaatggagaaaatatatgtaaacgatccatctgacaagggattaataaccagaatatataaagagctcaaaacactcaacagcaaaaaaaaaacaaacctctaatttaaaaatgggcaaaagatctgaatagacatttttcaaataaaaacatataaatggccaacaggtacagtcatcaaataaaaacatacaaatggcaaacagatatagtcatcaaataaaaacacacaaatggccaacagatatagtcatcaaataaaaacacacaaatggtaaacagatatagtcatcaaataaaaacatacaaatggccaacagatatagtcatcaaataaaaacatacaaatggtaaaacagatatagtcatcaaataaaaacatacaaatggccaacaggtatagtcatcaaataaaaacatacaaatggccaacaggtatagtcatcaaataaaaacatataggtggtaaacagatatagtcatcaaataaaaacttacaaatggccaacagatatagtcatcagagaaatacaaatcaaaatcacaatgagatatcatcccactcccgttaaaatggctttttttttcttttgagacggagtcttgctctgtctcccaggctggagtgcaatggcacaatctccgctcactgcaacctccacctcctggattcaagcgattctcctgcctcagcctcccgagtagctgggattacaggcacctgccaccacacccggctaattttttgtatttttagtagagacggggtttcaccatgttggccaggctggtctcgatctcctgacctcatgatctgcctgcctcagcctcccaaagtgatgggattacaggcatgagccaccgggcctggcccaaaatggctcttattgaaaagacagaaaataacaaatggctggcacggatgtggagaggagccctcggacactgtgggtgggaatgtaaattagcgcagccactatagagaatagtatggaggttgctcagaaaaaagtgaaactagaactaacatatgatccagaaattccactaccgggtttgtatccaaaagaaaggaaatcaatatatcaaagagatatctgcatgcctgtgtttattgcaggactagtcacaatagcaaaaatatggagtcgacctaagtgtccatcaatggatgaatggatatagaaaatgcagaatatatacacaatggaatagtattctgccataaaaaagggtgcaagcctgtcataggcaccaacatgggaaactggaagtcattatgtgaagtgaaataagccaaacatagaaagacaaatactgcatgttctcactcatatgtgggagctaacaaatggatctcatgagggtgcctccgttgagattggtggttaccagaggatgggaaggggagctgggaggaaggaaggagagacattgactaatggctacaaatagacagaagaaataaaacctagtgtttgatagatcaacagggtgactagagttaacaataatgtatgtatgtttcaaattagccaaaagagaacagcttgactgttcctggcacaaagaaaagatgaatattttaggtgaagatcccaatcaccctgatttgatctttacaaattatacaatggtattaaattatcacatgtaccctgaaaatatgtacatcgattctgtatcaatatagaaaagctttctagagagcccatttttctacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcgttgttgaaggggctgggtgagctgtgagtagatcccaggcaccatcaccatcgtccttgccattgctggccgtcatctctggtcatcgcaaacagagccccttacggtacgttaggggatggtgtggaaacgcttggctaaatgaagatgctgctgacattgctacgtggtgcctgccacacaggcaggcaatgtcttcagaggagccccagcttctcctctcccttctcctcctcagatctaggtagggccgcttgtgctcccttggggcatgaaggaaaaacttcacgcaggccacccctctagccaccgtgctcattcagaagccacaccagacaaacgttgaggggtgggtaaggctgcctgggccctgggccctcagaacctcaagcaaagctgcccgaaggtggggtctgccctggcgtctgtggggtgggggcacacagtctgatcccagtctgacatgcaccagctgtgagcctcgagatgcctcaagtatgtcttcatggagccgccgtgaagacgtgatggcactcagtgggactccccacagggccagtggaacctgtccctgcctggccccccagttacccagttacccggtgcaacctgtccccgcctggtcacccagttacctggtggaacccgtccccacccagccactctgttaccaggtagaacctgtccctgcccgaccactctgctgtggggaaaagcaagagagatcagattgttactgtgtctgtgtagaaagaagtagacataggagactccattttgttatgtactaagaaaaattcttctgccttgagattctgttaatctatgaccttacccccaaccccgtgctctgtgaaacatgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggagggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatctaaaagcacagcacttaatcctttacattgtctatgatgcaaagacctttgttcacatgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaaggacacccttccctcacgctgagctcagcacagagcctgcaggagttgcccgcagcccggcggctgccatggagatacacacaggacacaagtgtctgtgatttctgtggccacacctgtgctggctgctcccgacgtccctggaggccagctgttccggcagggctggggcacacacacaatctccacagtgcagccgcggcctcctgctgggaacgtccgccccgtcctgcctctcggggcggctaagtcgctaagtcacgcccgtgtccggctctgattggaaaaggacgccctgggcttggctgggaggaaaggccagagggtccacaggggaaaagctcagctctggggggcatccctccctacagctgggcctggagaggagcccagcacacctgatggccatcgcagatcaggaaaccgtcctcccctccctcctgccctgggccaagcaggtcctgccagttactataaaataaagcggggggtgtgggtggcaccaaaagcacagcaggcgagacgcggggcacaggaaggaaggaagccacagcaaggcttctggtctctgccgctcatcagaaacctttcttccgccctcagccactgtccctcttaatccagccacattcacggtttctgtatcacccaaaacatcatgtttgttggaacttattttattttagattcaggtcttgttaaccattgctccaggatgctttactttccttgtcttaaacgggaacttcccaggtcatgttattaagaagtgggtgcccaggaagcacgggtcgcagctccacacggacagaggctcctgggacctgggactggctctaggtcatgacagctcagcaggattccagggaccgacggattcagtcctgaggggcagaccaggtcctggtaggtacagcaaggaggactcccctgcaagtctggagcaacaaggccccatgaagggagacaaaaccagggaccctgacacggtggctacaagggcagaggtgagagcagaggtgtgaaggccacgcagcccccaggacgcccccaggacaggctggcctatgctaagccacgcggctccccagactcctgaatggagaagagggtgctggcctcagaggctctcgtgagggccgtggaggggagcggaaagccaggcaggcagctgccacccgagcctggtgtttgctcggtcaaggtgccacagcccccatcaccccggggtgggggccaccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagaccacgttcaagttgcagccagcaaggagcccggagctggtatcccggagcttgttctttcctggggcgctttgtttcagtccacaagccaacgctccgtagcgcggcccccaccctcctgccgtgtggggcaaactattcaaagtcccctggccgtcagaaggttccagagggtgtgcagtcactttcctccccattctcacagcagcaggaccaatggggacgtggctttgtctgcatccctgcggcccctgccactgcactcgccaccatcaaaagcttctcctctcggagctcaaggacacatcaaatgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggtgaaatgaaagaaagccacgcttcctccacgcccattgggtcacgaaatccttgctaatcctggccggggcactggaggatgctataaacaatcacggatctgagcaggtggatgaagggaacgtagatgacacgttgagggtgtggtgcgggcaatacacagactaagagtgggaactggcgaagtgagctataatcccaagcataaaggaaaggaggggaggtggcctccagcgcctctcctactagttaaaggagagagagggagaaaaataccactggaacctccaggcaggtcagacgggcacttggggcttatgtgcattatttgatggaacaagcagtgtctttgtttcttaggatggccatttttatctttttgataagtgtggaggaagttggcttagtataatttaatttctctctcctattaacaggtctcagtaaaacaatggggaatataccaaaaaagagagagagagagagaaagccaaaagaacataaaactagcacattagtcttttaaataaaaatgcagaggaagatagggaaggaaaagaatactacccaatattagtccagacctcgaatacgaccaggacagcctgccacagcagaaagaccaggtgtgtgggcttttgttttgtttttgttttctttcgagatggactctcactctgtcgcccaggctggagtgcagtagcgtgatctcagctcagtgcaaccactgcctcctggggtcaagtgattctcctgcctcggcctcccaagtagatgggattataggtgtgtgccaccacacccggctaatttttgtatttttagtagagacagggtttcaccatgttggccaggttggtcttgaactcctgacctcaggtgattcacctgcctgggactcccaaagtgctgggattacaggtgtggccactgtgcctgggcaggtgtttggtctttctaatggcaaaaggcttccttcgaactttacccttgctagatcttaatattgattcaatggggaggcatattttgctaacagcaaagaagaaaaacatcattgaataattgagatacaattctcagtctaaggccatcaaactgtttgtggacaggaagtggaagcagaagctgagcctggctttccaggcagaggcctctgctgtggtgcccaggaaccatgtcaggagcccacttctgaataaagatgccccaaggcagccccgtgggcaggtgccctcaggcccagggccccctgtgaacgtggatcatggtcttgggccagccagcatccagttccagcttcatggtggaagcatcaaagtgttcttggttaacccattttagaaattccttcagttaccaggtgactcttccctttctccagttcggctatagtttcctttcataacatatttgctgacggactttaattagaatccttcactttcggccgggcgtggtggcttacacctgtaatcctagcattttgggaggccaagggggaggatcacctgaggttaggagttcaagaccagcctggccaacatggcaaaaccctatctctacaaaaaatacaaaattagccgggcatgatggcaggtgcctgtaatcccagctacccaggaggttgaggcaggagaatggcttgaacccaggaggcaaaggttgcagtgagccaagatcacaccactgcattccagcctgggtgacagagtaagactctatctcaaaaaaagaattaataaataaataaaatttaaatttaaattttaaaaaaatccttcacttcccctgacacagactttaaagtacgaatcatcacacccaaattcagctctgaagacattgttttctgaagtgttcacgccctgttttgggcataccaggaaaggaggcagtgttctgttctgttttctcatatcctacctgaatcttatgattgattttacagctaacgttctacagctccccgttctcctaatcacagctctgaggtcctccccaaatgatcactgagtaagaaaacatcttgggaccttttttaagtcaaggaaatgatacagatggctcgaatgttcccacaaagtgcatatggtcctggagaagggagaccacagctctaccaaagctgccatctgaaaccccctcaggcccatatttctagacagcacagtcgcaaaccgaggggtccttatcttcactaaactagctttgcttttgctgtggagccttgtttgcttgcttctgttattgtccaaatcttaactgactctgacttggcctataaggcaggttcacccacccggtagagccatgctagtggctcctagcagcccaagagcccagcctgtaaccattcatccctggagggaaaggagctgaacctaaagtttccagtacaacctcctccccgccccgtcctctgcaccttcctctcccatcgtttattttcatttccatctccagtcttctatctcaagctccactttccacctgcctaggcatggacttctccaacctcttagttccgcttcttttcaattagagagaattctaaatcaaaagcgtgtctgcaaagtggagagattcaaaagatgagaatctcctctaaagattgcaatcagtggccaagagtgagggagggaattcacaaagttcaactcctttcagaaaacatctgtgttcgtcgggaatactggcctgtagtcttctttccctggagtgtttgtctggctttggcatcagggtaatgatggcctcgtaaaatctgtttggaagtgtttcctcctcttcagtgttttggaagagtttgagaagatgggtattagttcttctggaagtgtctggtaggattcagcaatgaaaacatccgttcgtgggcattattttggctgagacattttattactgattcaatctccttactcgttacagtctgtttttctgtttcttcatgattcagtcttggtaggttgtatgtgtctaggaagggctccatttcttccagattgtccaatgtcttggcgtataaatgtccacagtggtctcatgacccttggtgtttctgtggtatccattgtaacgcctcttctttcatttctgattctatttatttgagtcttctctcatttctcagtctagctgaagatctgtccattttgtgtcttttcaacaaaacaactcccaattttgatgatctttcctattgtttttctaggctatttgacttgtttcttctctaatcattgttatttccttccttccactaactttgggcttagtttgttcttcatttcctagtgccttggggtgtaatgttaggttgattagaaaacaaaataagctaacccaggaagctggagtgagaagattccagctagaaagcacagacgccttcacttcagcctcaacctgtgatcagagcagacacagcaggaaagcaggaaagctttcatttccatataccagactcagagctgaaaagaggcaaagaaagtcttctctcccaaaattaatcaatgcaagaggagcagaccatttcactgcttcacactggcacttctcaccttgtttctcttgcccaaccctagtaaaaatgattcccatgtgagcacaacagcctggacattgtggtttaaaagtctggtcactgtagtgagaggaaaaaaagatctgtctggtttcatgagaagaaatgctcagtggagagatggttactcgtgttttccagatggttctgtggaccccagaacgctgtcccagccaaactccaccacagataccaccttcagagttggccaggagctgcaggaagcccacaaaggttgatttggaagaagcaacatcctacaaaccagatccatccacacagagagcaggctctgctccttggcagtagtctctacttagtgctaagtactaagtacctcctaagttgtagtctctgcttagtactaggtacctcctgagtcatagtctctgctaagtactaagcactagtcactactatatatctcctaagtatcagtgtctacttagtactaactactgctaagcactaagtacctcctaaatagcagtctgtttagtacaaagtactattaatgataattacaaactacctcctaagtagcagtctttgcttagttctaagtactgctaaatactaagtacttcctaagtcacagtccctacttcgtatctaatacctcctaagcaacagtctctacttagtgctgatccctcccaccccgagtcactgacatcacttcctgtcctccctccttcctcacaatgtggcccattttccccactgaccaccaatgcagcacccagtccctgggaagagaacaagctgcctccttcccccaggacttccatggtggttcctgctcagccagaagggaaaggccaggctctgaagtccttccagctagctcctgcttcttcactcagaagtgcaggaaactgaccttcccattaatgcttcagagggggtagtagcacagaagttggaaacgcaaattaaaaggtgaaaggtcaaggcagtgtcctgaagaaaaaggctgaacaagcctcaaaaacacacctttcaggtattcatgaaaaaggaacagatacacagagtgtctgtagacagtgagctgtgtgttttgcgtgagtgtgaatgagcgtgttttgtgtgtgagctgtgcataagctatgagtgtttatgagtttttgtgtgagctgtgtgtgagggtgtgtgtgaatgagcatgttttttgtgtgtgttttgtgtgaaaatgagtgtgtgagcgtgagttttgtctgagttgtgtgtacaagctatgtatgtgttttgtgtgagctgacttgtgattgttttgtgtgtcagttgtgtgagttctgtaagctgtgtaagttgtgagtgtgtgtggttgtgagttgtgttagagtgaaagtgtgtgtgtgtgtgagttgtgtggttagcgtcagagtatgtgtgggtgtgtgtgagttgtgtgagtgtgagttgtgtgtgagagtgtgtatgagtgtgagttgtgcacatgtgagtgtatggggggcgtgtgttatataaaatattaaactttttctctgagctcagtgtctcccagtgtgacagagccccagtgccccggggtgggggccgtgggagaagcgacaggcctgagcgaggccagcagttcgaagcccctgctccctggctgtgtcatgtggacaagtgacgtcgtcttgaggatggcctcgtgaggcggcggtgggcatgaaatgagatgaggcgtccagccctgcatctgcagcgtggtcagcacagaggctgacatccatggtcatgccggaatccgtggtcatgccagaatccgtggccatgccggaatccatggccatgccggaatccgtggtcatgctggaatccacggtcatgccggaacccatggccatgccggaatccgtggtcatgctggaatccacggtcatgccggaacccatggccatgccagaatccgtggtcatgccagaatccgtggtcatgccggaatccactgatggtgcacgtgacccacgatgggaaaagtcacaagacagcttcagagctggtcaaacgggactgagaggggctgcaccaggaatgcgcggcctgttgagtttcagtgatgaggccatcagaagccatctccacgcacttctcatagagcgcatgggccgccctggcctgagtcaaaccaggggcctttcatccgagccgacctcttgacgtagagtcaggtctccttgccgagagtgggacctgcaccctgatccattactaggtggagggagttttccagactgggtttgtttgggttgatacaaaggcaactctgcacatccaaattcgcatggatgggagctgccttctaggcccctctggcagtttccccaggagtcaggcacagcgtctcatgacgtggctgtgtgaacaggtgagtggggatgtggaagcagccggctcagggccggcacacagtaggtcgcttgtgcgtggccaccatgctatccgccaaccccggtgccatggttatccctatgctgactcacaggcatggggctgctgactcacaggcatggagctggacatcagtctggctcgcaggcacactggaaagctgctcttaccctactaactttcagtcactgagacacaaatcagggcctggttggcagcagcgagaccgtcagggtgccctccccacctgcgacaataaacaccgcatgatgttaccctccagggatgacccaggattgtgtgaaaccaaaattcattaaaaatgaatattctgggccaggctgcattcactaattgattgattgattgattgataatttgatttatttaaaatacacctttctcgtaagcttctcggcacatacggcaaaatataaataccccacatgaataaaattatcacttgaaaaaactcatcacttgaaggaagagggggaaaaatccatgttatggaaatggcagcgtaatgggtgggtctcctggtgaccaaagacatcctgggaggtgagagatggagagagaaacagaggcttaaagatttggagtcgagacgcgtctctctaccaagaaggaagaagacggctctcactgcccccagctctaactccgtgtggtccacaggacaggaagtcccacacgggagaaggaggatgctggggctgctgacgataagaaaatgtgagcgtttcacaagtcaccgtgggtggtcattgtccttgtccacgggatttttcaaagtaggacaatctgtattttaaagaagttgcgttttcttcctttttgacctttttaaagacttatgcagaaagtgactgcaaccaaaagcatatggttttattgctaattcaaccttacagagctgacaggcaaggccgaccaatgtgtgggagggctctgatgacagcaacgacgacagtgaatccaggggtgacgtcccccaggcgtgtgcttcccatggccatgccggaatccgtggtcatgccggaatccactgatggtgcacgtgacccacgatgggaaaagtcacaagacagcttcagagctggtcaaacaggactgagaggggctacaccaggaatgcgcggcctgttgagtttctgtgatgaggccatcagaagccatctccacgcacttctcatagagcgcatggagcttcccagagcaagcgtgcagccatgccaggcctgggctgggagacatgtgtgaggacgcacgatggggttaggcagcctgagaaaccatccctggcacgggctgcctcaaggaatgaggaggtgtgggcttcccggctgcccatccccatatctgcacatagcccctgcatctcactacacagagcgtggcccgtgggtggcaccccccagcatggccaggagcaccgaggcgcacgctgggctctgagacgccccctggccaagaggggtggaggaagggggcaggcgccaggatctggaaggagatttccaacccacgtggggtctcacaggagaaggccgtgatgggaggtggggaagtggggaggagggcgctcttgaccgtgtctgcgtgtctaagcaaaggatacaggggcgcaaagggaaggagtggccaggggtgcccgtcccaggtgtgctcttcttcacggcgcccctgcttccccaccacgcccatgtccacggctcgtgggcagctgggcactgggccactcagacaccgtcctaaacactccacacaggtaacttgctccctctccagccacacagcaaacacagcaaaggggacttgggtgtctgcggtttttttgtttgtttgtttttaagatggagtttcattcttgtggcccaggctggagtgctatggtgcgatcttggctcactgcaatctccgcctcccgggttcaagcgattctcctgcctcagcctcctgagtaggtgggattacaggcatgcaccaccatgcctgggtaactttgtaattttagtagagatgggttttccccatgttggccaggctggtctcgaactcctcacctcaggtgatccacccaccttggcctcccaaagtgctgggattacaggcatgatccaccgcgcccagcctaccatctgtgttcttaaccatacctcgcacaagaccccagcctggagagaggagcgggagggggaggcctttatccccccattattagggagatcccaaaggcttgtctcataaaatcacagcacatcgtttctgagggtaaagaattagagactccttgaaaatgggagagaatgagtgatgctttaacaagcttctaagatgaaatcctaaagctggggctttgctcagagcccactaaggccaggcgggtcatgctgtccttccaggagcggccccaccccttccgtcttgacactcaaaccatcgggctggaggcaaatgtcagaggagaaaagcctttgcttttctcccagctctcctgtaagaagccgctgagctgccagctatgcagcaagcacctgcgtaccccaagatgcagccaggaaggagtggggtaccccgaccacgtggggacacagccctcccaaggggcagccagtgtttccctgaaggaactgaggccaggaagcttgtttctcatttacttgaattcaaatcttaaaatgtttgcaataaattcaaaattttcaaaatactgtgtaggactgaacaaaacaaaacactcccacacacaccccatgcacacatatcacatatgtgcatatatacaccacacagtgcacacatgccacacacggacccacatcacatacatgcacatacacacgcacacacaccacacatatgcacacatcacacccacacagcacatatgtgcatatatacaccacacacgtgcacacacgccacacacatgcacccacatcacatgcatgcccctacacacgcacacacatcacacatatgtgcacatcgcacacatcacatatgtgcatatagatgacacacgtgcacacatgccacacgcatgcacccacgtcacatacatgcacatacacatgcacacaccacacatatgcacgcatcacacgcagcacatatgtgcatatatacaccacacagtgcacacatgccacacacatgcacccacatcacatacatgcacatacacgtgcacaccacacatatgcacacatcacacatgcagcacatatgtgcatacataaacacacgtgcacacatgccacacacgtgcacccacatcacacacatacaccacacacaccacacatatgcacacatcacacacacacatgaacatgccacacacaccacacgtgaatcacatattcatatcaccacacacgtgcacacagcacacacacgaacacacatcacacacatgcacaccatacataaatgcatacatacacgtatctaccacacatcctgcatgcacacgcatcacacacatgcacaccatacacacatgcatacatatgcatatctaccacacctgcatgcacacaccctgcatgcacacacatcacacacatgcacaccatacatacatgcatacatacacatatctaccacacctgcacgcacacaccctgcatgcacacgcatcacacacatgcacaccatacatacatgcatacatacacatatctaccacacctgcacacacacaccctgcatgcacatgcatcacacacatgcacaccatacatgcatacatacacatatctaccacacctgcacacacacaccctgcatgcacacgcatcacacacatgcaccatacctgtgagttggattggctgatgagtctcccagttgtgacgtctatgcagccaataaaatgtggaagaggggtttcctatggtcagtgaggctttaggaccagaaaagccccatcccctggggactgcagagggctttatctcagcggtcagatgccctctgtgacatcattgccaagcatcattcactcataactttgacagacatgcactgaatgcattcccatttaaactgcttctcctgtgctccagcaagacgccacgtccctcccccagtgtgtgtgcacaacgacccgtgcagtgtcattgtgtcataaatgcatctgagtgtaatgcaagtgagagaacacgtgttggatgcacgacacacacacgagtttcccacactggacactcagtggatgcacaacacacacacgagtttcctacacttgacactcagatgcatttatggtctactcttaccaaagtaaaaagcaacagatgaattgttgaagtatggtacatcagctctaaatgcttcacatatttatggaaatattataataaagaaaatacttatactatcaaggaaagccgaacaacaggacccacaatcggatctatggggtggtccctgcctctaacctgagctcagataaagtaggacacttaagccctcatttttaggatgtatgaatgtggatattctctcattcctactgttgcataattttcagattctttctaatgcatataggttatttattgttatacatttatagcataatgcatgcctatttaagaaaattgaaatggtatcaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagacaggtatattttctttgcaaaatctcaaacccccgaattgttgtggtttctctctcgtctgttttttgacgtgatgcaaaacatgtttgaatgttgcgccgtagtcctgattccttcaaatcaacatcagctgactcttagcagcactgtgctatcactatttcatatcattttcaaccagtcataaatgtgtcctcctaaccatgttgccacaaaagacaattccagatgctttgctatctggtagagaaaaaattaacaattcgcttattcttaaagtgtttgtggggaaattttccaaaagaaaaaaggtgaaattacgcacagtgagatgagcacatttttacttgattgtaacaagtacggaagttaaagccccctggaaatctcggtggaaatcacataaagtagactctaggagacaattccctatctaggctggcatgaaatcctaatgcatagaaagggtaatgggacacgcacaaagcgtactgttacttagcaggctctcaagaaccacacagcatgacggtaataatgtgctcatcttcaggagaatgggaacaagtgctcagggtcaaagaactgggctcccgtcctgcctgctgaggtccctggggtgctttggaaccctcattggtgagccgaggagaacctcgcctttctcccagcagagatcagatgtcctccttactgcacggatatgatacatgtgcatgcggtatgtgtgcatgtggggcgtgtgcaggtgtgcaatggatgtatacagtgcatgtggggcgtgtgcaggtgtgcaatggatgtatatggtgcatgtggggtgtgtgcaggtgtgcaatggatgtatatggtgcacgtgtggtgtgtgcaggtgtgcaatggatgtatatggtgcatgtggggggtgtgcaatggatgtctatggtgcctgtggggtgtgtgcaggtgtgcaatggatgtctatggtgcatgtggggcgtgtgcaggtgtgcaatggatgtctatggtgcacatgtggtgtgcacaggtgtgcaatggatgtctatggtgcacgtgtggtgtgtgcaggtgtgcaatggatgtctatggtgcacgtgtggtgtgcacaggtgtgcaatggatgtatatggtgcacgtatgcatgtgtgtgtccccctcattacctcacatgcgtatagagcacagacacacaccttaataaagcccagagtatgctcagcacagtaagtgtgcaaatcctgaaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggttgccgcacagcctcaagcctcagctgcttggagtgggtgggaacgcgagagcacttgagcaccagtggcctgacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcctgaattagtgtgtgggttggtgagcactccaggcggacctgatagcccggagccctatccctcactaccccccagccccagccctgcaccagttaccaaagacaaacaagagacacgtttctccaaaggatggcaggacaggacagggtaggaaggccccaccaccccatctccaggcacctggctttcagggaagccaccacgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaatcctccccaacatgagccacccccaccacccccgattgatggggagattaacatgccggaaaacgaccccatatcacaaagcagagcctggtttctcaaaggagaccttaatcttccctcacccttgggctggcggagtgagagtccctgtggcccgaggttcctcctgtcatgcccacggcactcagaactgaggctggcatgcggagggtgtggtttccccggaccagacctcgttgtccagaccaaacccaaccacagttccaatctgttttttagccaagtgctttaaatatgtgtcaagcactaatgctgggaggacttaaataaatacatgagccttttcttctaataaactggcagatccaccagatctacctgggccagtctcattttccaggcgactgagcctggatgtgcataactgaagctgcctgaggactggaggactgaccggggccagcacagcgggcgggggcctgaggactcgaggactgaccggggccagcacagcgggcggggctctgcccattaaatacactttcgcgtgtttcttttaacaacgtgctcctttcacagaagtgttttatgctgcatttcgtagaaaggaggaagcactcaacagaaccttccgtttccagtcaccgggtgattgccgcgcctgttgcttccacaaggaacccactgcaaaaccatctagggcaggggcagccccgggtctccagagcacacgccagactcccgaaacccaggccaggaccgcgccccacaggaatctgtcccctcccctcggcggtggtcaggttggccttgagtcttccatgagaatctgcagaatgcggcacacaggcgaggcaagactggggacttccttgaataacaaggtgtccagtgctttaaaaatactctaatggtgaggaaggaaattgagaaaatgattcattagaagagcggaataactctttttaagagcaggctcgcagaagtcgagctgggcaacagattctcgagccgctggcatccatatttatcgagcagaggaagcatccctgtaactgcacggcggcacagagccactgcccacggcacgacccgccctccatctctacgttcaggagcatccctgtaactggacagcagcacagagccactgcccacggcacgacccgccctccatctccacgttcaggagcatccctgtaactggacagcagcacagagccactgcccacggcacgacccgccctccatctccacgttcaggagcatccctgtaactggacagcagcacagagccactgcccacggcatgacccgccctccatctccacgttcaggagcatccctgtaactggacagtggcacagagccactgccgcccacagcacaacccgccccccatctccacgttcaggagcatccctgtaactggacagcggcacagagccactgcccacggcacgacccgccctccatctccacgttcaggagcatccctgtaactggacagtggcacagagccactgcccacggcacgacccgccctccatctccacgttcaggagcatccctgtaactggacagtggcacagagccactgcccacggcacgacccgccccccatctccacgttcaggagcatccctgtaactggacagtggcacagagccactgcccacggcacgacccgccctccatctccacgttcaggagcatccctgtaactggacagtggcacagagccactgcccacggcacgacctgccctccatctccacgttcaggagcatccctgtaactggacagtggcacagagccactgcccacggcacgacccgccctccatctccacgttcaggagcatccctgtaactggacagtggcacagagccaccgctgcacacagcagtaaaaatgtacagccctccctctctgcgttcaggagcagagggcatgagtttcacctccctacaggacaggaaactacgacagtcatctttgcacctgaagaaacaaattatttaaactttctcatcctgcagtttacttcttagacatgtctactttctatagcaaaatagatctggacacgaataataaatgcgaagcatggtgttacagggaaaatcccgaggcatggcccaggcccaggaagaagctgcagaaaaggagaaattcatgtccctcccctgctgtctttcctaggacatcccttccctgctcacccacgtccaggacctgttctttgtatagaggttcctgtcttctggtgttgagtgacacagagcaacccaaaagctccctcgcagaagcccctgcaggcttcacgacgtgtgagcaagggaggttctttggctaaagacccagacaaggcaatgatctacccaacaagatcaccaagggcaagacttcacgcgagcacagctgaggaagatgtttggggcttatctgaccgtttctacaagcatctctcaaatcacaccacagaggaaaccaaaaggcctggttcagcctccaggggccgggctctggaagaaagtaggcccagggcaggagtccacggccacagggaacagggaatgctgccttcctgtggggaacaagaggatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgaggggtgttgagccctctgtccattcaggatgctttggaaatgtttttaccaaactatgagtctcacagtttcgaggactccattcccgctggggctgtgctgtccgccgcacccttgcactgggccctgacccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaaccttctaaaccagacgatgctcagaactacccagcctcagaactacctctgtcctcagacttagatgccacaggaaaccccttgctgggagagccagtgctgactccagcttctcagcgggtttgattttggatgccgtgatcagaaccctgcaggtgctgtgtgttctgtctcatccagggatgtcccgtgtctactgcaggaccttcgggggaggcctgcctgcagaatctctgtgcaaaggtgatgtgggcagggagtgttgacgacgatgctttgatggtcctcttctgttgtctcccataggcacagctttggaccaagctctgtcccccacacaatggactgacctcttgggactcagagtctgatgccgactggctgaggaaagtggacgtggcagggaccccgcggctgcctctgctgagggggacaagagggcaccgaggcttctcctcactctgagaggagttgtcacgtgcacccttggagcaaggtcaccagccagtcacaagtgcagggccattattctggtccgcgccatgtggaattttaaaaagttttagatggtggaccattggcagttttagaaatacactaaggccccggaagacctacctattggttcaggtacctgaggaaaggtggtggaggagacagaagctggcgggggcgggggggaacctaggcagctcccgtgaggacaagtgatgacggcagagaagagggcaggactcaagcagctgggcgcccagcagaagctccatgttggacaaccatgcactaccctggtggcttgagagcaatagaatttgcccgagcttaaaattaaactcagccctaataggaagtttatggaatgattcaccatctgtaataaaatttatctttcttggagtagaaaagagtatttttcccaaaaaatatagtctctaagaaattgtggaataatcaaatctatctataacctaaacttatgcaaaaagaaacatggatgtgagtttattctgccaaaacgaggaataaggtccttcaagctaccagctttttgccgtctgggagcttgggtttcagaagatcccctgtaaattccggacccctagttccctggaacaggcatgagacaacctgctaaggcagactgagagcccagtcagatccctgctttccctgggatctgggttgaaatggagttgaatgagggacccggacaaccagaatcatgctcaaagaggtttcgagtatcctctgtctaccacccaggtcagcaggcggggtttgccctggaccagcgtgtggagagacccgggcacacggctgctcaggacgcagtcagacgcggaacccgacccctcaggtttgatcacagaaacctgtggcgtgtttctggggtaggatccttcctttaaataaaaacttacacaggaaccaaatgttcagagagtctacatcccagatttggctgattcttttctcctcagcgttacaatgagatggcgtgatttgaggacctgctgtacgtgcgctaaacgtctttttcttgttactctgacattcgaatccagtcaggcatcctgtattcaatctggaactctgctcttccttctggggggccctcaagctctgggaatcataggataagaggactgtggtgctggacgaccccgagcccccagttgggtgagcaagcgtgcagcagcgagaaatgtctgagcccccaggcttcaagcccacttcgctcagcctgggtctcacccactgtacaaaggatccaaccctgcagctccgctcctggaggactgaccaagacctgcggcggtgactgcccccgcccagccccacggcgctgacctggaactgccctgatgatgagaatcacagggatggcgtgcgtgccaggggtgagcccgcctgcagaggagctggtgagggccacagcccatgccctcccctgctgggctccttgctgtcagctgacagtaccctggcttcgcggtgacagcagctcttcctctgagcgctgcctcagctcatcacatgagctgagagtgggatgggtctcatcatagctaccttctatccattcttttttacctaaggctttcttgagaggcagttttcactttgcagcctgaatcctactctgcttcaggtaagataactgggcgggagcctgacagtttaagagacccaaatagaactaatctccaagcgggcacgtaagaacagctcacagcatggctgccccggctccttctcacctgggatttctcctggagcattcccgacgtccacacaccacatttcctccgctctgtctgctgcagagcctgctccagggtgaacacaggccgtcctgaatcagccgctgacgcctcccccggcatctccacgtgcagcccctgccctgcgcgactggcgtggaaagggctctggtgcgtctcacactctgctatcatcagcctccttcctgctccagttcttaagttcttgtcttttctgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctcccctgccccccagtcacagctttgggggagatttcagaggtttcagggccttccctgaagcctttcctggaaggtggattctcttgctttttcagcaaccaccagccgttggctctgctggaatggcatccagggttttccttgttgcttctgtatctgtttgttttggcctatttgttgttcatattgttaagctttagggaggaacatttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaagcaggagcaggacgggttgaggcagcagcaccagcaacgcctgtgaaaccccttgtgcatgtccccgtgaggacccctgatgcctctgctgcctgatgctgcaaacgtctcttgagtgagagctcagtttccaaatggagtgacaaggagcagaacttctagacaccggaagtggaaggttgctcaaggcagatgcacaaataaatgacaaatggcagtttgataaccaacacaatgctaaagggccacaggcacaggccacagagaagggccatgggagcaggcaggccacgcaggacacggagaagagccagggaagcaggtggcccatgcagggcacagagccacccttccgggcagggcaagcggcctctcatcccacgtcacaacccgcagctgctgctgtgctgcagggaagagtgacatcacagacacccctcagagcccctgggaaaagcctaaaggaggctctggaggctccaccaaagaccgtcggcaccaacggctggcatgttccttgggaaattagaggagggcgtgtctgccaaaggtggatttataacaagagcccaagagtgggactcactcttcccggggatcccacctgctcccactcctcaccagggagcagcatggctgtgtccatgtgtccctgtgtgtacatgtatatatgcatgtgtttgtgtgtccttgtgtcccgggtgtacaggtatgtgtgtttgtgtgtccatgtgtccatgagtacacatatgtgcatgtgtttgtgtccatgtgtctctggtatacacgtatttgtccacgtgtccctttgtgtacacatatgtgaatgtgtttgtgtgtccatgtgtccctggtgtacatgtatgtgcgtttgtgtgtccatgtgtccatgagtacacatatgtgcatgtgtttctgtgtccatgtgtctctggtatacacatatgtatttgtccacgcgtccctttgtgtacacatatgtgaatgtgtttgtgtgtccatgtgtccctggtgtacatgtatgtgcgtttgtgtgtacatgtgtgtgcatgcacatatttgtgtgtatgtgcgtgcacgtctgtgtgcatattctgcacatgagaaccagaacgcctgcatgcctagcagacaagatgcctgctgtctctctgtggggtttggagaagcacatcagtacagtcaccaggctgcctaaaacacgacaaagcaaagccaattagcaatgctgaggactctcaggccaggatgccgccctaggctgccttcccaagtcagctagcttgacaaaagctttcatatcagtgcctgcaaaaacaccttctcagcacacagctcaaatgttattaaataattccatggggaaataagactttatacacaaaagtttgctttataaataatttgtcagtaatgtatagtaatgcatgcattcataaatcatggttaacagaagcagagacacaaccggatacgacttcttcagaaggcctagaaaaagagtctatttgaataaagcccagagggcctatagaatccaaagtatgcactcccacaataccccaaaacaaaagcaaaacaaccatgacatttatcctacggacattctaatgctgatagtaaggttaaaatccccgtccacataacacacccacacacaaacacaaactggctgttgccactagcgctccgtggggctgaagatggcaagaccccaagcctcaggctggcatttccagaaaacaccctcgctgccacgcctacacaaggggaagactggcagagacggctccttcctcctgacccagaagccaggagagaaagctgatcagtcgcacaggccgggacccagcatgccctgccactctggcaggtcctcaggcaggagtgtgagctcctaatgtctcaggagagacaggggaggagagaggaggcagacgggcaggagggggcctgtccctccagggtcagctcagccctcagagccacttgtaggaggtctgggcacaatagatacagtgactcctctgagaagctgcactgtgatgggacctggggtatccagcaaggggggcgtgaggctccgactggctgagtctgtgtcagcgtcagcaacagtgcccatcccgagctctttcccagcgcaccccaggacatggtggaaggtggaagaccctgcctacgggcagctcagagagcaggtggcagaggccagggtcggcctgcatgcagacaagcaggccgggcagcgggaagaagctcccggaaagatgggagcaccaggccacatggagcttggacagggcaaggagtcagggggagggaggtaacagcccctgggaaataataaagcacacgaacttgtgagacacaatcccttccccagattcccaactgtgtgatcctggcagggacccagcccaagcctcaggggctcacaggcagcgatgggccaaggaagggcttcagggcccagcgactccctgcaaactgagccctgtcctgcacaggtgagaagggaagggatggctcccctgccagttagagacagaggcttggtgcctgggggactccagccacccatcctgagccagaatgtggacgtccactccatagagcacacgaagaggataaaacagcagggtgcactccgggaccgcaggctccccccagcacacatgggtccctgtctgggcatgcacaccgccaggacacagcagctctgtggaagacgccatgcagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggggccacagccgccctgagcccctggttcccaggtgccagtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacacattcacacactgcacacacattcacacacactgcacacatattcacacacactgcaaacattcactgcacacacatacacacattcacacacactgcacacacacatacatacattcacacacatacacacattcacacacactgcacacgcagattcacacactgcaaacattcacgctgcacacacatacatgcacacacactgcacacacattcacacactgcacacatacacacattcacacactgcacacactacacacacattcacacacagcacacacattcacacacattcacacacactgcacacacacatacattcacactgcaaacattcactgcacacactgacacactgcacgcacattcacacatacacacattcacacacactgcacagattcacacacattgcgcacacatacattcacacactgcacatatacacacactgcacacacacattcacacacactacacacatacacattcacacactacacacattcacactgcacacattcacacactacacacacatacatacattcacacacattcacacactgcacacacatacattcacacacactgcaaacattcacactgcacacacattcacacactgcacacacacattcacacacatacacacattcacacactgcacacatacagattcacacacattgcacacacacattcacacacagtgcacacatacatattcacaaaatgcacatatacattcacattgcacacacacatcacacacaccacacacattcacacactgcacacacacactgcacacacatacacatatacacacattcacacactgcacacagtcacacattcacacacactgcacacacattcacacacactgcacatgcggtacctgtgtgcacccgcatgtgcctactgtatgcatgcatttacacacttgtgcatgcactgcacgtgttgcactcacagtcacatgtgcacaccgtgtgtgggtgtacacacagctgtacctactgcacatgtacatgtgtacacatatgagcacacacatgcacactgtacacacacgtgcacatccacattcatccacaatgcacaaacacatgcacacacacacaggcacacacacacagccatcttctcccgaccgcatcccacaggaggggcttcctcaccccatgctgcctgggtttggggcaggcccatcagcatctgctcagcttgctctggaggactttgccccaccgttgtttgtgtatttcccatcgctctgccacagagcctctgggtgctgggtgagggtctacttccaaattcctctcccgggcattccagctcctggcttctgtggcctgctggctaaggggaaggcacagccatgggtgggcgcccagcacctcaacggcccttttcccaccagggacccctccaaagcacccgtggcacctggggagaacctcctgccagttgtggacacctccctgcatgggacactgagtgagaggcacttgaaaatgtgaaagcaaggctgcaatgacggccgagccagagagcagcacctccctagcacaccctgcacccagcggaggtggctgaacacccgcgtcactcagcaaactccacggtgatgtgggccagctgaccaacttcatctagagccactgggctccctaaattcaagtccaactctacccctgccactctcacgcttcccaccttcatcttccagtgcaggactttggagcggcaaacggttattatttagaaggaggtcacatggtgaaagtccaagcctcctcaccttctagtcaaggcttgctgataacattgtccctaacgaacagccgcagcagcgcgtcaggcagaatgagcctctgtttagagttggtaacgaccgcctgaaaatgtcgtggtagaaataaaaccatgcaattcagtaggggaaataaaatacatatccagatggaactgcactgagacgctggcacactgacatctcaagttagacaatcatttaccactcaaagcaccgtggagtgaaggtagcttcccagggcagtttgctgagctcttcctgcgtgctggacacacacggtccaaagatcgtgctgagctcttcctacatgctggacacacacagcctgaagttcaccgcctaagccacactcctgtccatacgacagatcgccatgggccacacgtgacatgtgcatgggtacctgcagcagccggtggcagcaggtgacagtggggaccatcgagatggcccttgcaacagtctaggaagagactcactgccccagattcacctcgagactccaaatggtctcaggtcccttgcggggaccaaaggccgggagccaggagccgtgggctctctcctaatgctcttcctccatgcccaggctccaggactgcctcaagtgtgcactgaaaactgccccattccgaaaagccagcttgcaccttcttgttcctggtagggttccagaacagcgatgctgcttctcacgtggggtccctggtccttgctggcactttccttgatgcccgggaggagctgtcccatggagttttggggtcctcctcctcttccctcccttttctgcctttacacgaagagccccctgaccctcacctgctagagcagtcgaggtccgcctgttcacaacagccctcctggccatgggctctcctactccaggccccacagcccccaagcctggtgacattcccccaggtcactttctatctgctccaggtaggctacctcccagcccccaaggtagtgcatgcttcgtatgtgttccgcaggcccctggcccggtggagcagtgacttgctcagaaactagcaaggcctctcggtagtggcctcccactgacctggctccccacctgccatccactatgctcctggtgctggaaacacccccatgtggctcagagtggtccccagaggcccctgacacagacacgagcacatacctgcaggcacacacctgcaggggcacacttgtggatgcacacctgcaggcaggtacatacctatgggcacatacttgcaggcaggcacccacctgcgggcacacacctgtgggcacacacctgtgggcacacctgcaggcaggtacacaccgacgggacacacctggaggtaggcacccacctgcaggcacccacccacaggtgcatatatccccccatgtccaccctctgcacagcccccttgccaggctgccctctgcacatttctgtttggtcccagactctgggtgaagggatcacctggtgccatcatcagtctatcaccagccctcagagaagtgcctcagcaggaggcctggcagaactgtgtgaggctgcccagcagcacagccccgggtacacagcgtggcatttgatgagtacagctggaaatgaatgagcagaggcaccatgaggacatggtccaggcacacatcaaaggcggtggccagaggccgcctggctccccatcagcaggagcttcagccctgcctttgggtggaggcccacagagccccgccatggaacacagaatcagagtctgcgtgggggctgcgtccaccccatctgtttgcccagcttctctctctagcatgctcagaccccacagaggcgcagggctccttcgcctccccaggggttggggacccctggtctggaggaccagtggggacagtgtctgctgcggtgtgatgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggtgtctgctgcggggtattgtctggcagtgaggctggggatggtgtctgctgcggggtgttgtctggcagtgaagctggggacggtgtccgctgcagtgtgatgtctggcagtgaggctggggacggtgtctgctgcggtgtgatgtctggcagaaagagccggggccagtgtggctgtgagcatcaggcctgaattccgtgaactgaggaacagcctgacagagggacccagcagcagcggcctcaggacaggcacaacggccacttcccggcttaacctgggcagagagacgagagccacttcccggctttaacctgggcagagagatgagagttctgtaatttttgaagattgaattcagtctgataaataattcaaagtacattgcctgaccccattaaaaaatggagttcaaatatgccaaatttttaaaacttcatccattggctgcacaaacaggaaagtgggctccagtggccctggctggtggttcagatgccgctgtggggccggccttcaggggtggtggggtggcccagctgcctccaccccagctccctcccacgtctacatccaagatgtctggcttccactttccgtgtcactaaagggcggggaagctgcaggggaggtgcctcatctgcagcgtcgtctccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaaccccgggggcgtggtgctcacagcaaccttgttagaagggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttagagccgttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacggacttaggaacactgtttcctacctccttcacctcacctccctgccacctccagcccgtaatttagagagaagctgatgcagttgactcttcccagcttgccatttaaacgcacactgggttatgtgcacagagatgctgccccagtgactgtatttgggtaactgtttcaccctcgtggtgtgacagcccatttgagcgctcttcaaggcacgagatcctcagcaccgtcaacaagtctgtgtctcacctgcaatcacagctcattgagccgccagctaattagagagcccctaagtgaatcagtgacacaatgccgcctgcaaaagcatcagagccgcggccgcacgcacacagagcggggtgtgagatatcccagccgcacacacacagagcggggtgtgaaatatcccagcccagacgcgtgcacacggggcgggtgtgaaatatcccagccgcacgcacacagggcgggtgtgaaatatcccagctgcacgcacacagagtggggtgtgaaatatcccagccgcacgcacacagggcgagtgtgtaatatcccagccgcatgcacacagggcaggtgtgaaatatcccagctgcacacacacagggtgggtgtgaaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcacaggaggagctccaaggcccctcaggagtcgccactgttgcctccggtcacccccaccttctgttggagtggccttcagggaaaatgccccaaaggggcctcctaggagcccctgcccgaccccgccccagatgctccctcccatcgccaaacctcgtctcctcatctatggaaggagaacaaggagacggccctcacctagcagtgtaaccctgaatgccaaggccatgcctggtgcagaaaggcccaaacaccagcctcaggaggcgcggccatccccgtcatcacacctggtttctgctttgacctttgctgccaataaatgtgagcagctgccatcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaatctgcctcttctgaccttggatgtgccccaaccagagcttttgcaggaggggctgctcactgtggaggggagcccagagctggaccatcaggagacccaggacagacgccccacagcaaaagccaggacacctgaactggtcaggccagcagtgactcagggcctggagagccccgtgggcagaggctgcctggaaggctccaccggccaagggcaggtcagcaaggcaagtcatggccagaaggcagaagggccagcacaaaggccagctttataggtgcagagcgggagccaggcgggggcactgggagcacaggcatggttctcggggtgaggacgcctccttggccccactccatgtcactggtgactggtcaacaaggtgcaagctgctaccttcacagagggtgatcctaccggagacagatgagcctcactcactggccataacgtgcccccgaccccctggctccctctgcctatgaccaggccaggccccctgcagtgggtgctgctatcacaattgagggctgaacaccccaggggaaactgagtcctttcagggcagtaataagggaaggtttcgaccactgttagctgcagaagggccaacccctttacctggctgtccctctccctgggagcttgctgggccacccctctactgggctgcccctctccctggggtgccttctctacctgagccgtcttctccacctggaccaccccgtccacctggaccacccctccacctggaccaccccctcacctggaccgccccctccacctggatgaccccctcacctggaccgcccccccacctggaccgccccctccacctggatgaccccctccacctggaccaccccccccacctggaccaccccccccacctggaccacccccccacctggaccacccctccacctggaccaccccctccacctgggcctccccatccacctggaccacccctccacctggacggccccctccacctgggcctccccccaacctgggccaccccctccacctggacgaccccctccacctgggctgccccctccacctggaccaccccctccacctggggtgtgccagagggagtaactgtgggatggaaacaaaattcgactctagtgggtggccaggagaggtcacgtgctgcttctcttgtgttgtgaatgcagcggtcagccgcaaaacaccaaatgacacccagtcactggaattcttggattaaatgcttttgatgcacatatatcctctccacacactgcataattaactgaatatccgacaatcggcagatccatactgttgaagctggactagccacaacttatcattaaagtattcaattacataatttataatgaaaagccacaatcaacgctaagcaataccaatggtcacaattcatcagggtccttcccaaaactgtgggactctcagcagagtccacatgcacgggacgggggcaacacagccaagccccatggggcaatccagcttctctgcagacactgctggcttttagtttgtgccaaattttaataaacgttaataactcacttgataggtgtctcagcccatgcaggctgctataagaaaataccatagcttgggtaattgataaacaacagaggtttctttctcacagttctggagatacccacagattcggtgtcggtgagcgcccactttttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccatcaaaagacggtcaggttgttccctcctcatttaagccaattttaaaacgatttttcctcctacaacgtgaaaatgatcacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaacggtcaaggatgagaattgcagcagagctttaaagacttgggtcccaacgtcactgtctattgactgagtttttcaagtggtttgagtcagaagtagggatataccttcaattagagtcctgaattttaggcattacttaccaaaaacactgagcaggtttgcccagaaaatacagtctgcatggaacttccacatcccctcactctctaccagaacggcagcccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctcaggatggagacagtcgcatctgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatgggcctccaaacagctcagaatgtaaaggggaagagctctgtgctgtagctgcaactccagccacaaggaagacaagacccagggctgtgggacgaaggggagagaggactcaggccccagctgcaggattcgagtgcccttcgggagtgagctcgcaggggaggaaccctcctaggacagggcacgtggagctccaggcagcctctccagggccctgcgtgtgctgtttctctgtcttgaaaatgacaccgaacgtttatggccagtgagcacccaccgcaagcccacactgtgagctccttgcctgctggggaggccaggagatgcagaaccaagggcagaagcactgcctgcagccctgtcccagcgtcgtggatgcagacacgggaggagccgcagacagacgcgggaggagccgcagacagacgcgggaggagccgcagacgcagggggagccgcaggcacagggggagccgcaggcacagggggagccgcagacagacatgggaggagccgcagacacggggagccgcagacacagggggagccgcaggcacagggggagccgcagacagacatgggaggagccgcagacacggggagccgcaggcatgggggagccgcagacagacatgggaggagccgcagacacgggaggagccgcagacacagggagccgcagacacagggggagctgcagacacaggaggagacacacaaggagccgcagacacagggggagccacagacagacatgggaggagccgcagacacggggagccgcagacacagggggagccgcaggcatgggggagccgcagacacagggggagccgcagacacaggaggagacacacgaggagccgcagacgcaggaggagccgcagacagacgcgggaggagccgcagacacagggggagccgcagacacagggggagctgcagacagacatgggaggagccgcagacacagggagccgcagacacagggagccgcagacacagggggagccgcagacacaggaggagacacacgaggagccgcaggcacagggggagccgcagacacagggggagctgcagacagacatgggaggagccgcagacacggggagccgcagacacagggagccgcagacacagggggagccgcagacacaggaggagacacacgaggagccgcagacacagggggagccgcagacagacatgggaggagccacagacacgggagccgcagacacggggagccgcagacacagggggagacgcagacacaggaggagacacacaaggagccgcagccacagggggagccgcagacgcgggagagccacagacacagggggagccgcagacacagggggagccgcaggcacagggggagccacaggcacagggggagccgcagacagacatgggaggagccgcagacacggggagccgcagacacaggaggagacacacgaggagccgcaggcacagggggagccacaggcacgggggagccgcaggcacagggggagccacagacaccctcacactccgggatctagcgtgtgtggacgagcccgaggcgctcggcccagcttgtcagcagccttcctgggaacgctgtggaaatgtgtggaggggccgcgtggcttcctgctgcctgggacgacattactgcatctgcatttgaggtgtggggcccagaggggctcaggtaccctacggggggagtcaccccatgaccaggaatcacgctgtggccacacacagggagcctgactgcagctttctggaggagaacgtggttgcatttcacatagaaacacaggtcattttgtttctgaagaattcattccgaatatttatttgctacttgacaaagaagagacttcatcagggataagatctcgacaaagaccatctcctggctgccttttatattcaaatccaccacagatcaactcctggggcgtagcagagtcctgtctccccccaaaatagggagcactttctgattgtggggttcaaaaagctgccttctgagggtaaagggtgttcttaccaggaaagaggagacagaacaatgaagtccccaggggccggcagcagtgccgaggagccccggggaagagctcaagccagtggccaagcctggaccagcctccagcagggacagcaccgtggctgtggggacagtggggacagcgcctcggggccacagagacgtgctccctggacgttggcccaggtgcctgcccacttcctcggagggcctctgaacaagctgcagggctgtctccatgggaaggcgcgcacctcctcacgcctctccagggaagccacagcttcactgtgctggcagacccactctgttttttctacattgcctagagttcggctatttttctcttcccaaagagcctacccagcaaattttactggacaaagtgcctggaacaaagcagccaacaataaaactggcgtgcaccccatgaataaaggcgtcgcccagaaaatgctctaaattaggatttaattgctagaaattactttcaattacaaaaattgcaataaattacttgttgaatagacacattctttcaccaccattaataatttaaaattgctaattgcacgtaatcgcaagtaatttttgttctttggtgagaatcgaggtactacgttatgtggggtgggtttgccagggctggcccccaccctgcgcacctccacgtgtggcaggcagagccgaactcccagaagaagagttgcagtgatggggcctccaccgccaaagccacggacctggtgcagttcataaggtggcctcctccctccatcagcccctcagggacaacaggtggccaagggggtgaccttcccaaggagctggtccctccgccatcctgagaacagtgaatttgtatttgcagtaaaacccagattctccagaaaacgtcttgctgtcagcatccccgccgccttacacgtgctatggctgccctctgactctgctgcctgacttttatctgcacaaatcctacagtctcctgggagcccaccggtcagccagctgcctccaggggtgcgtctcctctcagcttcctcttccatctgaaccttccctccctccccaagtgttcgtcccttgtccacctggaaagcctctctgcccttgaagcacagctcctgccctggccccggcaggctgtaaggtagcacccccacatcccggtcctggtagcacccccacactctggccccaacaggctgtaaggcagcacccccacaccccggccccgacaggctgtaatgtatcacccccgcaccccggccccgacaggctgtaaggcagcacccccacaccccggccccaacaggctgtatcaccccccacaccccggccccgacaggctgtaaggcagcacccccacaccccggccccaacaggctgtaatgtatcacccccacaccccggccccgacaggctgtaaggcagcacccccacaccccggccccgacaggctgtaaggcagcacccccacaccctggccctgggcagtcgtggtgaccgcatggccttgttggtagcttccttctttattaacttggccccatttattaaccaccagcttcctgagggatgaaaccatgcttccagcgtttccaggcccacacagcactgtgccaggggctccagggaagctgatggatgtgggtgctatgacaccagctgctgcggggccctgatgccatggctgggaaggacgtcggcctggggacgctcagctggcaggatatgcctccccaggtgtgcgggcggcctcctcgtagtggaggcaggggcggagggtgcgaggcatgccactgtgagctggggccgagggggccatatgctcaggtgctgtctatcagctctggagggagaagccaaactctcaggcagcccacagcggggtgaggaccgggctccgtcccctctaacagggtggggtggggggcactgactggtcggaccctgcaagatccccacgggcaagagtggctgatcagagctccatgaacagccccttcgtcagaagccatcctctcacacacgtgcacacacacacacacgtgcccgcacacgcacacacgcgcacatacacgtgcacataaacatgctcttctcacgtcgcagtggatttctcttgcactgttgctttaagaactgtcagagcggtgagatgacggcagcctgtgcgaatcggcctccagcctcctcggggtcctgcccactctgttcgccattcggtcccacacctcagccacaacgggcagtcagggcttcagccactccacgggcaccaatgctgaagaccacagaggaatgtgctccagacggaggaggccgggcccaggcctgatggagacacggacgtttgtacctgaagccctcaagtctgccctataaaggagatgaaccctgaaaacactgacccctgaaatcagcaagaggaggcggctacagtgccaggacctaacccgcgctctcccaagtctcctcctcatcacacagctcccgaggcctgccagaagcaccccttgaaggcactgtcagggccttgccacactgctgcacgaggtgcacacgcaggggctgggacatatagctctggccttgcctccaagtctgtctccaaaacaatgagctggggaagagaaactctgtacggtcctccctactcccttgcccggccggggttgtggtcaggccaccctgggaaagaggagcagcccagggcagctacagaggctcctcctcccacctggggagaggaatccgccttcagggagcagcccatgccctccctggcttctcctgtctggcatcacggctgcggcagagtctaagagaaaggctctcagccgggcaggaccaccaggcacacaagggggggatgggagttagaggtgccagccctgctcctgacctccctgacctccagcacataacagggaggccaggtccttgtctgacacacccagagaatcatcagatccaaggcccggggtggccggggaccaagtatggctcctatgagaaaacaggcgtctgcaggaggcctgagcctgccccaccagcctcagcacgtaacatgtctagaacattcctagagccagaaggatgtaggaacttccttccagaatacacttcccagtggacagggaaatgggaatcgaatgcagggaccacccaccacctgccaggggacctctgaccccagggaggaggaaacaaggtcaaatcccaagaccagcctgtgcaacatgatgaaaccccgtctctactaaaatacaaaaaaaaaaaaaaattcagctggacgtgaaggtgggcacctgtaatcccagctacgcgggaggctgcgggtgaaggtgggcgcctgtaatcccagctacgtgggaggctgcagcaggagaattgctcgaaccggtagcagtgagctgagatcgcaccatttgggcaacaaactgaaattctctctcgaaaccaacaatcaatacaaaccaataagcccagaacccacaacttcctgatgtagatggacatgttgtgtccggaattggtgggttcttggtctcgctgacttcaagaatgaagccgcggaccctcgcggtgagtgttacagtttttaaagatggtgtgtccagagtttgttccttcaggtgtgtccagagtttctttcttccggtgggttcatggtctccctgacttcaggagtgaagctgcagacctttgcagtgggtgtcacagctcataaacacagcgcatccagaattgttcattcctcccagtgggttcgtggtctctatggcttcaagagtgaagctgaagaccctcacagtgagtgttacagctcataaaggtagcatatccggagttgttcattcctcgtggtggatttgtggtctcactggcctcaggagtgaagctgcagaccttcgaggtgagtgttacagctcacagacgtagtgaggacccaaagagtgagcaccagcaaaacttactgtgaacagcaaaaaaacaaaccctccacactgtggaatgggacccaaccggtttgctgctgctggctctggcagcctgcttttatccccatatctggccgcacctacatcctgctgattggtccattttacagagagttgattggtccattttacagaggctaactggtccgttttgacagagtgctggttggtgcatttacaaacctttagctagacacagagtgctgatttgtgcatttacaatcctttagctagacacagagcactgatgggtgcatttacaatcctttagctagacagaaaacttctccaagtccccaccctcccagcagcccagccagcttcacctctcactggtactcgctgcaggactttgtggcccctagcccgggcactccaggcagcccaatgggagctcgtcccagacaaccaagagaaaaagaggggaagcgagaaagagacagagacccaccatcatggccaacgacccagggaagagggaatggcagtcctctcacgggatccagcctccaatcaagcccagcaggtgccggccagtcccacggagtgccaggcccgctaagcccgtgcccacccggaacctgcgccggcccacaagccccgtgtgcagccccggctcccatccgcgcttctccctccacacctccccgcaagcagagggagccggctccggcctcagcaagccccagagaggggcccccacagtgcagcagcgggctgaggggctcttcgagcccggccagagcagacaccgaggcagagaaggcgcccagagtgagcgagggctgctagcacgttatcacctctcaatgtggacttgaccccacggtgtgccaggtaaaataaaggtctccttagttccgtgaagacagtcgaggtctgtgcacttaatccagagccccggacggcccccacgccccaccgctgcccccgaacccacagagccccgcggcggcccccacgccccaccgctgcccccaaactgcaccaagacacagcagtttgctctcaagcagtttaaactcgtctaatgctttaactggcctgtcaaatcattgtttcacagaccgcataatatgaattgtgtcccttccatatctggaacaccaaatcctaaatccacagccttcaagcacatctggttttcccgggcccaatcggaaagcaggtcctctccggcctgaagctgcgaagagaggcagcagccatgagaaggtggctaaccccgtcgggggccatggctgcctaggggaggccggcagagcctgcctgggggtcggtaaggacgctggctttggtctgacaccggcagggagggacagcgacgagggcaggagccgcggctctacctgggaacgcaggatcatctctactctgacggctcagcctctgcacacaaaccatccttctgcgtttaattggtcctctccaggggatgttttttgaaactaggtctttgaagacctttcatagcagccctgagataccgggtggagagggcagatggagagagaaccaggagatgaaaggaggagccgagagagcctgggggagccggacgggtgcggcccgacactgcgtagagacgcggccgtggagtttctccaccgtcattaaaccccttttttgctgaggaacgtgttatcaattttaaaattttcccaaatgttgaacaatggaagtgttgtttgcagagagagctcaactgtctaaagtagagaaatagaaggtctcccgagactgaaatgacaaagatggaaagcgggaggggaggcctcacggcagctgtgcccagaaccagcacgctgtgaacaggcgccaggccctgcgccggcccacggctacacggtgctctggaaacataggctagcgagagtctaaagaggtggtgcaggctcaaagccatgtgctcgtcatcacagcttccatttaaatcttgagggctgggcgcagtggctcacgcctctaatcccaccactttgggaggccgagtcgggcagatctcttgagatcaggagttcaagaccagcctgatcaacatagtgaaccccacctctactaaaaatacaaaagttagccgcgcttataatcccagctgcttgggagagtgaggcaggagaatcacttgaaccggggaggcagaggttgcaatgagctgggatcatgccactgcactccagtctgggtgacagagcaagactccgtctcaaaaaataaaaatgaaaataagcaaatacattttgtgtatggtttaaaagcatataaaacagtagtagagtcatacacatactcctaaataacaaaggcaaataggaataccaggagtgcatgctttgtgtgttttcatcaagaacatagtcaccaaaatccaagcggatgggcacagccatttgcatgtaactttacagtataagagacattgtcatatgcccacagtctgctatgaagacacagatccagactggctaagagcacagaggtgcatggaaatgctcgggtgtgtggtgtgcgtggtgccctgcgcatttgtgctggctttgcacccccctcctgccacgtcccgtgcaaacgctcaggtgtgtggcatgcctggggccctttgcattggtgctggctttgcacccacctcctgccacgccccaaaccccaaggagtccaggagccaggagagcccaaaatccccatccatgctcctagaaaggaagtttcttgacaaaggtctgagtcaaccatgggtaaagccagaataaaccctgctagttcttttgaggtgtgaacagtctcagctactctgagccccgcataactcactttggtcaccagaggagcaggatttacagggtcaaaagccatttctccttccagaggctcccagctcaaagcccagccatcgtctcccagacattttgggtcgcatggaaatctgcctcttaagagacctggcctcctgtctagggttagagaacactgtgttcccagaagggacagtcaggcctcaggatcctctcctgagaagccctgaactcaagtcaaactgagcctgtgttaacagggtcctttgccgctaagaacccaactgtctcaggagtggctctgcctttttttttttttttcctttctattttcagacaaatcgtcactcagcatagtaaacccaagatataaaaaccaacaattgagtaactggtcttttccgtctgtcttgggaaagtagcttatcaaaagtaagatgaaaaaagagtattttattgttaaactctataatgaagcaactgtctttgactacacaatgtgggaacttgccagtgaatgtagaagtactgcggggccatgcgtcagaggtgtgtgggtctaggagacgcagatcaggagtctggcctggctcagatgtccacagccaggaagccgcgggcagagcagcggggtcgaggctgcggctgagtttgtgagctgtggcagccatacttactctgcagggcatgttgagttctgaaggagacagcactgctgaagtgagcacagcagcaggacagacggctgatccctccttgtgctcccacacacagcagcgagacacaaacggctcgtccctcctggtgctccacacacagcagccggacagacggctgatccctcctcgtgctcccacatgcagcagccagacacagacggctcatccctcctcgtgctcccacacacagcagccggacagacagctgatccctcctcgtgctcccacacacacagcagccggacacagatggcttgtccctccctgtgctcccacacacagcagcgggacacagagggctcatccctcctcatgctcccacacagcagcgggatatagacggtggtccctcctcgtgctcccacgcagcagcaggacatagacggctcgtccctcctcatgctcccacacgcacagcagccggacacagatggctgatccctcctcgtgctcccacatgcaggggcctcagctctcaggaggaaaacactcttgagagaagagaactgaggaaaggtagcgctgatgtcaggggaagacgcattcgacaacacgcatgaaaaaaaacacttcttgttacgttcatgccatgcttttgtattcgccacaataagaaaaccaagcaagtacttcagtcaggcggcagccgtcacaggtaaacaaactcctatgtgggaaatgaaccgaggctgtgagcctcaggcagctccccagacccccaagaggagagggagcagtgaccgagcaggccccgtctgcagttcacaccgtctgccatccgtcccagagcccagcctcttgtagccaagacggggcaggagacagagcaaaaccactgagaccaccactgagagggtaaccaggcttctcagtagaaccaggggcttgccgcagggacgggagctctgactggccacgtcgtggagtctgcagctgcccatggtggagggaatggcatgcaggtgacaaggacatagggaccttgctgtggccacccgccggggtcacagcatgtccacggcaccctgatggaagctttaatcatcaacggtgttggccgccaatggcataatgaccggacctcaccccacccgcagccctagtggacacgcccatgcaggtgatcagcagtgccgtggcagccacagagacaggccaccaccactcctcaggccactcaaagccaccagcccctccctaatggcctcctgagcaccagaaatgcagaggggtgacagcatgtctcagaacacactgtgagcacagacctagaatcaccacgtcgttcagaatcgccacctcacagagaagcaaacccaaaggcagccagcgtaggagccttttcctcaggagggctgtgtcctgctcctaaaacatttccagggttcgggcatcaagatcagatcacacgttaatcaatcacacgtttaagaacgcctgaaagacatgttcatagctatattcgatgtcgttggattttccaacatggactgatgctcttcaattctctcaagcgcgtttacacacacacttgtttgcctgtgtgtttttgtgtccaatgtgtgtcgtgcacaggtgcaatccaagtgtgcaccggactcacaagactcagtattggcagcgtcctacatttagagagaatccagacaaacagctggtgggcactgggcactgttgtgtgccaggaactctccgagtcagccaggcactgggcactgttgtgggctgggcactctccaagtcagccgggcactgggcactgtgtgtgtgccaggcactctccgagtcagtgtacatgaatgcacttggccctcttgatgctctatgagtaagtgctgctgggacacacccatttcacaggtactaaagctgagacagagatccactctgcaaacccttgcccagtgccactctggtaataggaagagtgagaatttgagctcaggcagagccactgtcggtggttttgacagaaattatggactctttctgaacttcctaatgagaatttaggaggctctcaggtgccccttcctgtcccactccatagtttggcgtacggactccgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcccggctgtgcccatatgctgacgttatcctccactgggtacaaaaaggatgacaggaaccctcctcatcacgctcgtcatctcagtaattccctgggagcttttgtttgttttttgttttgtttttctccctgcatctgtcttgctgttgctctcagtggaaaacatacaatatttctgacgtgcccaggctttgggccatgctgcaaatgtatcctgccattgtgaaatgaccttcactgcgctcctgcccagaatgtgtgggaagaaaagggcactcgcggtcccatgggccaaacaaaagagtggtctgggggatcctgtgctatgtagggacaggagaaggtgccaggactcctggtgaacaagacattccaaaggccaagcattgctaactaatgcaaggctgcaggagagaccagcaaatgacaatagccactctcctcagaaggacagggatgtgcccacgccggcttcaactctcccgcccaaccccagcacaagcagagctgagcgctcaggtcctcctccatccatgctgctcctgcaggcgggccccaggaggctggacctgctcttgcctgggtacagcaggcagctgagccccctcctctgacaccagcatcctgtgtcccagccctgcctccacagcttctcctcatcaggcctgccattcccacaccacagagcatgctgctgtaagaggccaggtgtgaagagcccttatgctctcaaccttgtctgatcagggtggaatgaggagtggaacagcgtagagcgcgggctgtctatgtcagctacaccggctaactccggcaaaacctcagtccttgggttagggagacaggtgacaaccccattcgcctctgagctagggaagtagagatgctctatacctgtgtccacacccctcagaggacaccaaaggtttcacagagagagctccacacacctctgaggttggatccagccacacagaggtgtctgctatgcagcaagctaaacacaaccaattcctggtgttgggattaacaagcagcagggcagaccacgagaatgaacatttatcaacagccatcgggaaacatgccctccagctctcacatgttctccaggctccctgggcaaatggagtcctaagtattttatattttttgagctactataaatgggattattatctgatttctttttcagacagttcattctcagtgtataaaaatgctctttatttttgtctgtggattttgtatcctgcaaatttactgaatttattagctctaacagtgtttttggtggcatctttaggattctatatgtaagatcatgtcatctgcaaacagggacaattttaacttcttttgttccaatttggatgccttttgtttcttccttttgcctaattgccctggctaggttttgcaatacagtgttgaaagaagtggcgagagttagcatccttatctggttcctgatcttagaggaaaagctttcagcttttcaccattgcgtatgatgttatctgtgagtttgtcatatatggtctttattatgttgaagcacatcccttctacagtatatctaatttattgagtgtttttattatgagaggatgttgtgttttgttgtatgttttttatacatctaatgagatgatatatggtttttatccttccctcaatgtggcatatcacattaatagagttgcatatattgaaccatccttgcataccagggataaatcccagttgatcgtggtgaatgatccttttcatgagctgttgaattcagtctgctggtattctttcgagggtttttgcatctatgttcatcagggattttggcctgtaattttcttttcttatagtgcctttgtcagctttggtatcacggtagtgctgacctcgtaaaatgagtgtggaagtattcctcttcttcagttttttggaagagtttgagaaggatgagtattagtccttctttaaatgttaggtaagatcagcagtaaagccatcaggtcctgaactctttttatgggagactttttattactaatcaaatctccatatttgttattggtctgttcagattttctgtttctccataatttttcttggtaggtatcatatgcttagggattttccatttcttctgggttatccaatttttggcatataattgttcatagtctcatggtcccttacatttctgtggtatttgttgtaatgtttcctccttcatttctcattccacttgacttttctcttttttcttagtctaaaggttttcaattttgtttatcatttcaacaaacaaactcttagttccattgatcttttctattgtttttctagtttcgatgtaatctctttctgttctgatctttattatttctttcctattagatttaggcttagttagttctttttatagtaccttgaggtgtaatattaggttgtttatttggattctttcttcttttctgatgtaggcatttatcactataaacatccctcttagacctgcttctgctgcatcccataggttttggtatgctttgtttttatttttatttatctcaagagatcttttaattctctttttaatttcttctttgacatattggtggttcagaagcatgttgttcaatttccatatatttgtcaattttctgaaattcctcctgttattaatttctagtctcataccaggatgttcagaaaagatgcttaatgtgatttgaatcttcttaaatttattaatgtgttttgtggcataatgtgatctatcctggagaatgttctctgtgtttcagaagaatgtgtatttgctaccattatatggtatattctgtatatatctgttatgtccatttggtctaaaagtatagtttaagactgatgtttccttattgattttctgtctgaatgatctgtccattgccgaaagtgggtattgaagtcccctactgctacattacagtccatctctctttcttcagacatattaatatttgctttacatacttaggttctccagtttttagcccatatttataattattatatcttcttgatgaattgacccctttatcactgtataatgactttattttacagtttatgacatgaagtctattttatttaagtatagcacttctactctcttttggtcttcatttgcatgaaatatctttttcatcccttcgctttcagtctatgtccttaaaagtgaagggaatctcttgtaggtagcatatagttgggtcctatttttcagccattcagccactctgtcttttgattagaaaatgtaatccatttacattcacagtaattattgacaggcagggtcttactaatgccattttgttcattgttttctggtattttctaagtcctttttcctttcatcctctgtgtctgtcttcccttatgattgggtgattttctctagtgatatgctttgattccttactttctatctttggcatatctactaaggtttttgctttgtagttaccatgaggcttacataaaaatatcttacagttatagcaagcttttctaagttggtaacagcttaactttgatcacatttttaaaatctctacacatttactccacccaccccacgcataaactttaatgtcacaattcatatctttttgttgtagctattatttaagaaatttcatagctatcactgtgatagttttctctttttaccttcatgctaaagacttaagtgatttgtacaccaccattacagtattattctgaatttgactgtatacttatttttatcagtgagttctatacttttgtatgttttcatgttgctagttagcattcttttctttcagcttgaagaactctctttagaatttcttgtaggacagctctggtggtgattaatccctcagcttttggttggctaggaaggtcttttcctctccttcatttctgaagaacagctttgccaagtacagtattcttggttggccatttttttccttcagcaccttgaatatatcattctactctctcttgcctatagggtttctgctgagaagtctgctataaaccttcctgtaactcctttatatgtgatttgcttcttttctctcactgcttttaagatcctctttgtctttgatttttgacagtttgattataatatatctcagtatagtcttatttggattcaatctaatcggagacttttgatcttcctgtacctagatatttatatatttccccagaattggaatgttttctcatattatttaaatatgctttcagtcccttggtctctcttctccttcttgaatacctgtaactcaaatatttgatcttttggtgttatctcacaaatcccataagctttcttcattcccgtttactctttttctcctctgactgtatgttttcaaataacctgtctttaagttcacggattctgtttcatcaattctgcagttgacactctctactgcatttttcatttcatttattgtgttttccacatccagagtttctagaatttttaaaaaataatttatacctctctgtggaatttctaattgcagtcatttactgttttcctgattttattgaattgtttttctatattttcttgaagttcatgaacttccttcaaacacttactttgaattatcgggccatttgtttatctccatttctttggagtctgctgctgggagattattgtggtttttggtggtgttgtgtctccttggtttttcatgtttgttgttgttgttgttgttgttgccttacgttgatgtctgcacattttgggaagtagggacttattctattctttgtagaatggcttcgcctgggtaagcccttcatcaataagcccatgcagattctgggcgtcatctggcatgctccataggtaggcttgctattggggtcctcacgcaggctggtccaatgcctgggttagcaggtgagtgagccttggcctggatccactggagtggacctgttgattgagtctgcaagggtgaacttagagcctggcatccgttaaggcaggactggtgctagggtaggccatatacctgagtctgaaggggctgtcctggggctaaggtgggcccagagcttgaatttgtgggggtgagcctgggtcctggatccacaagggttggcctggagcctaagtctgcagaagtggtcttggagcctctgtccaaaggggctggctggcaccaggggtctattggagtgggcctggactctgagttctggagcctggagcactggggaccagcctggatcctgagtccacagggacactcctggagcccaggtcagtgagggctggttcagtgctggggcctaccaggataggcctgggtcctgtctgctaaccatggagctgcagggccagcctggtgccagagatgatgtggagcctgaggccaatggggtcaacctgtatgcggagtgggcccagagactaagtccactgggcaggtgtggggcctgggcctgcatgatcctacctggtattggggcaggcctgaagcctccgtccttgggtaccagcctggagtaggaagctatgggggcatgtctggtgctgggtttaacttggttggtgggggatcaggaggcagttttagagttagaagcaaagtctggtactcacttctctttccttcccccacatagagggcatctctcaccacaacatgctgctaggcctgggtgagaggggacccagtcatgcaaaactgttttttctgccttttcagtgcatcttatttctgtgccatgcccaggtgctatcacctctcacctggtttccttagcacttgtgaaggtatttttgcacacagatagatgttcaaattgttgtttctgtgatggatgagcaatggagagtcctctcctgctgccttgctgatgtccatctctgacgaatgttgactatgtgactctctttaaaatattcagggaaaggagcatctgattctttaagaagtcagcagataaaatgtggatgctctttgacagaggaggaggaggtctgctgagccaagagcaggatgcagagatggggcatttctgctctggggtggggagttgagaacctcatggcaggaggagtttccaaggcttgccttcattccaccccacttggtgatgatgtaacagcttccatttgtgtttcacagttttcaaaatgtactcaccaggatcaacccacttggtcttcatgactcttttgatgtggatctagctgtgttgctttgtattattcaagatgtctaatcattttcacacttgagggttctagggatttttctgatactatccactcttcccttgatatacaaagtcatatgatacagaatcacacatatttgttgatctggagaaacaatagggatatgaggatatcatttattggaatttatattttgtttgggtttttttagtctaagctctaggagcttcccctcccccaattgttataaattaactagattttggttgatttctaatgttttccaaaaagtgtttattcattggtttttgtctttaaagttaagattcactgggtaaagtaaaatagagttctgtggcaagaaacaaccctgacagatgaaactgaccctggacagtgctgctgtctttggttgtctgacttattacttctgatttgtaataatttctgaggctgaatacagtgttaaatgaaattccctgtctgcaccaatgttcctgcactttgtaactcgattcttgacttcaaataaaagtgacttcttcatatagctttgccatttactcttagagccagctaacactaccagaaccctaacaaaatcacaagaaagtttaactcaagaagagagagatgaaagagggagagaaagaagaggggagtgtaaaagccatttccaaaacaagaggcccagacatcaatttgtaattatctgcccacatgagtctaaaggcttttatttgataaggccagtaatacacaagcctgtaatgtgaattatttcaaagaataaaagcctgattgtctccatgacctgtctagcttttagtgaggcttaagacaagattacattccatacagcccgcaaatggatccctcctctccccaccttcctgcttctttcagaaatgccagggttttctgtgctgccatctggtaagcttccagttccgataggtctcaatttcctcctctgttgagacatctaattctcctgagggtgacggttcttccttgtctgaaatgaagcttctattaaacaaagactgcccctattccaggatgttcaaaagcagatggagcccgcctcctggtgaggcttttccattaacactaaagaatgccctaaatcaagcttttcagttttaaatagggatgaagtctaactgacctcatactttaaaattaaaaggtaaaaactgtgggttgcatcagaaaagaaaatgcaagcttttaaagcattcacaggtaagccatgtagttttaatcctaagagtagtacagttgcattgcttaatggtaggggtacattctgagtaattcctcattaggtgatcctgtcactgtgcaaacatcacgggtgcacttacgcacccccagatgggacagcccgccacacacctgggctggatggtaaagcccattgtgcctaggctacaaatctgtcctacaagttactgtgctgaatgctacaggcaattgtaacacaaggttaagtatctgtgtatcatctatacattaaaaggtgcagtaaaaatatggtataaaagataaaaatgggccgggcatggtggctcacgcctgtaatcccagcactttgggaggtcaaggtgggtggatcagttgaggtcaggagtttgagttcagcctggccaacatggtgaaaccctgtctctactaaaaatacaaaaattagcctggcgaggcagcaggcacctgtaatcccagctactagggaggctgagtcaggagaatcacttgaaccacggaggcagaggttgcagtgagtcaagatcacgtcactgcactccagcctgggcaacagagtgacattcagtctaaaaaagaagattaaaatggtgcagctatatagagcactgaccatgaatggagcctgcaggactgaaatttgctctgagtgcatcagtgagggtggggtgggtgagtgtgaaggccgaggacattactgtacaccactctagactatcaacactgtatacttaggctacactaaatttataaaaatgttttttcttcaataataaattacctttaaatagtaactttgggctgggcacggtgactcacgcctataatcccagcagtttgggaagctgagacaggtgatcacctgaagtcaggaattcaagaccagcctggccaacatggttaaaccccgtctctactaaaaatacaaaaattagccaggtgtggtagtgtgcacatgtaatcccaggtactcgggaggctgaggcaggagaatcgttcaaacctaggaggcagaggttgcagtgagctgagatcgcaccactgttctccagcctaggtgacagagcaagactctgtctcgaaaaaaaaaaatagtaacttgtgtactttataaatgttttaactacttttaactttttcttataacacttagcttaaaacaaacacatagtacagcagtataaaaatagtctctttatatccttattctataagctttttcctatttacacttttcttccacttttaaaacttttttgttaaaaaaaaaaaaactaagacacaaacacacaccctagcctaggcctacacagggcaggctcatcaatatcactgtcttccacctccacatcttgtcccacaggaaggtcttcaggggcaatagcacatgtggggccatcatctcctatgagaagaatgccttctgccggcatatctcctgaaggacctgcctgagtctgtgtgagtgttagttttgctttttaataagtaaaaagagtgcattctaaaataatgataaaagtacagcaaatacacatgtaccgtgcacagctagactagactttcatacaagtgggagtgcagttggctcgtctacaccagcatcaccacaaacatgtaattcactgcactgtgacatcatgagggccacaaggtcagtcggtgacaggggttttcagctccactacaaccatatgggaccaccatcatgtacgcgatctgctgctggtggaaacattgttatgttgtgcttgctgtttacagtttctcaacatcacttgaacctacaagaatatctaaggaccttctgagacacaaaagcttgattctcaaatacataaaaataagaaggatttttgttttcccccaaagtgatgaaattacatgagagtttgttgttttcatgtctggctcccatattttttgtaagtttttcatgtaaattaaaggtttactctggcgtcaactattccctcctggcctggaatcacagacgttccatttcttccatctactcatttgggaataagtcacgtaattcccggccctcagctcctcaactgatatccctgagcaacagcatcagacatgcgtgtgcctctgacacaggaggatgcgagaggcagggctgagccaggccaggcaggagcaagcggggagggaggagtgttcccgggggagagtgagaggcaggaaagacatccagccacaaggagacctgggagcacgggtcgcccagaattcagtgtgcttctatttccacgctcatggttcacccacctttctgagggtccaagcccacggcacccgctgaccctgcctgtctgcccagacactgcaccacatcgtggttcacctgcctttctgagggtctaagcccatggggcccgctgaccctgcctgtctgcccagacactgcgccactttccacgcgcgtggttcacccacctttctgagggtccaagcccacggcgcccgctgaccctgcctgtctgcccagacactgcaccaccttccacgcgcatggttcacccacctttctgagggtccaagcccatggcgcccgctgaccctgcctgtctgcccagacattgcaccacatcatggttcacccgcctttccgagggtcagagcccatggcacccgctgaccctgcctgtctgcccagacactgcaccacatcgtggttcacctgcctttctgagggtctaagcccatggggcccgctgaccctgcctgtctgcccagacactgcgccactttccacgcgcatggttcacccacctttctgagggtccaagcccacggcacccgctgaccctgcctgtctgcccagacactgaaccacattgtggttcacccgcctttctgagggtctaggcccatggggcccgctgaccctgcctgcctgcccagacactgcaccactctccatgcgcgtggttcacccacctttccgagggtctaagcccatggagcccgctgaccctgcctgtctgcccagacactgcaccactctccatgcgcgtggttcacccacctttccgagggtctaagcccatggagctcgctgaccctgcctgtctgcccagacactgcaccactctccatgtgcgtggttcacccatctttatgagggtctaagcccatggggcccgctgaccctgcctgtctgcccagacactgcaccacatcgtggttcacctgcctttctgagggtctaagcccacggtgcctgctgaccctgcctgtctgcccaaacactgcaccactctccatccgcacggttcacccgcctttctgagggtccaagcccacggcgcccgctgaccctgcctgtctgcccagatgctgccccacatctccatagcacccagttgtgcactagcagctgaggtgagctgtcgaatcctcattttctcacttttcattttcacatcatcaggcaccttgtctgagatggttgcttagttaaataaacagaaagatgagtttggattgcttctgatatgggagatgggcagggaagtgctgggtggagaagggcgggtctctggcaagggctctacccctggacctttcccatgggcctaggcgaggacaggcatttttgtttttgtgcccaaatgttgcatttcccaagaccaccctggtccaccatgcctctatcctgtgcctataaaaaccctgagaccctagcaggcagagacacaagcagctccccaagaccctagtgggcaaagacacaagggctggatgtcaagaggagcacaccggcagaagaactcactgacaggcaccagcagactaggtagttggaggagagcctggctgctgagcggcccgactccaggggaaaactgccttcccagtccatctccctctggctcctgctgagagttacttccactctataaaaccttgcgctcattctccaagcccatgtgcgatctgattcttccagtacaccaaggcaagaaactccaggacacagaaagccccctgtccttgcaataaggcagagggtctaattgagctggttaacacaagccgcccacagacggcgaaactaaaaaagcaccctgtaacacacgcccactggggctttaggagctgtaagcattcacccctagacacggccgtggggtctgagcccacagcctgcccgtctgtatgctcccctgcaggtgggagcagtggggcactgaagaagcaacccactcctccatcgcacgccctgtgaggggaataagggaacttttcctgtttcacttcatctcaaccctcctgacccactctcttctgggtggcagttggcctttctgaggcagcagatggagccaagcatgtaggctgtggtcacagaggcacatggccacctggcccacaggaagaccatgggaagaccacaggtggacacgcccggcactcagggaactctaagggaggtggagcttgggtggtggagcagttggggtggtggggcaggagagaccagcagatgtggccgggggcaacatttggaatgtccatggatagcattccatccaaacacaaacgtgcgccttactagttcctctgcttctgaagcggtaacggtgaaaatcctgggagctctcaggatccagtcccggagggaccagcacagcacatatacagcttctgccaatggctgggcataagcttttaaaaactgatcatgtttcctagctacagaatgactttctcttcatttcagattgatcatcattcagagagagctgctaactctctggctttcagccgttctgtcctggtgttaacaatctgggaacctattctgaaatgtaccagagaaactctctgttcaaagggatctgccagaaaccctttgggaagggaagacgcccctggagccacagtgatgacactgcaaagtccgttcatttgtgatacggtatctccttgtggttcagcaaccctcagcccatgacctggtgagcttgacttgaggcttcattcttcatcagacacagaagcatcttgtcttgggaagggtcttcacgtacagccctcatttctcctttgactacaaaacccagcagtaaggaggggtctttcagagtcattaaggacaggtcccaaagaaatatggacttagtaaaaaatataatcaggtttcttgtaaaacagagaatggccaatgtttagaggttaagagtgctacaggtgcacaccacacgtgcctatgtttaaaataactaacccccatcctacctaaccacataccccagttatgctgttccctcacctctccacatatattttggagaatatcacaataggatggtttgtggacagaatgaatttcctattgtgaatgtggactactcttactgaagttacaaaacaagttgactgaaaatttaaggaatgcatgttttaatgaatatagactaactcaagttttctttactttttgagtcacttttatcaacttacaggttttttttctaattgccttttcaaatttcttagaacaaagtcattagtagtgttttcctacgattcttgaattcaatttacctatggtggaattccctttttcctctcattaattgtgtacttatgcccttttttgtcattgtcggtaaaaagagctctgtaagtcttttcaaagacccagagatatttctgctgtttgtgttcttgatgcttgccctcatttcttcgtacctatttcagtattttctgctcttgtcttcattattttcttctttttaatgtcttttgcttgctttgttcgtccttttattcttattatgaaacgtttcaggcacacaaaaaggaataaaataatatgacacaggttgaatatccctcatctgaaatgtttgggactagaagtgctttggatttcagatatgtttggatttattctggaatatttgcatgtacataatgaaatatcttggggacaggacccaagtcgaaacatgaaattacttgtgtttccttataccttatatagaaggcctgaaggtaatgttatgtaatttttaataattttgtgcacataacaaagtttatgtgccgtgaatctggaagaaaagaatgaagagcttgcgggggaggccacctctgaaggaatggccgagaaacttcccaagtgaaaaagctgtgaggcttcagattggaggagggcgcaagggcccagcaggatgtgccaaagttgtgctcgggcacatcaggaggaaatcaggccccacaatgtcacctccaagcacctcctggggttgcctgtcctctctcctcttcctgctgagcccctgggtccaaggacctcccaccttcaaaaaagtaaaaacagcacagcccagacccaggggtaaaattcatgtcatcacttcttcctgggccagcacccaaatacctcctgagccacaggaacacgatgcctctgtggccctgacagccactgccgattgtcctgggaggggccttcagggaaccgcacaggaaggagggtgcagctcagcccgttttcaaatccagcaggatgttcatgacctccctgcagacactaatggacagaacgtcacagcagtctggtgagcgatgatgtcagtgcattattaaattcaaactggaggggaagttttgacactaatcaatgctttttatcccacccaagactggcatattcccgagacaaatctcagtggttactgaatagcttgcagacctgggctgccctggggaaactgccatgcaagtctgtccttcccacctttctgcagatgcacgcagggctctcaggaagcaatttttttttttttttgagatggagtctcactctgttgcccaggctggagtgcaatggcatggtcttggctcactgcaacctctgcctcccaggttcaagcaattctcctgcctcagcctcaggagtagctgggactacaggtgcatgccaccacatccggctaatttttgtatttttagtagagatggggtttcaccatgttggccaggctggtcgtaaactcctgacctcttgatccgctggcctcagcctcccagagtgctgggattacatgtgtgagccaccacgcctgaccaggaagcaattttttttagctcattaacatggcaaagacagatagccagggccttctgagagctgtaaatgagcttctcacctctctgacagttttcagcagacatggattcctcagtcctagagctgctggctgcattcatccttcactgccacagagctccctcacctccctcaggaagtggcagagcagttggcggttcccaggccccccagggaagccctggcaggtgcttgctggggttgggtctttaccccagaacccagcaaaatgagcaccttggtctgggaggagaacgtccctgaaaggcccttggacagtattagcagctcaggggcaggttctggaaaggccttttccggttaacaccactgaatggttcatggggtcagagcaggcaaaacgagcaccatttcctcccaagaaacacatttttcccactgtctgacagttgaaaatatttgtttactttgtagaaacctaggatgttttggcagcaagcaatttatgtcactttgaaccacagagaatgcctctgaaatgatgatatgggtcaatgaagaagcaaagtttcttaactgaagtccatttcatagaaacaaatgcggaaatgattgtaattatgagggatgggcccactgtggcatttcccaatggtgacagtcaggctctacccctagcccttggagtcaaggccataaagcaaacggccaaaggtcccctcgtatcgtctgatccgacggctagggttggaaggtgggcagcctcacgggagcatggacctaggtagtcgccaggggcctgtgtgcagaaaaatttctcatttgctttgacacgctgctgttgctgtcttgaaattctcaaagattttatctcccaacctatattttgtgtgagacatcccatgaggcgacgtggtgcgcgcacctgcagagaagacaccccaatctgcacgcccacagcgcctcgcccgccacccagtcccgcagcgcctcgccccccacgtgtctgtctgtgctcatgtggccctaagaggccactcctctgcttacccagagcttgctgcaaaccacaaagtgcaacagtgttctaagaaacacaaacgaccaagggtcccaccctctctcccactcacattgctttcccacataagccaccatttatgctgaacgtggccgtgtggagggaggggaggtgggcagcccacagtccttctcatgtgtgagcaaaggtggagaatctcggtggacaggggctgtttcatgaagggaaataaacacagccgagtgagtttcacacagcatttccaccgctgtaatgagaatgaaatacatatgcatgtttgagctgtgacagatgaactatgtagttgttcagattctgcatgtgaattaaatgttctttcatttgcatttgaaaccagcaacgcacgatatacagatgaatggtaaccttcatgttaataattcaaaaatcttaatgtttttagaatgatgctgaatagcaaataaaaatcccatgacaagtcaagacggagattgtgaaaggaaacatcttatactataactagttcctttaggggcacttttccttgatttctgaactaaggacctgtatttgcactttgcacgggccgtgcaaattaaacagacagcattgcagggcatgaacacagacgaaccacgaccaactcagctgtcccgaggctctgtgttaacggctcctgacacactcccctcctccctgttctgatctgtttgcattaatatgcgctcaattgtaagaagctgaacagatgtatttattcagaattcccaagcagctaactagaactcccaattctgagtcatcgtcttagctcccgaggtgcttagcagaatgctctgtatttatcagcttcccggttaacctacacaccactccccagctcttgctggtttgagttatgtgaaccttcaacatcattagggaagcttctaccacacttagtactgataagcaaagtgcattcacacttcctgaggatttaatgagtggcaccatctaaattaatcttaagaacaatcccatttgctgggcgtggtggcccattcctataatcccagaactttgggaggccaaggcaggtgcattgcttgagcccaggagtttgagaccagcctgggcaacatggcaaaaccccatctctgccaaaaaatacgaaaattagctgggcatggtggtttgcacctgtagtttcaactacttgggaggctgaggtgggaggatcacttgagtccaggaggcagaggttgcagtaagccgagattgtgccgctgtattccagcctgggcaatagagtaagagcctgtctcaaaaaaagcaatcccctgtcccatgagatggtatgacctcctccaatctaggaagctattgattgcaagacagaccattactctagtactgctaaggaaaaacaaacccgctggcagttaaactatgatgtgctatttataaaagatgcctcctaatttcagtgatgggaaaacaatacacacctgagaaatgatgacattcagggtggtgggtactgtgacagccacactgctgcttcctggggactctgcatcctctccccagacaccagctgttgagggctaggggttagccgctgaatccctccccatcaccacctgagcccaagggaacagccactccctaagttacagtctcttgctccctggaggtgaaccaccatcagtgatccctcatgtgggacacaaaggcctagcccccagccttggttgggtcaaccctgaaggggaaccccagctccggctgcagagcacctcacaggatcagctcggtcctcttaaactgcattccagctcaccttctccctctgcccaattcagcttccctcacctgtacgggggttaccccagatcacccccagtcaccgactgcatgcaaatctctgtctcagagtttggtcccagcacattcaacctagggcatgtaggaccaccctcgtttcacgataaacaaccaaaacagggcagttacgtgatgtgcgtaagatggcacgactcacacgtgccgcagctggaacttaaactccatccggactccaaggccaccctgttgtctctccacaatcaatgctcagagcacagcctgcaactgtaagaggcccctaagctctttcaagtggtccatgaggccaaaactattttcataaaatactaagacatactttgcctttctcacgtgtactcttttatgagagaacttggaacagtccagaggctatgtggcaggaaatgacacagaatgagtgggaggcagagatgagaatccaagtgttttctgttaaatgaaacaatgagatatgcaaaagcgtgaaacaagaatgtaaaaatgtaaaacaaaaatgtcacacttagcacttttttatgttttggaaaatatagctactgtgtttataatgaaataattttatgatttattttaaagtgaattaataaacagcttttctaaagtgttggcaattttaatttctaaggtaacaaatgtggatagcactaacccaccaaaaaaaaaaaaaaaaattctttggagtcttcagtaattttcaataataggatgtgatcctgagaacaacattttaaaaatcacggctctgcactctgctgctgggagtttggaattccgctctccattccacaccagccgaaggaccccaggaacaccctgtaatccctctgtgattccgtctctttaatctgctaaataaagagatgtaacttccctacagcaaaaggaaagcaccagtagaattctgtaagttaaaactactgttaaaattttactgctctatactatatccagtattcccttctccattattctatgaaaattttaacaaaatgcattatactaatttaccatacaggattaaaatgtcattaagcttgcaatgtgtaaaccttaaaacagctggataaaaatttaagacaggaataagaagaaagccattcatattgttggtatataaaacaagcttcagagagtgttagtcccattttattcatggaagaaaataaatatgaagacactgaaatcacctggagaatttttaggagatgctgatggcaggcctcatatgagacaaatcaattcagaatctttgaagggtaagccccagacaccatggtttccgaggctcccaagttattttaatataacgtcagggctgacaactactgctcctgttgatgaagagggtcaaactctgaaaactatttgaagaaatgtattctgagccacatgtgggtgaccaatggcccaggccacagccccaggagagcctaagatcatgtgcccaaggtggatgggcttcagcttggatttctacacactagggaggcataagacatccaacaatacactaagatgtgcacaggcttggatttctacatgctagggaggcataagacacccatcaatacacataagatgtacacaggcttggatttctacatgctagggaggcataagacatccatcaatacacataagatgtacacaggcttggatttctacatgctagggaggcataagacatccatcaatacacataagacgtacacaggcttggatttctacatgctagggaggcataaaacacccgtcaatacactaagatgtacacaggcttggatttctacatgctagggaggcatcagacacccgtcaatatgctaagatgtacacaggcttggatttctacattctagggaggcataagacatccgtcaatatgctaagacgtacacaggcttggatttctacatgctagggaggcataagacacccgtcaatacactaagatgtacacaggcttggatttctacattctagggaggcataagacacccgtcaataggctaagacgtacacaggcttggatttctacatgctagagaggcataagacacccatcaataccctaagatgtacacaggcttggtccagaaagatgggaaaacactaagcagggtcttccagggcataggtgaattcaaagatttctgaatggcaattggttgagtttatctaaggactgggaatcggtagaaagagtgtctgggttaagataagggactgtggagaccaaggtttttattatgcagatgaagcctccaggttgcaggcttcagagagaatagatggtcaatgtttatcagacttgaaaaggtgccagactcttaattaattccctcttggatcagggaaaagacctggaaaggaaaagggattctctacagaatgtagacatttcccaggagagacagctttgcaagccatttaaatatatcgcagaaatatattttggggtaaaatacttccatttctttcagggcctgcaatctgccatgttggtaccttatagctgcaaaaggtctgctttgtctgtcttcacgcctctgttccaatgttaacgctggtcagctgtgcctggacaccaagggaggagggtaggataaggtgtgtccaaacaccccttcccatcatggcctgaactagtgtttcaggtttactttagagtgcccttggccaagaggaagggtccattcagctggctgggggacttagaattttatttttggtttatactctaaagccaagagtggcttctttccttcagtgcagaggaatccaacggatatttttaacaaggaaaggacaacagaaaaaatagggattcatttttatattagacaaaacatagagctaaagatagagggagagagggagggagggagacagtggtggagggaggtggagagagaaagagaaaaaaagatggatgtggccatggcagcattgtttttgggtattccccaattcccacataaaacagacggagcaactagacaaggaaatcaacaaaccaagatcacacttaaatcaaactgaagtgaagctgtccccagctagtgatccccaaggcgatgtccagatgaacgttgaggagaggaccagagaaaagcagccttaggaagtagctgtagacatcagtgaaaatggcaaagaaccttaaacattccctccttcataaaagcaatgagaaaaccacccaaaaatatcagaatcaacttttacagaactctggaaattaactaaaggctagcagaaatcagagcaatttactcaaaaaaaaaaaaaaagaaagaaagaaaaagaaagaaatggctgaatctcagcaagaacagcgaacttcctggcatcttaactcaccctatttccagctccctctcctcagctctgccacaggcttgaaaatgagcagcccacaatggcagtaaaaaccaacagcctggaagccaccagaaagcacagggtggggttagagtgccttcaaagccccattcccagagaattgtcactacttgacctgtctggttgttccctggaggacccactggaaaggctgtctttatttcatccaactcaaagctcacatatgtgaaaagtctttccctgggggcatttgttgaaaacatttagagacaatgttttacttaccagccacctgaggtagaggataatggttgggacaaacaataggctaaccagaaagcttgaaggaaaagctggaaaatgagatgtgcacaggtgctttgcaaagctctgacacgatccttggaatatggatggccacaacacatggagggctgtgtgcctgcccaggctgtgcacactcagggaagacatgaggctctaagctctcaccactggctgatgtagaggctctgggccagcatgaagtgaaggctacaacagagctgtgaactgcctgtctgatggctgaaggtatgccccacactcacacagaaccctcagcagagactgaggcttgtttctaggcatttaaggcaatctgtctggtcatctgaccactaaccaaactgagcagagacttggtggccacacatgatgaaaaaacacaaactttacagaattagttcagaatagtcactaagcaagcaaacaacaataaacagcaacaacaacaacaacaacacctaaggagagggaaattctggttttcaaagttgccacactatgttatttaaaatattgagttttactaaaaatttttgaggcattcaaagaaacatgcaaatgtgcctcttccacaggaaaacaatagaagctgttcttggggaagccaaatggcttacaagacaaagactttaaatgagctgttttttgttttttttttttttttttttttttttttttagacagagtcttgctctgtcatccaggctggagtgcagtggtgtgatcccagcctactgcaacttctgcctcccaagttcaattgattcccctgcctcagcctcccaagtaactgggattacaggcatgcaccaccatgcccagctaatttttgtatttttagtagagacggggtttcaccatgttgggcagactagtcttgaactcctgacctcaagtgatccacccgcctcggcctcccaaagtgctgggattataggcatgagccactgtgcccagactaaatgagctatttttaatgtgctccaaaaactgtaagaacaatgtctaaagagctaaataaaagtaggaaaatagtgtctcatcaaatagagaatatgaataaaaagatagaaattatatttcaaaaataattgaaaaattcagtacagcagctcaacagcagatcttagcagcagaagaaagaatcagcaaacttcaggataggtcaactgaaattatccagtctgaggaacagaaaaaaaaagaataataaaaaattagaaacctgtgagagaccatccaatgtactgagatacacgtaaaggaagtcccagatgtaggagaggaagaatgaggtagaaagaatatttgaagaaataatgacccaaaattcccaaaactagatggaaaacatgaatctacatatctaagacactcaatgaactccaagtagaataaactctaagacagccacacctagatacatcaaaatcagaccttcaaaacccaaagacaaagtaaatctaatgaaagcagtaagagagaagcaacttgtcacacatgttatggactagatatttgtcccctccaaaactcatgttgaagtttaatccctaatttgggagtatcaggagggaggaggaaactgggtcatgagggctctgccctcatgaatggattaatccactcatgaattaatgaattaattcatgtgggttatcacaagaggggacctggtgactttctaagaagaggaagggagacctgagctagcacactagcatgctcagcctcctcatcatgtgataccctgtgccacctcaggactctgcagagagtccccaacagcaagaagacccttacctgattctgcccctcaaccttgaacttctcagcccagatacctgtaataaataaattccttttctttataaattacccagtttcagatattctgtgataagcaacagaaaataggcaatgatcctcaataatattaacaactaatttctcatctgagactatgaaggccaagaggcagtggaatgatatattcaaagtcctaaaagaaaaaagtctatcaaccaagaattctatattcagaaaatcgatccttcaaaactaaaggagaaatcaatacattcccaaacaaaaaacaaagagaattttttccaacaacccttccctagcaagttctaaatggagtactttaggcaaaaatgaaaggacattagacagtgagttgtatccagatgaagaaataaacagcaccagtaaaggtcattatttagtaaatatgaaagacagaacaaatatttgagtatgtaacatttattttctcctaattttctttaaaaaacctgcataaagcaataattataaatccatgttgataaacatacaatctataaagatataattttcatgacaataacagcacaaaggagggaaagagaaaaaatgacagagagtgtttgaaaattaagttggtattaattcaactagattattataaagatcttaatgttaatttgaattaataattaaattaatattaacttggtgttaataaaattaaataatattaatcttctagcaaacactaagaaagcaactcaaaaaataatcaggaatgaaaagacattattactgatcttacagacataaaaattacaaggactatacagaaatactataagtaatcatatgccaacaaactagataatctaggtgaaattgacaaattcctatgaagacatgaactactgaagctgactcaagaagaaatagaaaatttgaatatgcctataataattaaggaaattcaatgagtaatttaaaacctcataaagaaaagcccatggtcagatggcttccatttgcaatagcttcacttcaaatgtttaaggaagaattaacatcattctttcacagtcttccaaaaaaaataaagaaagaatactcttcaattaacttgatgtgatggttaatattgagtgtcaacctgatgggattgaaggatgcaaagtattgatcctgggtgtgtctgtgagggcatttccaaaggagattcacatttgagtcagtggactgggagaggcagacccaccctcagtctgggtgggcaccatctaatcagcttccagcatggccagaataaaagcaggcagaagaacacaaaagtagtttagtcttccagcctacacgctactcccctgcgggatgcttcctgccttcgaacctcggacctcaagttattcagctttaggactcagactggcttccttgctcctcagggcctattatgggacctcaccctgtgatcgtgagtcaatactccttaaaatactcccctttatatacacatctatcctattagttctgtccttctagagaaccctgactaatgcatttgacaagttatgtattactataataccaaaaccaaagatatcaaaagattaagagatatcctttataaatacggacataaaaattctcaacgaaacactaagatactaaatccagaaacatataaaaagaattatacagcatggtcaagtaagacttatcccaggaatataagattagttcaaatataaaaactaaccaatgagatacactatggtcatagaatacacatgctatgatacagactgaatgttgacatcctccccaaacgtacgtgctggaattctgatccccagtgtgacagcattaggaggtgaaggctttgggggtaattaggtcatgaagacggcgcccatgcaggtgggattagtgtccatacgaaagagatcccagagcgctcccttgccccgtctgccacatgaggacacggggggaagatgccacccatgaaccaggaagccacccaccaccagacaccaaatatgggggagcctccagagctctgagaaatcaatgtttgctgtttcagccacccacgccatgtgatttttgtgacagcaactcgaacaagagaaaaattggcaccgggaagtagcagcacggctgtgacaaattcctaaaaatgcagaagcaactttgggtctgggaaacttgttgaggctgagtcttgaggtgtgtgctggaacaagcctccttcgccatggatgaatttttaaaagtgcttgtgttgagagatcaaaaggaagacaaagcagtatctcttagagaacagctcggccatcatgaatggaatgctgggaggatgcagacagagcattctgtgaggcctgggaaaggaggaacacactatcggacggtggagaagaggctgtgctcctcgcagagtggtgaggaccatggccgaatgcgttcatgctctgggctcctgtggaaggtagagcttgtgaatgaggaattggaaacagtgcacctcagtggcagagggcctcacaaatggccggccggagatgggggctgggtggaaggagccactgggcctgctcgggaggttcctccattgccctgcgcagcctgagccagacagagcgcaaatcccacggagggcgagccctgagccggacagagcgcaagtcccacggagggcgagccctgagccggacagagcgcaagtcccacggagggcaagccctgagccggacagagcgcaagtcccacggagggcgagccctgagccggacagagcgcaagtcccacggagggcgagccctgagccggacagagcgcaaatcccacggagggcgagccctgagcctgacagagcgcgagtcacacggagggtgagcaccacgcgtgactccaacacacccacctgtgctcaccagacgtgagccagacgttctccctccccaaccccacaccacacatctgcctggaggtcgggtagggggtggatctcagctcctctcagcaagaaggaaagcctccaagctccaagggcccaggatgggaggtaaaacaagacaggcgagcacagggagggcgcaaatagagtgggcaaggaggaggcagaacccggctcccctgacctgtgccggcaagcacgtccccagcagcagctccccggatgccatcccagccaggacccgtgcggccagccttggatttctgtgttccagtccacattatttagggatttattttccttctcttttaaggaatgataacactgttttatgtacatatttggtttttttgctttttgcttctgacatgcagctcaataagtcagaagattcttaccaggaaatgaatccacagtcgttttcatgacagcaaattgcatgccaacgagtgacatttaaatgctgaattttaatggcttgtcagaaaaagtgaaatgtatttaaaaaaaaatcatacatgagagagcagtgtgtctgcccatgaaataatgctgcctgtagtagacaagaatggtaaaaacacagtgaacgtattttgttctgtgatgtacacatctacctggaggaagaaggttgtgaaattaactcccatttaccctcctcttcgtgcagaagactctgaaggccgcgcaagcagctgtctgtcaatgaatctgacaactgcacctgcaagaagtggcctggatgaagacgacaggcagaagcacaggatcaactctgtttcaagcgcagttaccaagacagaatcatttctggaatcctgaaaaacctgcatatgaacatgctcacgtgtagacacccacacacatgcacacacacctgcacacacactcacatgctcatgtgtagacacccacacacctgcacgtgtagacacccacacacgcacacacctgcacacacatgtgctcacgtgtagacacccacatacctgtacatgcactcacgtgctcacatgtagacacccacacacatgcacacacacctgcacattcacatgctcacgtgtagagacacacacatgcacacacgtgctcacatgtagacacacacacgtgcactcattcacatgctcacatgtagacgcccacacaaggcaaacacacgtgctcacgtgtagacagccacacatgcacacacacctgcacatgcactcacatgctcatgtgtagacactcacatgcacacacacgtgctcacagacacccacacacatgcacacacacctgcacacgcactcacgtgctcacatgtagacacgcacacatgcacacacatgtgctcacacagacacccacacacatctgcacatgcactcacgtgctcaggtgtagacacacacacatgcacacatgcacacatacctgtacatgcactcacatgctcacatgtagacatacacacacatgcacacacccctgcgcactcattcacatgctcacgtggatacccacacatgtacacacacgtgctcacgtgtagacacccacacacacgcacagacacctgcacacacatgtgctccagtgtagacacccacacgcaaaacctccctactcaaacactccccccatgtgaggctgacaaaactcaggaagacaccaggatttgagattctttccttcaagtgtgcatgcatgtgtgcctgcctgcacacatgcatgcacacctgcacactcattcacgtgctcacatatagatacccacacacacacacctgcacactcattcacgtgctcatgtgtagatacccacacacgcacacacacctgcacactcattcacgtgctcacgtgtagatatcccctacacgtgagcatgggtgtgtgtgcatgtgtgtggatgtctacacatgagcatgtgtgtgtgcaggtgtgcatgcatgtgtggggatgtctacatgtcagcatgtcaatgagtgtgcaggggtgtgtgcgtgtgtgcatgtctacatgtgagcatgtgtgtgtgcaggtgagtgtgcaggtgtgtgcgtgtgtgggtatctacacatgagcacgtgaatgtgtgtgcaggtttgtctgcgtgtgggtatctacatgtgagcatgtgtatgagtgtgcaagtgtgtgtgcaaatgtgtctgtgtctacacgtgagcatgtgaatgcatgtgcaggtacgtgtgccttcgcagcatgcccaccttccagaagcctgcatcctggactagacacaccaatggccctggcaaccaaagaggcctcctgccacagggtcgtcctcctgccacggggtcatccccagggtttgctggaaatgcccaccccaggacacaccccacagctgtgtcagaaccagctgggaaggtgtcagcaattctgtgtccccacaatgcagaagatgacttttcactgtctagagagtccaacagcccaggacacacagtccctggggatggagctgggcagagggctccagctgcccaggccatgggcagttctgatacacctgggcagacgctcagccagggcctgagcaagactggagatgcagggctgcctgggacctctgtctctatgcaaggatacctacgaccccccatctccacatggggctgcctgggacccccctatccccatgtggggctgcctgggactccgtctccataaagatgctcttatcctcaagaacaggtgccaggaatgtggacatagcctgacactcggcacaatattaattttctctgagatggttttccttaggagttaccttttgccattatttggttagattattgtcatgtaatttaaattcatggatatatgagacaaactagaaaaagctattgctttaaaatcataggtgagaaaactcatctctgttggggaattcggggccactagatatttttctatccctccttttgaaactcaccttaaatttcttggtttttttctagtttgtcaggctgagagtcttgtgcattctctggtttcatttcatcccaggacgcccacccaggcagggccccggagcccttgtggcactagctcccatgacaagggagctcaggtgaactccggcaccctgcccccgccacatctcagcacaggatagcacagaaacgtgatgatgttcagtgccagttgccagcacatggtgatagctacatacatacctagagccgggctgaaattacgctcaggggaagttctgaaagagtcacgcccattctcattgaaagacccctggcctccactcgcacgtccagccatcagagtggcaaaagctcatctgtttgctccttaaatgaggcttttccctcttctcaagataataaagtgaagggtgaaacacagagtaaggctcacaagacaagcaaactcagaaaatgtgacacagttgaatatttacacaaccttccttcaatatggctcgctccatgtttgtccctgcgtgggcagcattccgtctgtgtcatctacattgatacccatatctacgtgccctgccaagcctggcactggcctgcgcacagcaccccatcgccaaacgacagtggcacatatggagcaggagctgggcccaagccgccctggaggctcccgtggggaaagggctcaggagtccagtgtggcctggagtgtgcatcagggagctgcccggcgccctggcccacaccgccacacgcgtttctctcaacccgcagtttggctttgtggagggttccccatggactttgggctcaggtgacttgggctttgtttgtgggtggttctgtgtaatgcacaggcaccacccaaaagcagacacgtgtagcactacacaccacccatgctgggaccccctgaaggacagaggtgaacccggaacccctgtaggacagaggtgaacccgggacccccttaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggacgccctcaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccttgaaggacagaggtgaacccaggacgccctcaaggacagaggtgaacccaggaccccatgaaggacagaggtgaacccaggactccctgaaggatagaggtgaacccgggacgccctcaaggacagaggtgaacccgggacccctgaaggacagaggtgaacccgggacccctgaagaacagaggtgattggaaaccctcctgtgagcagaatctccagcagtgcacctggctggtgattccgcctggaaggagaaacggccagatgtgtgattacttatgaattaatgggctgtggccagtggtttggctggagggccagggactcggagagaatatggttggaaacattgttgacaagggcaactggggaagagacatattagatagacgtctatgaagtggtatgaagtactaagatatgaatgtcccgtgtgaatgttctccaaagagtgacctcagcagaggaggattttaataaccaagtggatagggtgacctgttctgtggacaccagtcagcctctttccccagccaccctgccgttgccccatgggcccatgaacaaggtggtcgcggtggcagagttggaggtgatgcctgggctcccactcaacaaggccagccctgctgtggccacccttgagtccccagtcagccaccacaaagaccatccctgagtccccaacatgacatcattccccgaggtgatcagccagccgccggggggcaggtggttccgcaggcagcttcccctgtggaaggggtggggaatggtccttgctggactagacgcttactccagatgtggatttcccttccctacgcacagtgctcctgccagaactaccctccgtggagtcagaacgccttatccatcaccatggtgtccacacagcactgcttctgaccaagagccctcacttcacagtcaaagaagcgcagcagtgggccggtgctgtgggaattccctggtcctaccatgttgccatatataatttttaaattatcataattttaaaaattatcttctcatcacccctgcagggaccacctgcaacaaaaatttcacaacagtgacaggcagaggctgattctctccaggccgagccacgcctgcactggacccagccaggcccagataagcagccgacgcctgcctactttgtgccaggcccagctgcgggccactgcagcctcctggcatctcctccctcagacacaggaggcagcaggcctgggctcctccaaacccaggaacggacgatcccagtaggaagcacccatgagcccagcgcccggctcccacctgccccttccaccaccacactcgtggattcagtccgtcccagctcctcaccgcccaggaggagaagccaagcccgtgcggtcgctcagtgcggcagccgccgagcctcggcccacgcccgccctacctgtgccggaaagcttctgcaacgccacgcgcaggcgctgcagggccacgggcgacacctcgtagcggtaaaagtccattgccggaaccttctggcaccttccaaacactccatctgtgagaagggaaggagataagacagaacgagacgtttcattttcagagagcaggaaggtgtcacacacgtccttgcaatgcgttctgatcatgtgccgccgtgaggttttggagcacggcgtcaccagagggctgttaggacccgggagcacccggaggatgctggtttgtgagataaaaaccgagcatcacggaaaacacaaatgccaaggtggagagaaagtccagtgtggctgcaatgttgtcactccactttcctccataccccccgagccctccttttatgtaatttcacattttttatgtaaaacttgcctctgacaactcagtgacaacaaaaaaacaaagtcaataacattccaggccagttttccagatgaaaaacagaacacccaggaaatataaatattactttgcaggagctacaaggatcggcggagacgcctctccctgggctgcgtgggaggcaagcacggcttcccgggctcctttccggcggcgcaggagaggcgcggggctggcgaacggtgtgggactaatggggactaatttatttagctcgattccatttgtctgaaatggcagactctgctcatcaacatcctttccaaccacaccttctaattaatttagtccccaattagtctttattcggcgaattgttcactttgagacaagcttcctgtggggtttcaaacattcaaattaccttctttggtgcacacaaaaggttaattcaggcgctactgcttccacacagggcggccatctgcagcttcgggcggggcggaaggggaaatggtctcttttattgttcactaggtttcgccgtgcagcttggctgaagaaagccattcaaatgcaacaagtgtaattagcagaaacacatttgcccagggccaggctgacggtaattgctggtctgatattgcatatatgctcacgacgacggggccgggtgattagcagaaaataacctcgagtattgcaagcgtcctgcgggtttctatgggactttgcaaagcccagggaatccgggaggcagcctggcagctgcgcgggcgggcggacaatggcaaggaggagacgccaggcccgcgccgtttccctccgtgcagcccggccgcgccgcctcctgtccgagagccggcccgagatgcctgcgaggccacacaaaggcggagggctctcggggacgcgtctgcagagcccggcgccccccaccgtccgtgatggacaggccgcaccacaggcgggaacacaggcagatgtgcccgctcctttgccttcctcagacacgcaccattcagtgcaagcaggagtgggaaaggggggaggagggagaaaggggcaaagagggaaaataaggagcgacttcaaacatacccagtgttcctactctgcttttcgaatgaaaatatcttgaaaatagaaaggcaacaagcaggaactgggcagcacgtcgagacggcccagctcccgtgctcacaatgcagaacaatcctaggcctcaggaccaaggcctggggccccagaggagggagtgagccacgggccaggaagaaccaaaagccaggttcctggacccccaagcggggcccaagtcagtgaccacctaatcctaggccagggccggcggcctcttccgatccctgaggccagggaggctcagaagcccagggctccactcagccgcagagcccgcgagctgcactccccaccctcagaaggaaggcgctctcggccggccccagagcagtgacggtgccggctgcctgcagctccccggcctcttgcgcacattggaaaatgcacccccggggtggacgtgcgtggccagctcagggcatggcagagcctggctggtccgggccccactcggccactccgggtgtctgcacacagggcttggtgatttggtgccaaatataagagaagcacatctgtgagtagccaacgcttcgcaacatgcagctgaggatccccttcccaggcaacctcatcaaatcattcagcttttcataaagaaaaatggcccaggacaattcctatcaattttggaacgttccaagcaaagcatttctcaagcataacagcctcattctttaaattttgtttcttgcatacaatgtcataaatatattttaaaattatattagactttcttgaaaactttcttttaaacatttatttagaatatatacaatataatgcataatatagtttgtgcttttaaaatcagttttagctaataattttagctacttgacagttgaaataaactaaccattgattctctttgccttagactatccctgtgctgaatgcagtggacacagacaccatccccagtgcattgttaatagactttatttttagagcagtttagattactgcaaacttgagtggaaagtagggatattttccatgcatcctcacacatgcacacacacacacagcctcccacacacacacacagcctcccacacacacacacacacagcctccctcacacacgcacacagcctccctcacacacaagcacagcctccctcacactcacacagcctccccccacacacacagcctccctcacacacacagcctccctcacacacacacggtctccctcacacacgcacacagcctccctcacacacgcacacagcctcccttgtacacacacagcctccctcacacacacacagcctccctcacacacacacacagcctccctcacacacacagcctctctcacacagcctccctcatacacacagcctccctcacacacactcacagtctccctcacacacacagcctccctcacacacacagcctcccttgtacacagcctccctcgtacacacacagcctccctcacacacactcagtctccctcacacacacacacagcctccctcacacacacagcctccctcgtacacagcctccctcgtacacacacagcctccctcacacacacacagcctccctcacacacacacacagcctccctcacacacacacagcctccctcacacacacacagcctccctcacacacactcacacagcctccctcatacacacacacagcctccctcacacacactcacagtctccctcacacacacacacagcctccctcacacacactcacatagtctccctcacacacacacacagcctccctcacacacacagcctcccttgtacacacacagcctccctcgtacacacacagcctccctcgtacacacacagcctccctcacacacacacacagcctccctcacagggtatttgcagatattaattttccacttttttgggtaaagaccaacacgagtgactgctggctcatatggtaagagtatgcttagttttgtaggaaaccgccaaactgtcctccatggtgacaatcagactaacagtggccgtgccatttttcactcccagcagctgcgatggcacccccatcgcccatgtcctcaccacagtgacaatcagcctaacggtggccgtgccatttttcactccgagcagctgtgatggcgcccccatcgcccgcatcctcagcagcgccaggtggcgtccgtgttcccgcgtcctcggcagcgccgggtggcgtccgtgttcccacgtcctcggcagcgctgggtgacacttggaggcgtccatgttccagcgtttggctgctgtcataggtgtgtatcggtatctcatgattttttatccaatgcatttttcaacaatgatattcatccttatctccgtatttaaaggacttcatgatgtgggtgtcctttattctagtaaatactcagcaataaggcttgttgaagatgattgtgaccagaaggaaggagcccagaagctcccacagatcatgcccaggttcgctgctacctgcttgattttaaggggatactggattcccccaaatatggatacgtgcctagcagtgaaatagaaaattaaggaaatttctaaatacatctggtagaattgatttttatgtggccagaattttgaaactattgctttgttcttccgggtcacttggctaataggcaggaccccaaaaggtctctatgaacatactagagaaaaggactggaaagtcaaatctcaatcaggaaagcatcaggtgcgatgagactccggagtcgggacgccaggggtgatctacacagcaggggtgccggagccagagaaccaaagctcccaccagtccaggctgagctccaccgtctcagacgtgcagtgcggcctctgaaacaatcccgggaagtggcacactgaagtcgcctcaccgccgaccatttaatcaccctagaaaccacccagagcccgtaaccctcaggcccctcctctgcgggactcctgccttcgtgttcttgggacacagccaggaccccacctgggatctgagcttgcttggggtttcctcatgaactctcttctacttcggactctgtttcctgtgccatggccctgcagcctgtcgacatgaccctatcgtcgaagcccggactgacccgtccagctctgcagccctgcgggccatgctgagctcccagctggaagtgcatcaccgcaccgcagtggaggcaggaggccttgggtgatggagcccatccacgagactttcagaaccagggtcctgctcttcgtccagaacgggcattccatgcgcaaccttaattccaagtctcactgctggcaactgagttcaaattgggggctgtctgaaaatcatgggagatgagaacaggtttgcctatgaaaactgtgggctccctgtccacccgtccttggctactgtcaccatcaaaacactcatgtgtgcaaatatatgtgtacgtgtcaatccttatacagaaacacgtgcacagctgctaactcatacacgcacataagcacagccgctaacgtgtttaactgccaaacttactgtgcgtgcccaaggatgccgccaatccaacatcataaacccttccggcaaacagacactgcccgtgcctctgcgcggaagcctaacccccaggtgctcctcgatgacggcttcgtgccttctccctctgtcttccctgcagcgttgggtgctctcatcaacgaggctcatcatctctgtccccagcattgcctgagccttgcaaagccccttcctgttctgggagcaggtcagtgctatgcctgctgcttggctgcctccgccccacaccctcgtcccagggaagccacagctctgccctgcatcctgcttgcatggccaggccaggacagccgggagacacgcacacagaaaaagcagacactgcaggctccatgctccagagcttccaggatcctggggcaacagatgttcaccactgatggttcggttataattgtggacaggctgcaaaaaagggcacgagagcacctgacagagggcactgacctcacccagcggtcagagaacgaacagcggccgacctgaggacatcgaggacactccaggctaagggagcagctccgtgcatggcagcatccagccccggtgggcgacggggagggagcagttccgtgcatggcaacacctggccccagtgggcggccaggagggagcagctccgtgcatggcagcacctggccccagtgggcaacggggagggagcagctccgtgcatggcagcacctggccctggtcagccccagtgggcagtggggacaaggccttgcagttctggatcaggcaggagaggacaccaagctggtcaagccactcaagcagattgtgcagagcctgcgggaatcagaggcagtggccttcatcccaggagctagaggaggccacctccacttgggtggtgttccaggcagggcaggctcttgaatgggtctgcgttttaaaacagatctccctggcaagggctggagattgccaggagcccatggcgggtaaacagagcagccccaaccaggggatggtggctaagtgaggatggtggtcatggagaccagagacctggatagactggagccatctgcaaggtgaaccttaggacaacacacatccctctgccggcagcagcaaccaggcctttccacatgctacccagcccatgcacagacaggcttgtgggggaggggaatattctgggagacgttctgtagaatgagtctttttccaaaacaggaaggaaggcaggcttcttgctgccctggctgggagaggcgagacatggaaggcgtcccccgacaagaattctgcctggcctggaactccgatatcagggactcaacgaactggggggcctcacacccccagagttctgggatgcaacccccttcactgtgcagacagaaggctggaccccacagaactccaatctcagggactcagtgaaccagggggccccacatttcagagttctaggacgcaaccccttcactgtgcagacagaaggctggaccccactgcctctgggaccggaatggacagtgctaaagacagtgagagaaggaatgcccaggatgcagagcagcggatgaacagggcccaggacaatggacacaaaagctttgaggagcaaaaggtttgcttagagacacttttattaacagtaatctagaattgggtggtcagtttctttcatttgaaagaaaatattgagcattttctgtggttggatttttggagaaataagaaaaagagctcatttatcttggtaatttgttttaaacagtggtccttagagcactgttcccacaggccaaagtaatttcattcgcaagcgtcactgtccccaaaacacaaacacaggcctcctccaggaccaagcttccagcccacttctattctcatatagtctgtggggctgcatacctccctccaaccttacaccacacgtgtgtacacggtgcatgtatgcacattcatacctgcatgaaccaacacacacattttcacacacttctcccatgcacgggacactcacacatacacacactcacacgcacccacgtgaacattccaacacatgtacacacacacaagtgtgcacacactcatttgcatgcacttgattatgcagacacacacacaggagcacgtacacacacatttgcaaacgtgcacacacacacacacacacccagacacactaactcatatacaggtgcacacaagcgcacatgcacaaactcacacgcccacacgcgtacgctcacacacagtctccgcatagacaagacggcacctcgcctctaccgccctgcaggaccaccctctccccggtgacaccgtgagttcctggaaggcagggatcacagctacagcctcttcacgcccccacagcatctggtacagtgccttgcccccggtgtggactaaaaggatgttagtgaatgactataactggtattttcccatttgtctaaaagaaaatggagatgtccgtggaagtgtttaagaccatcagctagaagcctcatttgttgaaatctcacatagatttacaagtcctcacccctggcagtgacccacttggatgaaagactcactggggaccaaaaaggctggtggtgggggcaccctaggaggggctggcatgagtctcgcaagttctcaggtggccatgcgcctccaccccatcccgtactgtctctctgcttgggctcagagggccgattgacccccagcatttctatccccagctccataagtgaagcaggtgatcctagtggacctctgttcttcagagtaagggtggggctctgctgcccagggtgcccccagagggtcctgttgcttggagatactgagcctccactctctgtgacacccatagcactgacccagaaccatccaattggagcaccggaaagctgtggaccgaacaaggtggctttgataccctgtgaggaaagtactcttgccacactttgcttaggtgatacgcccaggcctgcactaaacgacatcccgagtgacacgtccaggcctgccctagaggatatcctaggagaaatggcccagagacgctaactgtgcatctgctgagaaacgtcactcactgcgttaccccacaattctccacagagatccacagggggtcccccagtccccacaattatccacagagatccacagggggtcccccaggccccacaattctccccagagatccacagggggtcctccagtccccacaattctccacagagatccaagggggtcccccaggccccacaatctccacagagatccacagggggtcccccagccaggagcatcttccttccaccaaacgccgtgaacacgaccagctcctgggcagggacacctcctgcttacaggcgcctgtggcacagattccagtgaactaaccatctgcttttcccctttttctaatatctttacctacttttacttatatgtctttttttttttaacatttcttatttatttatggaaatataacaggacttgggaattaatgaatacaatatgatcacttaatttagtatttcaaagtgaggcaattagcttagggcattgtttgaaataaccacaatgcgcatacctattcaatcatttgtgtaaacagcatattaaggtaaatggtatgcacgtgaaaactgatttatctcagctgcctggaaactatcagaacaaagttcttgaattgtgagcaagaagggatgggcagaaaaggcaccccaattacgaagcctttgcagatgagaggcgtgggaggctgtattccgacaagaagggcaggcgagagacacccggcaaaccaccgggcaggcagaaccccggcggagcaagcactagcacgttccagggctgggcagggactgcgaccatttctagaatcgtcacaaagccatcgctgagacagacactcaggtttgcagaatactgtctacagtaaacaccaaatgcatccgctcttgcggctgccagctgaccctgcccagacaaaaggaacgggcagtcagtctcacagcagctccctgggaacacacctgggaagcccaggaggggaacgcggcctcctgggggtgtcccaggcactgaacccagagcctagaaacagcaacgttgcagggctcagggcgcactttccagagagaatgggaccacatccagggccccacaggccatacccgccgcaggtcttgagtctggcagccagggagggagcacagccgcctctcatgaaacaatggcaccctgctgtgcttcttcaagctggtctgtcactcactccctccctgcatccaaacaaggcaaggcccagaggctgcggtcacccaggtggccagtgagcaccaagcagcaccagtgacccctcgtggctgcctccctgcagtgccagttcttcatccgagacatcgctcaggagccctgctctggctcaggcctgaagatgccagtggcagactcagtcggccagtgtgaggggccaggagacgagacactgctgcccagtacagcaggagaattaatgcacacttgtacacgtgtgcacaatacacaagcaaccacatacacagacattcacagcatgcacacacaatgtatgcagacacatgcacatatgcagacacacaaccacataatgcatgcacattctcacatacacgtcctcacacatgctctcacaggcacacgttctcacacacatgcacattctcacatgcacacgttttcacacatgctcacactctcacatgcacacacatgcacagtctcacacatgcacacatcctcacacatgctctcacatgcatacattctcacacacatgcacattctcacatgcacgtttcacacatgctcacacactcacatgcacacacatgcacattctcacacatgcacacatcctcacacatgctctcacatgcattctcacacacatgctcattctcgcatgcacacgttctcacacatgcacacattctcacacatgcacatgctcacacgttctcacatgcacacatacacattttcacacatgcacacacgcacacattcacatgcacatacacattctcagatgcacacacatgcattctcacatatatacacattctcacacatgcacatgtacacattctcatctgcacatacatgcacacattctcacatgcactcattctcacccatgcacattctcacacaagcacacacatacacactcatatccacacacgtgcacacattctcacatgcacacacacatgctcacattctcacacatgcacacattctcaaacacacacgtaaacattctcatatccacatacatgcacacattctcacatgcacacacgtgctcacacatgctcacacatgtacacattctcacacatacacattctcacatgcacacacgtgctcacacatgctcacacatgtacacattgtcacacacacattatcacatgcacacacatgctcacacatgctcacacatgtacacgttctcacacacattctcacatgcacacacctgctcacacatgtacacgttctcacacatacattctcacatgcacaagttctcacacacatgaacattctcacacacatgcacatgtacacactatctgttctcacatgctcacacatgtacatgttctcatgtacacactcactactcacactcagaatagcagaaggagccctcaccagcctgggaccgccatgctccaggtgtcctgctgtaccaggctaggtcaccctttcattctttcctgcctcccctgctggggtccctcaggaccctgcctctctcccactgccccctcctggtggaggctgccttgccaaagtaccttcaatctgtaaatcccggtgccctgggacactggagctgcctctgaagtcccctccctgcagggagctggcagcgttgccagggttccctcggtcccatggggcttctcaaagcagcaccacagacggaggagcccactgctccatcagggtccccaggggtgcagcaacaagaaaaaaatctccccagctatttttggaggagggaaaagtaattacagctcagaatcactgccctgttgaaaggaattctccagagggagaaaaagccctttatctgaactgatcaagcacctgccatgcacatttctgcaaggaagctgtaaaagtgctcccattctgcaaggaagctgtaaaagtgctcccattctcagggagtagaaactgctgtcatggcatccagtcataactgctgcaaaaattccaggaggccaaaggtgaatcctgagagacagcaatggcttctgaggcccaaggaagcaggcactggctcaccacacacccaggtcagatttaaggagccgttggatccgtgggctgcgtccaaggcaggactgctgtgaagtctgagcagcttagttcgtaatgaaacctgaagataagccgagaccctatatcgctggaaattcctttattttcaaggatttcgttacagttcagagcagccactgacaggcagcagaaggcaggggacagagtgacagtgcctgggagcggccagcacagcctatgcatctgcagagcagcgtgaggctctgactggggaggagccccacgtccgggcagcacctgcacccacagcgggagcctcactgtccggagaggccagcttcccttgtgtgaggagcagggcccccattcctcccaccacccagatcccagtgaggcctgggatggtatatccaggagaggccagcttcccttgtgagtgtgagtgacgtctgcaggtgtcaggtcttatggtgagagtgtgggtgtcagtgacatctgcaagtcactaggagcggggcctccattcccccccccccgccacccagggatcccagggaggcctgggacagtaaatccaggagatcccagcttccctgagcgacaagcgggacctctgttcctctcgccacccagggatcccagtgaggcctgggacggtaaatccaggagaggccagcttcccttgtgagtgtgagtgatgtctgcaagcatcaggtcttatgatgagattgtgggtgtgagtgacatctgcaagtcactatgagtggggcctccattcctcccgccacccagggatcccagtgaggcctgggatggcaaatccagcggcgcacagcccactgcaccgagggaggcgcacgacagaagccacagcttgagggtgtgagccggcagtactgaggagcccagcagacaccggccaggcggggcagggggaagcgtggcgggtgggaggcccttctgggaggtgaggagcaggctaggaggggaggacagtgaagacagtgccaagaacacagccagtcatgcctccctcacggagcaccagcgcgcccagcacttcccagccttttacctttaaggatgccttaaacccccaccccaagcccatgaggctcctcctccatgcaacaggctgtgtgccgaaaccagccccgggtgctgctgttagcaggcggacggctgagaggcgaggaggtggggccttccttacacaggccccaaggacggctcacgctccagccacatgaggacacgtgaggaggcaccgtcgatgagccaggaggggactcgccagacaccagacgtcaaccctgccagggcggtgaccttggcttccagccttcagaactgagaaatcaatgtctgctgtttctaagccccgcaataggtggtactttgagcagccttcatggactaagacactgcgtattattatcccattgacgccatgtggaaattaaggcacagggaggttaaggaacttgctcagagttggcctgggagtcgcaacccaagatctgtccacatggtcccacttcaccgctcgaggctgtgtcctctacggagactcactttcactttagactgtagatgccagcgtctgactgagaaaatgcggtcaccatagctacatggagtgactggcagagtgtcctattctgcaaccaactcacaaaatcctcaggtcttgtatggcgactctcaccataagagctcacgcccgcagacgacactcacacccacactctcaccataagaggtgacatctgcagacgtcactcacacccacactctcaccataagagctgacacctgcagacgtcactcacacccacactctcaccataagagctgacacccgcagacgtcactcacacccacactctcaccctaagaggtgacacccgcagacgtcactcacacccacactctcaccataagagctgacacctgcagacgtcactcacacccacactctcaccataagagctgacacccgcagacgtcactcacacccacactctcaccataagagctgacacccgcagacgtcactcacacccacactctcaccctgaggtgacatctgcagacgtcactcacacccacactctcaccataagagctgacacctgcagacgtcactcacaccaacactctcaccataagagctgacacccgcagacgtcactcacacccacactctcaccctaagaggtgacatctgcagacgtcactcacacccacactctcaccataagagctgacacccgcagacgtcactcacacccacactctcaccctaagaggtgacatctgcagacgtcactcacacccacactctcaccataagaggtgacatctgcagacgtcactcacacccacactctcacaataagagctgaggcacaaagaggtcactcacatccatactctcaccataagagccgacacgtgcagacgtcactcacacccacactctcaccataagagctgacacccgcagacgtcactcacacccacactctcaccataagagctgacacccgcagacgtcactcacatccacattctcaccataagagctgatgcccgcagacgtcattcacacccaaactctcaccataagagctgacacctgcagacgtcactcacacccacactctcacgataagagctgtcacacgcagacgacactcacacccacactctcaccataagagctgacacccgcagacgtcactcacatccacactctcaccataagaggtgacacctgcagacgtcactcacacccacactctcaccataagagctgatgcccgcagacgtcactcacacccacactctcaccataagagctgacgcccgcagacgtcactcacacccacactctcaccagaagagctgtcacacgcagacgtcactcacacccacactctcaccataagagctgacgcccgcagacgtcactcacacccacactctcaccataagagctgacacccgcagacgtcactcacacccacactctcaccataagagctgaggcccacagaggtcactcacacccatactctcaccataagagctgacacccgcagaagtcactcacacccacactctcaccataagagctgaggcccacagaggtcactcacacccatactctcaccataagagctgacacccgcagacgtcactcacacccacactctcaccatacgagctgtcacccacagacatcactcacacccacactgtcaccataagagctgacacccgcagacgtcactcacacccacactctcaccataagagctgaggaccacagaggtcacttacagccatactctcaccataagaggtgacacctgcagacgtcactcacgccgacactctcaccataagaggtgacacttgcagacgtcactaacacccacattctcaccataagagctgacacctgcagacgtcactcaaactcacactctcaccataagagctgtcacgcacagacatcactcacacccacactgtcaccctaagaggtgacacccgcagacgacactaacaaccagattctcaccataagagctgacacccgcagacgtcactcacacccacactctcaccataagagctgacgcccgcagatgtcactcacactcacactcccacgataagagctgacaactgaagacgtcactcacatccacactctctccataagagctgacaaccgcaaacgtcactgacacccacactctaacgataagaggtgacatctgcagacgacactcacacccacactctcaccataagagctgaggcccacagaggtcactcacacccatactcccaccataagagccgacacctgcagatgtcactcacatccacactctcaccataagatgtgacacctgcagacatcactcacatccacactctgtccataagagctgacacccgcagacgtcactgacacccacactctcacgataagaggtgacatctgcagacgtcactcacacccacactctcaccataagagctgaggcccacagaggacactcacacccacactctcaccataagaggtgacacctgcagatgtcactcacacccatactctcaacataagagctgacacctgcagacgtcactcacacccacactctcaccataagaggtgacatctacagacggcactcacacccacactctcaccataagagctgaggcacaaagaggtcactcacatccatactctcaccataagaggtgacacctgcagacgtcactcacacccacactctcaccataagaagtgacacctgcagatgtcactcacacccacactgtcaccataagagctgatgcctgcagacatcactcacacccacactctaaccataagagttgacacctgcagatgtcacttacacccacactctcaccataagagctgaggcccacagaggacactcacacccatactctcaccataagagctgatgcctgcagacgtcactcacgtacacacttctcaccataagaggtgacacatgcaaacgtcactcacacccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgaaacctgcagacgtcactcacacccacactctcaccataagaagtgacacctgcaaatgtcactcacacccacgctctcaccataagaagtgacacctgcagacatcactcacacccacagtctcaccataagaggtgacacctgcagacgtcactcaaacccacactctcaccataagagctgtcgcccgcagacgtgactcacacccacactctccccaaaagagctgtcgcccgcaggagtcactcacacccacactctcaccataagaggtgacatctgcagacgtcactcacacccacactgtcaccataagaggtgacacctgcagacgtcactcacacccacactcgcaccataagaggtgacacctgcagacgtcactcacacccacactgtcaccataagaggtgacacctgcagacgtctctcacacccacactctctccataagaggtgacacctggagacgtcactcacacccacactctcaccataagacctgacactcgcagacgtcactcacacccacactctcaccataagagctgatgccggcacacgtcacacacacccacactctcactataagaggtgacacctacagacatcactcacacccacattctcaccataagagctgacacccacagacatcactcacacccacactgtcaccataagagctgaggcccacagaggtcactcacacacatactctcaccataagagctgacacccgcagacatcactcacacacacactctcaccataagagctgaggcccacagaggtcactcacacccacactctcaccatagagctgacacccgcagacgtcactcacacccacactctcaccataagagctgacacccgcagacgtcactcacacccacactctcaccataagagctgtcgcccgcagaggtcactcacacccacaatctcaccataagagccgacacccgcagacatcactcacacacacacgcgtcactcacactcacactctagccataagagctgacgcccgcagacgtcactcacacccacactctcaccataagaggtgacacctgcagacgtcactcacacccacactctcaccataagaggtgacacatgcagacgtcacacacacccacactctcaccataattggtgacacctgcagacggaactcacacccacacatgtcactcacacccacactctcaccataagagctgacacatgcagacgtcactcacacccacactctcaccataagagctgacacctgcagacgtcactcacacccacacgtcactcacacccacactctcaccataagagctgacgcccgcagatgtcactcacacccacactctcaccataagaggtgaaacctgcagacgtcactcacacccacactctcaccataagaggtgacgcccatagacgtcactcacacccacacacgtcactcacacccacactctcaccataagaggtgacacctgcagacgtcactcacacccacactctcaccataagagctctcgcccacagaggtcactcacacccacactctcaccataagagccgacgcccgcagacgtcactcacacccacactctcaccataattggtgacacctgcagacgtcactcacacccacactctcaccataagaggtgacacctgcagacgtcacacccacactctcaccataagaggtgacgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactgtcaccataagagctgaggcccacagaggacactcacacccatactctcaccataagaggtgacacctgcagatatcactcacacccatactctcaccataagagctgacacctgcagacgtcactcacacccacactctcaaccataagaggtgacacatgcagatgtcactcacacccacgctgtcaccataagagctgatgcctgcagacgtcactcacacccacactctcaccataagagttgacacctgcagatgtcactcacacccacactctcaccataagagctgaggcccacagaggacactcacacccatactctcaccataaaagctgatgcctgcagacgtcactcacgtacacacttctcaccataagaggtgacacatgcaaacgtcactcacacccacactctcaccataagaagtgacacctgcaaacgtcactcacacccacactctcaccataagaagtgaaacctgcagacatcactcacacccacagtctcaccataagaggtgacacctgcagacgtcactcacacccacactctcaccataagagctgacacctgcagacgtcactcacacccacactctcaccataagtgacacctgcaaatgtcactcacacccacactatcaccataagaagtgacacctgcagacatcactcacacccacagtctcaccataagaggtgacacctgcagacgtcactcacacccacactctcaccataagaagtgacacctgcaaatgtcactcacacccacactctcaccataagaagtgacaactgcagacatcactcacacccacagtctcaccataagaggtgacacgtgcagacgtcactcacacccacattctcaccataagagctgtcgcccgcagaggtcactcacacccacaatctcaccataagagccgacgcccgcagacatcactcacacccacacacgtcactcgcactcacactctagccataagagctgacgcccgcagacgtcactcacacccacactctcaccataagaggtgacacctgcagacgtcactcacacccacactctcaccataagagctgacacatgcagacgtcactcacacccacactctcacaataattggtgacacctgcagacgtcactcacacccacacatgtcactcacacccacactctcaccataagagctgacgcccgcagatgtcactcacacccacactctcaccataagaggtgaaacctgccgacgtcactcacacccacactcaccataagagttgacacctgcagacgtcattcacacccacactctcaccataattggtgacacatgcagacgtcactcacacccacacgtcactcacacccacactctcaccataagagctgacgcccgcagacgtcactcacacccacactctcaccaaaagagctgacgcccgcagacgtcactcacacccacagtctcaccataagaggtgacacctgcagacgtcactcacatccacactctcaccataagaagtgacacctgcagacgtcactcacccacactctcaccataagagctgtcgcccgcacaggtcactcacacccacactctcaccataagatccgacgcccgcagacgtcactcacacccacactcgtcactcacactcacactctcaccataagagctgatgcccgcagacgtcactcacacccacactctcaccataagagctgtcacccacagacatcactcacacccacactgtcaccataagagctgacacccgcagacgtcactcacacccacactctcaccataagagctgaggcccacagaggtcacttacagccatactctcaccataagaggtgacacctgcagacgtcactcacaccgacactctcaccataagaggtgacacttgcagacgtcactaacacccacattctcaccataagagctgacacctgcagacgtcactcaaactcacactctcaccataagagctgtcacgcacagacatcattcacacccacactgtcaccctaagaggtgacacctgcagacgtccctcacacccacactctcaccataagaggtaacacctgcagacgtccctcacacccacactctcaccataagaggtgacacccacagacgtcactcaaacccacactctcaccataagaggtgacacctgcagacgtcactcgcacccacactctcaccataagaggtgacacctgcagacgtcattcacacccacactctcaccataattggtgacacctgcagacgtcactcacacccacactctcaccataagaggagacacctgcagacgtcattcacacccacactctcaccataattggtgacacctgcagacgtcactcacacccacactctcaccataagagctgacgcccgcagacgtcactcacaaccacactctcaccataagaggtgacacctgcaaacgtcactcacacccacactctcaccataagaggtgacgcccatagacgtcactcacacccacacacgtcactcacactcacactctcaccataagagtgtgacacctgcagacgtcactcacacccacactctcaccataatgagtctcgcccgcagaggtcactcacacccacactctcaccataagagctgacgcccgcagacgtcactcacacccacactctcaccataattggtgacacctgcagacgtcactcacacccacactctcaccataagaggtgacacctgcagacgtcacacccacactctcaccataagaggtgatgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactctcaccataagagctgaggcccacagaggacactcacacccatactctcaccataaaagctgatgcctgcagacgtcactcacgtacacagttctcaccataagaggtgacacatgcaaacgtcactcacacccacattctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaactgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctgcagatgtcactcacacccatactctcaccataagagctgacacctgcatacgtcactcacacccacactctcaaccataagaggtgacacatgcagatgtcactcacacccacgctgtcaccataagagctgatgcctgcagacgtcactcacacccacactctcaccataagagttgacacctgcagatgtcacttacacccacactctcacgataagagctgaggcccacagaggacactcacacccatactctcaccataaaagctgatgcctgcagacgtcactcacgtacacacttctcaccataagaggtgacacatgcaaacgtcactcacgcccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaagtgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctggagacgtcactcacacccacactctcaccataagacctgacactcgcagacgtcactcacacccacactctcaccataagagctgatgccggcacacgtcactcacacccacactctcactataagaggtgacacctacagacatcactcacacccacattctcaccataggagctgacacccacagacatcactcacacccacactgtcaccataagagctgaggcccacagaggtcactcacacccatactctcaccataagagctgacacccgcagacgtcactcacacacacactctcaccgtaagagctgacacccgcagacgtcactcacatccacactctcaccataataggtgacacctgcagacgtcactcacacccacattctcaccataagagctgtcgcccgcagaggtcactcacacccacaatctcaccataagagccgacgcccgcagacatcactcacacccacacacgtcactcacactcacactctagccataagagctgacgcccgcagacgtcactcacacccacactctcaccataagaggtgaaacctgcagacgtcactcacacccacactcaccataagaggtgacacatgcagacgtcacacacacccacactctcaccataattggtgacacctgcagacgtcactcacacccacacatgtcactcacacccacactctcaccataagagctgacacatgcagacgtcactcacacccacactctcaccataagagctgacacccgaagtcagtcacacccacacacgtcaatcacactcacactctcaccataagagctgacgcccgcagatgtcactcacacccacactctcaccataagaggtgaaacctgcagacgtcactcacacccacactcaccatgaggtgacacctgcagacgtcattcacacccacactctcaccataattggtgacacctgcagacgtcactcacacccacacgtcactcacacccacagtctcaccataagagctgacgcccgcagacgtcactcacacccacactctcaccataagaggtaacacctgcagacgtcattcacacccacactctcaccataattggtgacacctgcagacgtcattcacacccacactctcaccataagagccgacgcccatagacgtcactcacacccacacacgtcactcacacccacactctcaccataagaggtaacacatgcagacgtcactcacacccacactctcaccataagagctgtcgcccgcagaggtcactcacacccacactctcaccataagaggtaacaccttcagacgtcattcacacccacactctcaccataattggtgacacgtgcagacgtcactcacacccacactctcaccataagaggtgacatctgcagacgtcactcacacccacactctcaccataagaggtgacacccgcagacatcactcacacccacactctcaccataagaggtaacacatgcagacgtcactcacacccacactctcaccataagagctgtcgcccgcagaggtcactcacacccacactctcaccatagagctgacgcccgcagacgtcactcacaccgacactctcaccataagagctgacacctgcagacgtcactcacacccacactctcaccgtaagaggtgacaccagcagacgtcactcacacccacactctcaccataagagtgtgccccgcaggcgtcactcacacccacactcaccatatgagctgacacctgcagacgtcactcacacccacattctcaccataagagctgtcgcccgcagacgtcactcacacccacactctcaccataagaggtgacacctgcagacgtcactcacacccacactctcaccataagagctgacacccgcagacgttactcacatccacactctcaccagaaggggtgtcacctgcagacgtcactcacacccacactctcaccataagagctgtcgcccgcagaggtcactcacacccacactctcaccataagagccgacgcccacagacgtcactcacacccacacacgtcactcacactcacactctcaccataagagctgacgcccgcagacgtcactcacacccacactctcaccatagagctgacacccgcagacgtcactcacacccacactctcaccataagagctgacacctgcagacgtcactcacacccacactctcaccataagagctgacatctgcagacgtcactcacacccacactctcaccataagagctgacacctgcagacgtcactcacacccacactctcaccataagagctgacacctgcagacgtcactcaaacccacactctcaccataagagctgacacctgcagacgtcactcacacccacactctcaccataagagctgacacctgcagacgtcgctcacacccacactctcaccataagagctgacatctacagacatcactcacacagtcaactcagtcagtccttatgataacccttagtggcataaactgtcatggtccccattccatattcagaaactagagcccagagaggttgggtgccttgctggagcccatagaggaatgggcagcggcaggaaagtctgactgacacttagcacccatgagggaggtacggaaacaggatcaaccattccagaccaccgggagctcaggaaacctcatcatcgtgctcacttgagccaagatccaggaaatattaagtccttaggggcttcaaaagcgaaggagaacggcagggtggacaagtgctgggttcttttcagccagcacatgccgatgaccagctctgcgttgcagtgagctgagattgcgccattgcactccagcctgggcaacaagagtgaaacttcatctcaaaaagaaagaatgtaaccatcaaaattaaaacttctgtgcatcaaaggacactattagcagcaggaaaaggcagccagggagtggggaaatatttgccctcatctatctgataagggatttgtatccaaaatacataaagaaccacaactcgacaacaacaacaaaaaacctgattaaaaacgggtaaaggacctgagtagacttttctccagagaagatgtacaaacagctgaaagcacagggaaggcgcccagcatcaccagcgtcaaggcaacgcaaatcaaaaccacagtgagacctactgcccgctcagcaggacatctgctatcaaaaaacgaaacgaagcaaaaccgaaaataacgcgtgtgggtgagaacatggagaaaatagggccctgtgctccgcgggcaggaacgtaacctgatgcagtcgccgtggaaagcacacgggaaaagttcaatgtggaagtagcagatgatccgacagccccatttgattttacacccaatacctgcaagcagggctcgcgcagaggctcaggcagccatgctggtggcacatgggctgtcgcgactgctcccggtggaatcagccccatttctgattttacacccaacacctgcaagcagagctcgcgcagaggctcaggcagccatgctcgtggcacgtgggctgtcgcggctgctcccggtggaatcagccccctttctgattttacacccaacacctgcaagcagggctcgcgcagaggctcaggcagccatgctcgtggcacgtgggctgtcgcggctgctcccagtggaatcacagctacaatcgagctcaggtaaaggcttccatggagggtctagactgcatttccaggcaccaggatgagtttaaattcagctcccaaagaagaccagtgaacacaccaatgaacatacacttcacactgccacaccccaagataagacccagaaactcacattcagggaaagacagcccctcttacatgccacccagacccccatacgagagtgtcagaccccagcaccttccaaaaacacaaaatgtccccctgccgaggagccagcacctgggcccttagaagccgtgacaacgagcagcaaagcgcagggcctcacccaagagatacccaggacagcacagacgggggaagctccagcaaccccacacaggccccaagaagccaccagccagaccaggctcgggaagagctgtcttcagcaggaacaaggcagtttagtaactagaagcaatatgggatggggctgagccatcatcaggagctccgtccagtggggagcattggccccagtcgcaggcaagggaggctgtttcaagtttaggcctccagaagaggcagctcctcgaccaaactgaagacacataatttcctgttaaattaacacttgcaacgccttgcacccaggtcttgaatgctaattatactcgccggcatttaatacaagacaccctggagtctgggctgaaatgccacacaggaatctggaatcgcataaaacgtggaaaaccagacttttctagcccaagaatgagtgagatgtaaaaatcaaagaggtcccacacgtaacccaccaagaaagaacaagtgaggctgtgttgctggaggtggtcgctctccccaagctcagtcctgacagaaatgacgctctgacggtgcacgatttgcaatgtgcaggaacagaccccagcacctttcatcggtgggtttaggagaggggcccaggggaccctggcactcctctgatgagaaatcaggcaccagcttgtgcatctgtttccctggaaatcactgcttccctgttggtttgcacatgtcctgtcagccctgtgaggtgagaacccagaagctgatggacgatacccaaaacagagctttaggcagaagacagcttggacccaaggcctcagttaggccatggagggaaagtatggtgcggacacctgggaccgcagtgggcgggagaaattctggaggataaaatgttgggccccagtgctccatctctgagggtggaccctgctgcctgggagcagtcctggcaggacccccacagtccacgtgactgatggtctaggcctatgtctgctcaactatgatggcataaacacccctcccagcagagccttgaaactaaagaagtcatctgagtgactagacgttaacaaggagagaaaacctaactgcctgtctcctggccaacgggaagacaggttttttgtcttactttgggttttgtcttaatttgggttttttgtgggctactctggtaaccagagctttgtctggagacagcgtgttcttataggaggccacagagggttttatgaagagtaagcttcggaggctcaggaggacttgtatttttgagcagggtggagcaagagaaagaacaaagacaaaggccaccggttttggaagccccaggtagaaggagacagggtcttccacccccgtggaaaaacctcctgaagctacaagctggggccaaagctggtgtggcagcagtggtcacccagagctttccaatgccgtccactcatcccaggtggggaaactgaggctgaggaagcaaaatgacttggtcacacacattttataatttacaattgtatatatatatgggtgtccattttcacacagctataaagaactacccaagactaagtaatttttgaagaaaagagatttaattgactcacagttccacagggctggggaggcctcaagaaactagtcatggcaaaaggcgaaggagaagcaagcaccttcttcctgaggcggcagaaggagtgggggtggggggagtgctacacttttaaaccatcagctctcatgagaactccctcactatcacgagaacagcgtggtggaaaccacccgcatgatccagtcacctcccaccaggtccctccccaacgctggggattacaactcaaggtgagatgtgggtggggacacagagccaaaccatatcaatgggtacaaggcaatgctatgatttatgaatacaatgtggaataattaaatcaagctagttaacatatccatcacttcaaatacttaacatttttgtggcaaaaacatttggaatttgttctctcagcagttttgagatgtataaccgtctactgttatcttcatcacactgtacaatcgaactcaaaaaattgcccctgagatttgtgccctccacctgttatctccccattccctccacccctggcctctggcgacctcagttctactctctgctactgtgagttcaattgttttcagttccacatatgagtaagatcatgcggtatttgtctttctgtgcctggcttatttcactcagcgtaatgctttccaattccatccatgatgctggaaatcacagaattccttcctttttaagactgaatagtatcccactgtgtctttatccatccatctgtcgatggacatttaggttgattctatgtcatggccattgtggacagtgctgcagtaaacatgagggtgcagatctctcttcaacatgctgattttacttcctttggataaatacctcatagtgggattgctagatgatatggtagtttgttgtttgagaggcctccatacagttctccataatgactgtaccgatttagattcccaatagtgcacaagatttcccttttcaccacttcctcaccaacacttgctgtctttttaataatagccattctaacaggtgtgatatgatatcccattgtggttttgatttgcatttccctaatgattagcacagttgagcatcttttcacatacatgttggccatttttatgtcttcttttgagaaatatctactcagattctttacctgtcttttaattgggtttttcattttcatgctattgagttgtttgagcttattatatattttggatattaagcccttattggatgtacagcttgcaaatattttctccccatccttaggttgtctgtgcactctgctaactgttttgtttgctgtgtagagctttgtatttgatataatcccatttgtttatttttgattttgttgcctgtgctttggggatcaaataaaaaaaattgttgcccaggataatgttatgtcattttgccctgtgatttcttctagtagttttacagtttcaggtcttaaatttaagtctttaatcccttttgagtttttgtatgtggtgagagataagttctaatttcattcttctgcatgtggatatccagtttttctggcaccatttattgaagacactgtccttttcccattatgtgttcttgccacttttgctgaaaatgaattgagcataaatgcatggattcatttcctggctctctattctgttccattagttgatgtgtctattttgttttgttgttgccagtaccacgttgttttggttattatagtttcatagtatattttgaaatcaggtggtgtgatgcatccagctttgttcctttggctcctgattgccttggctattcagggttttatgtggttccatatgaattttaggattgcttttctatttctgtaaaaaaaatgccattggaattttgataggggttgcactgaaactatagattgctctaggtagtacggacattttaacaatattaattctttcaatcaatgaacatgggataccttctatttatttgccttgtcttccatttctttcaccatctcatagttttcagtgtacaggtctcaccgtctgggttaaattaattcctatctattgcagtcacacatttttttagtggcagcactcaccttcttgagtgaaccatggaggttgtggcatttgcttgtcaagggccttgcattcctgggggtgccccctctgctgttgtggtatcctaggatggctgtcaatccctaaacttgctcccttgcggcccaggagccacaagaacatctcattccctgcccagtcactggtcaggtgcaggccctgacccattccaaaccacggccccctcctacatgcttttctctggtggaagattctctcttttcatgcagattggttgctaagccctgtgaacaggagtgaacaggtggacaagcagccatcccaacaccacacaaagagagagaaactggagacaaaagcagcggggagatgctgcagatcccggccactgtgccagagccaccctgggttcgccattcacagccccagagccaccctgggttccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagtccagtatgccccacgtgagtctgtgttggcttctgtcacttgcagtcctgagtgctgagctgggccaggcccccaacacctgaggtccttccctccctcacagagttttcatgctcagttgtgaggtatggtgatggccacaggcccgaatcctaaccaccacagcacaggacttctcaaagagaccgtcactgtgtctcctgccccaacaaggtgaacagttctgggatgctaatccccactcactcattccatccccatcctggagcctcctggacagattccatcattaccctccctcaggaggaggcagtgctgagggtggcccacgtcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggcccctgagggcagtgctgaggatggcccacgtcactgtgctccctgggtggtccctgagggccccccgggccacatgaggcccacccccttcctgatgtccaagaacaagggcgttactagcgctcacgtgttcccctttgcagactaggtcacaggatacagcacggattccttccggcaaaaggtgctcagtaaagtggattgcagcatcctgtgtctcccctaaaacatcctcaaacagaatggctgcaccaagatgtatgggatctgtaccaagacatgggtaaaaagaaggccctggcatgttcacctgattgttactcaaaagccccacagatggaggctccattgagcattgaccctgaggccctaagagttgctgcccgaggagagatgctcaacatcagccggcacttccatctccgctccctctggcaggaacaaactccactgaaacaggcggctctttcccaagcaggggcaggactggctggttgccgtgttcccaggaaacatgtacagggtacctgcttcacccaggaagtgcagggaggttggaatgaaacctcagaaggatggagaggctgctcagaagatgctgactgcgggcctgcttctggtgtctgactgccgtctgcacccagaatctgcctgtcaattttgtcttcaatgattttgaaactcctgggggtgagggagctggagacaaatagtgacttagagtcccataacacatttgtccccatcaccccattggatctcagggctgcctgtgagccaggctgtgcaggaaggaaggtgccagagctgctgcctaaggtgccctagggacaggagagcccctgcctcctgccggccactggatccacgcccagtggatcagtcgctcatcaccggccaggccagtgcctcgcctcacctcacccagcctcacagttcagatgaggaaacagacccagaaggagcaagtagctggattctaggctatcaacaaaatgccaaaggcagaaaaaaccctgattttccaaaagggaaaaaaatgttggaatacaaatcaatttgtctgctgtttaccaaagctcattctctcccccagcgtttccaaatcccacccggcacacctgtggcccattcaggtgccagttccgtcaactgcctggaaatccctgcagagaacaacggcacacctgagcctcttccagagcccacagttatcccattacgaaatgaaaagctgctttggggaatgctgtgttgatgtgtcagcatcaaactgttatgcgggaggcagaaggacctcaccgacggcatctctcgccacctcgagggcacgggtgaggtgcaggaggaactcgtgctaccacctccacccacccccaggggttctgccccttcagaaggagggtccaggagggggactcacccgctggcaccattggccactgcacactattccccagctccctcctactgcaccccatgagccaccctcagttgggccccatccctgagtcccttttgggttcctaattgttgggcacagtctaagcccagggctccctgcaggcctgcagctgtctggggcgactcgtacactgtacctgctttccttcgttgctcacacagcagccgacacagtcactcaaaactcccatttgtgaaagtaagtggccttttaaagaatgctaaaacattacgggcactttagccccgcgtttcttactacacgaaacatggttacctacgagtgaaatggcagaaggaatgaccttattaacgcctcatccttctcaagggcaagagagtgcaactcaacaactccatgtgaacacctgccctggcatgcaggcagccgggccagtccacagccagtcacggccccacgggaggagccttctgagtgacagatatcattttcattcaggggggcttgaactctggccatcagaagagctggttactacaaaggtagcagaacaggaagtactgagaagaaagtgcacctttctgaccacccactcccagcccagctcccctcctgtctgctcgcctcctgtccgctcccctcctgtccgctcccctcctgtccgctcccctcctgaccgctcccctcctgtccgctcccctcctgaccgctcccctcctgtccgctcccctcctgtccgctcccctcctgaccgctcccctcctgtccgctcccctcctgaccgctcccctcctgtccgctcccctcctgtccgctcccctcctgtccgctcccctcctgaccgctcccctcctgtccgctcccctcctgtccgctcccctcctgactgctcccctcctgaccgctcccctcctgtccgctcccctcctgactgctcccctcctgactgctcccctcctgtccgctcccctcctgtccgctcccctcctgactgctcccctcctgtccactcccctcctgtctgctcccctcttgactgctcccctccctgccagctaccctcctgaccgctcccctcctgtccgctcccctcctgaccactcccctccctggccagctactctggagcaaacttacacaagcacacagcaggacccaaggatcagcttcgataggcattttccagaagtgcattagaatggctgcttcaccctcctgtgatgatgcctggaccctgaggtgggtcaggcccctcccgtgctgcagccgattcgtggctggattaaacttcttattgccccctgaaggtgaggtcaggcagcagaagcatcgtgcagctaggaatagaaggctctgggccccacacatttcagagaggcgtaattggggtaggctggtattggtaatcctgagtacaatattgattgacaaaaacgaatcacacctgagcctcaaagctcttagcccttccctgcaaagaaaactctctcttagaattaccaaatatagctttcaatcccttcaatctaaatgtttcaggtgagagcagagatagatttttcgaatggagacattaacctttctgagctgcagctgcctggctctctctgcctgttactctgtttctggaacatggcagctgctttcgccgcaccagggcctgcaccaggccacccagttacattcaggccaccctgggccaataggccagacactcgctcctattccgggtctcctaacagcaggccaacagatcacaccctgttagtatttagaataatcaagatttttatcagaagttgaagagaacagcagcatgtatttcactcaggacccttcattttacaaataagaaaactgaggtcctccacagccgtgctgcccactgggagcaccccctgcctcacaccacatcatccaataccacgatgcagatgtggtcctcactcttggccctgatggggcactctagcatcccactgttttccttaatagaaaacaacacaatagaagttaaggtcagagtcaaaagatgacacatcactcggggctttataaaatccaggactcatgtaaacaagtcctaaaactatgagtggacattcacttgctaagcacaatgttgaagttatggctgaaagcttactttacatttgcctaagaccacacttgtcatacacacctaaaaccatctgctgtcttctgagttctattaaaggacaatgagaaaacagcaattgaaatggggtttctggttccaaacggcaggacaggagcaagctgtctcaccaccccagcagaaacctgaaagcaaacatgcagtgctgagatgctgagatggtcaccagcaacatctgagaacccagaggtgaggatgagtcaggtcctggggccaccaggaacagaaaaaccccgaacagacagacagcaggagaaccagacccccacatctgcaaggcccctccccataacctgcctggcatccagtacacaaaagattttcccttgacacagtttctacacttagaaaggtgagataacaacagcttgccctgctcttgggtgccctggcaggagacctctccctgcctcaacccatggggagcatcctgagtgcctgaagggagaaacagccctgaggatggccagagacaaaggtgggggtggggctactgtccccagccctggaaactctgctctgcaactcggccaaaggaggcactcaatcagagtggccactcgcagccccacgctgcaggacctgtgctcccaggtcccctcccagccttcccacgttatcaggacatcccctttgggacatctgctttgggacaggcagcactttcatcagtgaccagagctgagttgaacctgggcttaaggcgccatctagtgccaaaaaggaggctgcaacctagcaagaaaacactccacaggtaaatcacaaagaatctttaagcaaacataccccagaaaaaccaaaacacccagacagagaagagataaataaataaccgttcagtgccaagacacagacacacatcaacaaaccagaaagcagcagacgggaccatggcctccccaaacggacaaagccaagaaccagtgactggcccaacaaagtggcgatttgtgagctctcatcaagaaatcaaaatggcagccctaaggaaactcggtgatccccaagataacaccaggaaatcaattcagaaagttaacaacagattgaaataatttttaaaaatcagacagaagtcttgaaacaaaaatacatttagcgaaatgaggaaattcatgacaagctcccaacagcagagtggcttaagcagaggaaagaatcagtgagctcaaatacacaatcagaggaggaaaaagaacaaagaatgaaagacaacctacaagatagagaaaattacctcaaaacaccaaatccaagaattactggtgttcaagagggagctgagtgagaacaagaggtaccaagcttactcaaagaaacagtaacagaaaactttctgaaacttgagaaaggtatagataaccagattcgggaaagtcagagaacaccagattcaacccaaatatgaccacctcaggcttttaataattaaactgtcaaagctcaagggcaaagagaagaccccaaaggaagcaaataacatctaaaggagctccaatttgtttgtcaacagacatctcaatggaaaacatacagaccaggagaaaatgggatgatactttcggagtcttgaaaggaaaaaaaaaaaaaatctgtcacccaagaatactgtatccagcaaagctacccttcaaatacaaagaagagataaattctttcccagacgaacaaaagctgagagaattcatcaccaccaaacccaccttacaataaatgctgaagagatctcttcattcagaaagaacaaaaatacatcgaatggggcactaagagggcagattctcattccaccttgccaccagcctgctgtgcaaacttgggcaaatcacttcacttctctgtgcttccatttcctaaattgagaccaatgaattcggtattttctaggatcctttccaatcaaatgttctgtgtttgcatgatgatagctagggtgctgcagcataagtgtctgtaatttagcttttgtgagctgtgaacattgcctgcctctctctcactctcctgccagctgctcacactgtgtcatctgtccgtttgtgtcaacagagaactgaggaaatgcaactgcagtgcagccctgcaatgggctggccaccagcaacaacggcaggagaggcaggagcagtcaggcaggctgggccccagaagcacgcagtggagaagcccgcagcagtgcagagggatgtccttatgagccaggacagagtcccctcatttgctggactctgcagaactacactggctgcatccaaaacccagtactcaccaccagatggcaacagggagaatctgcgtgcacaggagccagcctgaaggaagcatccagggaacgcaggggaagagcgtgagcgtgaaccccaagatgatggggtgagacctcgctcacaggcagatgcgaatcctccacgtggggatgcgggaaggctgttcttgccaaaggctgatgatgaccctgctgcctctctgcttatctgccctcgaaacagaatgtggttccaggcgccaccacccagcctagcagccgtcatgggcccacagtgattgagccctcaatcaaagcttttttattattatggaaaattacaagttttttcacaatgagttttcacacacatataaatcaatggaaaatgtcttcttggctgtctttatggtatttaagtaaatgattaaagttttcacagttgggataaaggacatccaatgtaaaagactgccatttctgaaaataaagacaatacaagctggtcatcactgttgacaaaaatttcctcgggaatctaaaataaccaacaagtcactcatttccctttgtctaacctactacatgcattttttatttataaagccccactcaacttatctttttcccctttcatcctgaattctgggagctcaaaggcaaccttaaggcttagttgcaggaactctgttgaccttgtgggaacatttgcttctttttccttccctatcacattcccacttcaaattcatcaactcatagagtatctttttgttgcttccttgggtttttttggacaaggaaagttgaacataatcaaaaacaacagtggtgaagtcctcacccaacactgccagcaatctgtggagcacagggcttcccacccggcagataagaaccccatgcacacctcttaaataaacaggctgatgctgagcaggcaccaccatccaggcaccatgctgagcgctgtgcgtaaagaaaatacaaagatcagccagacagagcctgtgctgcaaggagcccacattttatttgaggggccagataggtcacaattcataacataacaaagcaaaaggtgaaaagagctaaaaaaaaaaaagtagaaataatttctgataaattttctcttagcttttctatggggaaatcaggagaaatggactgactgggagaaagcttctggggaccaagtaaaacccatcacgatcatcatcgaaactgtggctgggaagatcctgggccccagcacagggtcaggtgggctctgtgctggccgggagagcggcctccgtctggctaccaggcctctctggactgcagagttagtttttctgcaagtaacagagtggaacccaatggcaggaacatctccaattccgaaattccatggtcctgtgcaaacaaccagaaaatagaaaccaagatttgaggacggaagaggaaccggacgaatgatgtgaacacggggcttgtttgcaggtagagtttactgggggaaagcatccacattacataaaagagaaaggagacaaaacgacgcccggcagtgggtgcccggcttgcaggcctctgcggcaggtctgtgggttccctggcccagcggcaccacccaaaggcgagggccaggctgtcgttgacgccctgtggcagcacctcagtgatttcaggggtggttttgactctttctgtggaggtgacaggaggtgcctccatcacagacacaaatggtggcttcctggcttgctcggtagacgccaggctatgctcaccccaaggccagaccccggacaaggccaggggctggcccaacactggccttcagggtgctgggcaacctgcatttgctgcgcagcccaggcccacccaaatcactgagggcgtcacacaggcaccgtcagctgcgggtgctaagaaaagcggcaggagaggaggaaggcagcttatctgtgcagccgtcagccatcagcaagcctgtagcagccactgccaagcaaccgggacccagctcttatgtcccgtaaggttccagggaccattccggggagaaagaagggcctggtcccagggcaggaagctcacaaggcaggaggcgcattgcgtccagcaggggtgtcccattgggacagtggcggctctcagaacccagccgccagccctcaactctggctcaccgtcccaccaccaactagagggccccggccaagccaagggcaaagtaggggacacacttacaatcaggggtgcatggggctcctcccctccccttgtgtgtgcatgtctctgtttctctctttctgtctctgtctctctctttttctctctctggccctcccacaaggcttaaggtggctccttagaatggaaggcccaactttgtgagttactcgaatacatgaactcagcccaggacagtgggaacagcagcccggctcacccctgcaggcggggactgggtgcccagcaagcctcgggaggctgccccaaaccaaccacagggagacctgagacgccctacgcccacctttcttccggcctggtcttaaactggtgggaggggcgtgggctgaggtagccatggggggccctctttcctgccctcagcttcacctttttcaggagcatggcctggaagctcagccattctcagaaggatgggctggaggagggctgcaggcggctctgcccttcctggcctccagagacacactgaaagcccagttatcacaatattcggccgacggaaatggtttcatgaaaatttaccagacttgaaagcaatgactcaaagaaatacgtgtatgtacccccacgcacacagcatgttattcacagaagccagacacagaaacaacccaggcgcccagcagctgaggggtggagaaacagaacgtggtctatttacacgacagaatgggactcagcctcagaaaggaaggagacgctgacacagtccacacctgcaccagccctgagcacgcggtgctgcctttagcgttcggctgcagccgggcacatgctccgattgcactgatacgtggcccccagatggtcaggttcacagaaggtacactgagtgcagccagggccttggggagggggagtcagcattaatgcgcacagaggttctgtttggaatagaaagttggcaggtggatggtggtgatggctacacagcagtgtgaatatcctttataccactgaactatatccctaaatggttaaaatggtcattcttatgtataagttactgaaagtctttaagaagtgataaaaggtttactgaataaatgagaaactggatgggagggacgccatccccactctaaggagtctggactatgaggttgatgatgagcatgacctcaaggccccagcatagctaatccaaccacaggaaggcaggcagcatctgggaggccccatcagcaaggccatggccggcgagtccctgctcagaccccagaaatccaaagtgattcacgcacaggtgggaagacgctatcaatactcacaactttaaccagacacaagtctacagaggcgaccatcactaacgttgaaaatgtcttggcttctgatttgaacaggatcagacctcaagcacgaaatgaatgctttaaataatggatgttttttcaagaaacttaatttggtatcacattggccaagaggtcatttggcgaggccaacacacagtcacaaaggaaaggtggtcctcagtgccacccaggcactccgctcggccagccggggggacccagctggagccataaaaggactgctcccaggtcaacacgaaggcctgcccaaggactcctgcggccttcaaagatttgcagcctgaggacaactttcagcaacaccgcgacactctaggttgttttttcaaagattaaacataataataattctgtaaaaccaacatgggtcatcattaattactgcaccgtgaccatggctatttaaaaacccagcctcagcacagtagctgacaaacattaatgagcagtaatgtacacgtggtgttgtcgatgaacggataatgaaagcaatttatttgaaaattaaaacatgattaagaatggcagcccaagcgagagcccagatgcctgaagaaggcattcctgatggaatggccttcttcctctgacagtttttaatatacagcaccttagcttggcccctccttggtgcccaagacctaacactggagatgtcagctgtggagagtgagaagacaagcccctcagtgggacatctcacagcgctccttaagagcagcgtgtgaaggggacacggacgctgcatccttcctcacccagacaacccacagatcccaagtccacccacacccaggacgacgcacagaccccacatccaccctcacccaggatgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggatgacgcacagaccccacatccaccctcacccaggatgacgcacagaccccacatccaccctcacccaggacgacgcacagaccccacatccacccacacccaggatgacgcacagaccccacatccaccctcacccaggatgacgcacagaccccacatccaccctcacccaggacgatgcacagaccccacatccaccctcacccaggatgacgcacagaccccacatccacccacacccaggatgacgcacagaccccacatccaccctcacccaggacgacgcacagaccccacatccacccacacccaggatgacgcacagaccccacatccaccctcacccaggatgacgcacagaccccacatccacccacacccaggatgacccacagaccccacatccaccctcacccaggacgacgcacagaccccacatccaccctcacccaggatgacgcacagaccccacatccaccctcacccaggacgacgcacagaccccacatccaccctcacccaggatgacgcacagaccccacatccaccctcacccaggacgacgcacagaccccgcgtccaccctcacccggggtgacccacagaccctgcatccaccctcacccaggacgacgcacagaccccacatccaccctcacccaggacgacgcacagaccccacatccaccctcacccaggacgatgcacagaccccacatccaccctcacccaggacgacgcacagaccccacatccacccacacccaggacgacgcacagaccccacatccaccctcacccaggatgacgcacagaccccgcgtccaccctcacccggggtgacccacagaccctgcatccaccctcacccaggatgatgcgcagaccccacaccctggcaacccacagaccccgcgtccaccctcacctggggtgacccacagaccctgcatccaccctcaccaaggatgatgcgcagaccccacaccctggcaacccacagaccccgtgtccaccctcacctgggacgactcacaaaccctacgtccaccctcccccaggatgacccacagacgccatgtccacccctccccaggacaacccacagactcttcatccatccttgcccagaccccatcacagctggctggagaaggacgctgtgaaaacctcttttgctctttcttgctgctcaggccatccacacctggcagaaatccccactgcccagttccactgaagccctgggctccaatattcagacctgagacccaaacagccctccagagagagctgagccacagacgatctggagccccggagccagccctgccctcaggacaggctgttagcagatgcccaccatggaccttgggggcactcccggaccctcctgggggatcctaggcaggcatggatctgtgttcccccaacacagataccaacaagggccccaggaaggtcagtgcctggagccaggtgtgggctcaccttcaccacagatggtctggctggggcaggccctcctgagaacctgagctggcactgcccagtcctcactgtgtctctgcctgagccctgcctctccctcatccccctcttcccagctcttcccgctgagcctggaccctgcctatggagctcatccccgcttctctcctcccttcgtttcttggccctgaatcccagccccttccccatcgtgggttccatctttcctccgtctgtctgtcactcatcccgtccctgcacctgtgctaccatcaacctcccagcctgggcctcttttccattaacaaacagcccagcccagactagaaatgcagagaagccacagctgcaccagcaggcaccacctttcctggacctccatcgccccagctctcctaactcagctctgggctgtccagaggaggaggcagaagaggccgcccctgcccgcccggcctcagcctggtgtctcccaaggccagcactgtcctgtgtggcaagaggatgaagggacagagcccctgtgcccggcactttcctcaggccaccctggccccaaagcacaggaagaaaaaaatgtccacaactcatttactcacagagaagaaaaatttgactttatttgtaattaaagatggcctaattaaggcaatgtgacaattctgcccatcagacctcagaaaggcaaaggactttgtgggataactcaggttgctggtgaatgacatggactcatctacattttgttgggcacaaattaggtgtcccctctgcaagggacaaatttgcaacttgactgaagttttaaaatggccaagccccaggagccccagtttctctgctaaagatatattctaaggagataactggatgtgcgtataaaaccgtaagtcaggtttgtccatcacaaccacgctcatcctggtgaaaatgcagagaatcagggaactcgagtccagatgagaggtagtggagaaggaaggcaggggtctgaaagccctgcagatttccaagggttagtgttcacttctggggcccaaacatcccaggggcagtagccccaaagccccagatgggactggctcagtcaccgtccctctggggaccttgagtcagaattaagagtcagaattaaagagaagtctcaaaacgacgccactggagacacaatcgcaattcaggccaccatgttgtaggtggccctggtccccatgatccatggaacagaggcggccccagctgtctccgcaggattatgcaccgcgcgtcatgagccgagggggacaggacccgtggagcaccactctcgaaagccctttccctggggccagatggccagcaccatggacagcagctcgccagccttcgctgagcctccaccagagaggcaaggggaggacactagggaggccaggagaggctacgggaggacgctcgggaggccacgagaggctacaggaggatgcttgggaggccatgagaggctatgggaggacgctcaggtgctcgcagaggccctgagaagctatgggaggatgctcggttgcttggggaggccgcctcctccagagcctctggaactaagtcacacccacgctggaaccactgcgagcccaatttcggaaaaaacaaaacatacaagtgaaactcagcccacagctctgaattcattctctgaccagagaggtcctgcagccccgtcgaagcctgcacacaattcctggtgagcgctttcctgaccacctgacctggaagggcctcacccagtcttgatcgtcacatttcccagacaaacataaaatcgtgcctgcctaggagagaaccgcgcatgctgatacagtgagacaggcagggtgccagaactccgaggtgagacacttagggtgtcccagggcgctcggcccccagagctctgaggtgagagagccaggagaggtcgggagggggcggggcacgggcctgggaagcggctggcctgcagctcaggaaccccagtgtctgggtctccacggatgcctctggcaggtcagggagaggaggtggccgatggagagagtggatggaggagtctctggtgttgatcacagtggactagaatatgacagaaaaggggacttcaggctggcagacaaccacacacacacatgcacagacacacatgcacatggggagacacacacacgcttccccagacatcgcctcctgccggacgctgtttcattcttctctttgaaaggcgaacgatgaggcagtcagtgaccttctagccaatggggctttgggaaccaaatcaattccttaagaccaaaaaccctgcctctcaccatgcttcccccagcagggtctgcagagcccccatcctcacttcatctgcctctcgccatgcttcccacagcagggtctgcagaacccccatcctcacttcacctgcctctcgccatgcttcccccagcaaggtctgcagagcccccatcctcacttcacctgcctctcgccatgcttcccacagcagggtctgcagagcccccatcctcacttcacctgcctctcgccatgcttcccccagcagggtatgcagagcccccatcctcacttcacctgcctctcgccatgcttcccacagcagggtatgcagagcccccatcctcacttcgtattcaggtaagtgtgaccaagaatgtctctttttctggtttataaatcaattttttaaagatctcctaagatctgagaatacaagcaaagagacagtcacatgtaagcttaataatgaggttcatattaaaggcagacagatgttcaattaaacatcagacttcacgctgacacgctgagagtgaggatctccatgcataattctccgtcccagccccagatcccgggagttttgatcacacagctgggaagtcgtcatccaagcctcggatgtgtttgtggggcatcgtctatagccggggctcctcccctctctctgtccacacacacaggtctccaggcatgtttacctctaaatacacaccctgccaaggactgtggcctggaaagtcataggcacttgacttctaccaaaaaagaaataacggaacggcatgagaatggtcacacctgagcaggcagctaacagcaacaggttcactacacacaaccacccttgcacatatgcgtgtgcacccacaacacacacattcacacacacacacgcatgtgcacacacaacacatacatacattcatacagacacacacgttctcaccctaaagtcatggtcaaattgggtggtttactccacactattttaataaatagccttcactcttcagacacaatctgaaaaaaccccagactcgaaagcgtttcccataactcaggacaaggaatcacgcaagtgggaaaccgtccttgcgagcgcctcacgtgagccacagtcaccgcacaaagtctccatcgcgttggacggtccgtgggaatttctcagggctccggaggccagcggggctggaggcagacctcatcggcacttctgacaacggcaatttttgtgctcctcacaaccaacgagggtgtgatttttcccatctgtcttcccttcctcacccctcccttccccttctcttccctttgtctctcctccctctcttcctacaaaagaaatcacatgacatcgattccctgatattcagatcaatcagctggagtgacaggaaacacgttcgctcccattggaaacagcacgtgctccagcagagctcaggtgttgttgaagcccgttagaactggcatgcgtggagtctgctcccatgcatgcatgcacacgcacacacacccacagcatccctgggagaagccgcagcccaatgcacacgcacacacacagcatccctgggagaagccgcagcccaatgcacacatgcacacgcacacacacccacacacacacagcatccctgggagaagccgaagcccagtgcacacgtgcatacacacacacacacccacacacacacagcatccctgggagaagccgcagaccagtgcatgcgtgcacacacacacacccacacacacacagcatccctgggagaagccgcagcccaatgcacgcgtgcacacacacacacacactgcatccctgggagaagccacagcccaatgcacacatgcacatgcacacatgcacacacacccacagcatccctgggagaagctgcagcccaatgcacgtgtgcaaatacacacacacacagcatccctagaagctgcagcccaatgcacgcgtgcacacacacacgcacacacacacagcatccctagaagctgcagcccaatgcacgcgtgcacatgcacacacacccacacacccacagcatccctgggagaagctgcagcccaatgcacgtgtgcaaatgcacacacacacacagcatccctagaagctgcagcccaatgcacgcgtgcacatgcacacacacccacacacccacagcatccctgggagaagctgcagcccaatgcacgtgtgcaaatgcacacacacacccacagcatccccgggagaagccacagcccaatgcacgcgtgcaaacgcacacacacccacacacccacagcatccctgggagaagccacagcccaatgcacgcgtgcacacgcacacacacccacacacccacagcatccctgggagaagctgcagcacatgtgtaagctgccaataccctgcacacggctctgtgactggagataatgaggaatcgccatggcaacccgggaacaagcccacagcgccttgtttccccgaacgcagagccccggcagcccctccatccaccgagacatacacggctggaaggacgtggtgctgcggaccatgggtggttcttctgccacatttgctgggacttgtcctaaggacattttcaatttctgaaatcagtcgccattgacggccagggttctcattcctgaatttttgtctttgcttctggttaccagagatccaaagctgcagtcgtttagctggtttctgtttccaggggtattgtgaatggaaataaaccatgaaaatgaccgaagacgtcacaaggaaagcaaataggatttaaaacagcaaagcggtgcctttgccaattccagggagtgtttctgctacataaccctgtctgtgctgggcagtgccgctcccgtgcacccaggactggaaaagcatagcttaggggttcaggggagaaacagtgacctctgcatcagaaaagtcctagataagttgccaggaaaggcaacagcacctggaatgagagacaagctcaggactcgtgccccaggctgcagggacacccacagagctgacttctcctcggtcaaccagcccccagtgctcggaagcatctggcccaggcacaagcatgctcctgctgctacggcagctgaattgggaagtatggcgggggcacagatgccccaggtggacggccaggcctctggtccacacacaggcattcactccccatgtggccatgagcccccgattctccaagtcctgtgttctcacctgtaaaatacggaagctatgctagacaactgctgacttccctcacctgagctctgtggtactcagatatcctcactggtgggaaagggaaaggccacggccatcatgggcaggaggacgcagtggttcacaggatggaggcaccaactgggaggctgggcggtggcactcacactgtgctggagtcaggctggctcctggggagcacgtcagtcacctgcttaattcaccatgggttagctctccgcgggcgaaggatgacgaaattacgttgtaagtgagcctcagcattctgtcctttggaaatagccccaagaagtctgggataagctctattaatgttagtttttttccagagagtaaaaaataagctcttgaacccatccatggctatcagaatgaaggaaaagtcgtttgacctccttggcccagagcccatcagatgctcagtcattcccctctaaaatgcaactctctccataatgagttcattttcaaaagattcaattatatggaccgtttctccagacggtttacaaatttcaaccatggcagcagcatttgggaatggctcatctgctcccaccataacttagggccatgttcctgtttcaagacaccaaattcctgagtttgactttcccttctgcaagtttcccagaggaggaaaacctttaaattgagctgaggaaagaacaatatttgaccagcaccagaagtcaccgagcattttaatacaaaccttattgatgaggctttactgtccacaccactgcatatctaagtcagagaatttgtcctgtaattccataacttcaacagggcaaacgtttacagtacaggttgattctagagcctcctgcaccggcctcccaggatattcggcagcaggctgaacccaactggaacatccctaccaggagagaagcgggaccctgtaacagctgccacagcttccctgggaggcccccgcttgtgttgacttcagagaagcaaatcttgacttttcttagcgactacctaaagctttcattacaaactttcttgaaaaagaaaaaatggtattcctaccagcatcactggctgggctagcactgatcacagtgatgaccaggtagatgaagtagggtttccatacatgatggaagccgacagccacactttgaaaagctcagtgtggacttttaggtgaagttcatatgaaactgttagttcctggcccggcccgcccgcacagtaaatgagaaatgacaggtgtggaagccaggaggccactgctttgctgcacagggacgtccaaggaccaaggcacagagcagctggggggctccccagggaggaaggacagcactcagccccctcccctgcaggtccctcagagacccaaggcccagctgggccccaccatcctcgaccccccaagtcttcctccttgctgtggccacacagaaactgtaattttaggacgagagctctgccagacagaggtgaagaggcaggaattgtgtggggtccagaggaaccagagtgtgatggttaacactgagtgtcaacttgattggattgaaggatggaaagtattgatcctgggtgtgtctgtgagggcgttgccgaaggagattcacatttgggtcagtggactgggaggggcagacccaccctcagtctgggtgggcaccatctaatcagtcgctggcatggccagaatataaagcaggcagaatatcgtgacaagactagactggcctagcctcccagcctacatctttctcccatgctggatgcttcttgcccttgaacattggactccaagttcttcagccttgggacctggactggctctccttgcagacagcctattgtgggaccttgtgatcatgtgagttaatacttagtaaactcccctttatatatatatacacacatacacacacacacacacacacacatatatatacctataaagttatatacatacacgtatatgtaactaatatgatatatatatatctgcccctctagagaaccctgactaatacacagagtgtccaaaagtgaatcactcaacacatggtgagggtgccgggggtcagaacaggacccccccaacctggggccactgggcagatgctatcagcaccaggctgacttgaggccacacatggcatctgcctgaaccgagaggaaacgcctcccactgtccagtagagaaagtaaaagggccaaggggaatctgctcattcaccaatctgtttattggtaaatatcagccctgattacacatttcccgttataaggataaaaacgtgaaaacatagttacaaacatacacagagaaactggaacactgaaacagaaaaaccatgtgagagccacaaaatgattctgtagcacggaaaaggcaaacctacattgaaggtacaggaaaataaataggttttaaaaattacagttggaaacccatgtaaattctaaaaagcatctgatttgtgttctcaaatttaagaaaatgacaaccataaaaagcaagataacagcactccagaagtccccgacctgactgggcggcagacagactgagaaggaagtctgtgaagaggacagtgtggtctcagcgggcaggaggcccagtcagaaacaccgagggcagaactgtcccgggaagtcacctcagtcacacgaaagccaccgtgaacaggagcttagctacagacgatgggaacgaggtgatcaacactgcaggagaaactggtgcacggcggtgactgactggggatttggcataaggacaactgccttttaaaggctgggagaggccagcgcagtggctcatgcctgtaatctcaacacttagggaggccgaggcacaccgatcacctgaggtcaggagtttgagagcagcctggccgacacggcaaaaccccatctctattaaaaatacaaaaattagctaggtatggtgacacacctgtagtcccagttactcgagaggctgaggcaggagaattgcttgaacctgggaggcagaggttgcagtgagccgagattgtaccactgcactccagcctgggtgacagagcgagactccatctcaaaaataaaaagaaaaaataaataaaggctgggagggctgggcgcagtggctcacgcctgtaatcccagcactttgggaggccgaggcgggtggatcacgaggtcaggagactgagaccatcctggccaacacggtgaaaccccgtctctactaaaaatacaataaattagctgggcgtggtggtgggcacctgtagtcccagctactcaggaggctgaagcaggagaatgccataaacccaggaggcggagcttgcagtgaaccaagattgcaccactgcactccagcctgggtgacagagcgagactcctgtctcaaaaaaatttttaaaaatcaatcaatcaataaaggctgggagaaccagaataaatgaaagaaagcaacatgcaaaagtggaatacaaaaaaacttccacttccaaagatgctcatctgaagattcagagtttactaaataccacacaaaattaacaatttttaaaacacccttacacacaactgtttttgaattctaaagaatcaaacgaactatcacaatgaaagagttttggtagagcagcccattataagaaaaaaagtaaaaaatgtagcagcaattgtcatttgggaaatatgagaaaaaataatctcactcggtcataacgaaaaattttcagatacctaggaacaaacttgaccaggtatgtgactgcgcagggaagaaacacgggcccacagtgtggacaaggataacacggccaagtgaccctgacagcaacatggatctccaatggcttagatggattcaagtaaaacctttttttggtaggaaaaatttaggtgaaaaaaaggaaggaaaaaattaggtgaatagttatcagatcctataataagagagacttcctaaacaagcaaaggaaagcaaaaaaaaaaaagattaatttcacttcatgaagatttaaccttctatttttaaatacatgagaataaaatatatccttatgttttatttgattaacatttgtaacaattttaccaataaaattcataaaagaaaacataaacttagcataagaaatgaaaaccaaaacgaggaggcatattttcctacacaattaaaattcttcactaataaacatccacattgatgaccttgtgacgcaacaagcacctcacgcttgagagaggaactttatgcaagttctcggaaggaaaattcagcaactctcaaaaatgcacacaccaagtgacctaggaatttcacttctaggggaatgttctaaggaaatgattcatatgcggaaaaccgttcgttttcaaagatgtgcttactaagaatcagacattgagaaacaaaggaatttccaaccgtaggtgaataattaaattacaccacattaaagatcatatttataaaacagataacgtgacatgctcaagatatagtacttattgagaaaaggaatataaacccatggatgtaattttctaaaagggagagatgaacctcacacagctggacgtagcgcactcagcgtccgtcgtggccccggggatgaggttctgtgagtcacgccacagacaccctctgccatcagccctcctgggcgctggctgtgtgcggaagaccccctcgcagggccacaccttccggggatgagcacctctggctgagcactgcaggcacagagggaggcttgccccgagccccagcagctctaagaggtccccgtggagtctcacctgcccaccccgtgctggtccccagagctggacccccaacgctggtccccggagctggacacccccaggctggaccccggagctggcctccccagtgctggtccccagagctgatccccccaacgctggtccccggagctggtccccccaacgctggtccccggagctggtccccccaacgctggtccctggagctggacacccccaggctggaccccagagctggcctccccaatgctggtccccagagctggtccccccaacactggtccccgaagctggtccccccaatgctggtccctggagctgatccccccaatgctggtccccagagctggtctcccatgagctggtacccggagctggtccccccatgctggtccccagagctggtctcccctgtgctggtccctggagctggtccccccaacactggtccctagagctggtccccaccacgctggtccccggagctggtccccaccacgctggttcccggagctgatctccaccacgctgatccccagagtgccccaagacagccccagcatctagtcaccctctgattcagcttcatgggcatctcccttttggtttttatttctgttttttatacagcttgcattatctttaagtgcaggaaaaaatatatatattaagcaaacaaatcaaaaggcatgcatagtcctgacaggcagagttctccaggctgtgattcagcacccagggtccaagcagccacatagggctgctaagactccccgacctgacagcttccgggcatccctcctgcaatctggggccacctggccactctagaacaccgaaggtaacactgagcagggccactacagggaggctgccagaggatgcgctgcacagggcagcacggccgaaggttccacccagcggcctcttaaatcaaggacttccaggcagaggaaactcctgtggccacacccccaagatggctttgtctgtaaaggagcgttaacatcggcatttataagactaatatgacagcagatgtgctttcctctgacgcccgtacgctgcggaatcgcattatggaaatagagtgccaaatggatgccttgacctcggggcccggcctattctgcacaaagatgacttctgaaatgagttttttgctataatttgctcttgcctttgctaaaaggttgaaggcacttctattccaactgagtgtgagtaacgctaatttcatagcgttagctgcatgttcttaagcacgtttatcttcagcaagtacagttctgttgattgaaagaaagaaatatttctttttagtaaactagtattcccaaaggctgacagaccatctttgtatcacacacagttactaagggttcctttgcttaatctcttcagaggaaaaacagaccagctgccactgaagcaaacgaagtctctcctggcacccacatttggttgttttaggtttggagatggttttctgtgcaattaatgtgattcatccatctttgaaatgaagaattacactgcagtgcggccagttcccaccggatgaaagttgaagaaggagcaggattggaaatattcaaataaatagcaactgtttcagcccatgcacctgcagagtagcagccagcctgcaggccaggaaagggagacgctctcatccggcagcatctgggcgccctctctggatgggagtgtggggagggccctcccgtctctctgcgtctcagcctttgccaagcccagcattctgtctctgcctacctggtgcatggataactctcaaatgcacagatgagaagatgagacgctgtgggtgctgggctgggccctgagggaaacgggcagagtgtgatgactgttcccacggtggcaacacgacgcccacgcgcccggcactggagtcagggctcaggcagcgggcccttctgaccctcgcagtggcccttctgacccttggggcaagtgcacttaccatccccaccgcaaacagaggaaacagaatctagagctgaggggtttgctctgggtccaagcagcagtgaaggggaagagctgggtctcaaacaccaaaaatccaatcacaaagctcccttgtcaggaggagggagccacctccaggacagaccactggaaatggaactctccacaaacaccaactcaaaaggccaatgctgcaggccaagaacacactggcaaaaggctgcagagccacccacacactcactcgctcctgtgaaaccagaccctgcagctcctcatagacacacacctcaatatcaacagcgcagaaactccactcctggacactagcccgagagaaacaaaacacgatctgtaaaaaggattgtacaagaatgtttagagagactttattcataggcgccaaaaactgaagaaagaaaaaaagaaagaacaaagcccgtcaacaggaaagtgggtttgaaacatggcgcatccactcaatggaactcccctcaaaacagagacaaaccgtccacacacagcaagtggacagatggaggctggaggcagaaattaaagaatgccctgcggaaatccagaacagcaagctttagacctggagaaaccaagcatatcgtgcaaaggaatgggagaagtcatttccggggcggggatgtggtttcatgggaactttctgggtgatgtaaatgttctaagtcacagcacaggcaggggctgcatgctgggtgcatttgccaaaactcacagaattgaatacttcaagtctacagatttctactatatgtaacatttaactgggaaaatgtaacagaaaataataaagggtggggctaaaatcccttcctgcttaaaaacacagagcatggtggcctgaggcgcagaggaaaagatagatgagaaactccacatccccgaggctcagcagcagacgtatttcatgggggaaaccagctctcagctgcttcacgtggcagtgagaccctaaatatgagaggcagtggccggccagagcatgaagtcagaaaggtgcctaaacctggcagcactgggcctccccacagctcccaactcaccagaattataccaggcaagtgcccacagggcatcagcagagggcttgtcatgtgattcactgctcatttagtccctcattcagcaaatgtttacagagtacccaggacacaggcatagtccaggcacaatgagggcagcagacaaggcagctgtgtcttggggcagacattttaggagagcatgcaaggcagccaggctcaagctcctggtgtggccaaacccagccatctcggggatgtggtgggacagcacagctgaacattaaatccattgcaactacagttttccctgagaaaagcatcactgatatgggcaggtggcagaaaaattctgggtagaagagggtagttccccggcaaaggccccgccctcaagcctggaaacctgtggccctcaatgggaacaggcattcctgtttttgtgcccaaatgttgccttttggcctcccatgcctgcctatcctgtacccatgtaaatgccaagccccaggctccactagtggaagagcggaggaacagaagagtggcgtgtcagggaaggagagaagagaaggagcgtgtgaatgtcaagaggagttcggctggggacagtcagaaaggagattggctgcgggacggccaaactccaggggaagatcccttcccactccatcccctctccagctccccatccatcccactgagagccacctccatccagcagtaaaatcccccacatttgccatccttcaatttgtccctgtgacctgattcttcctggacgccagataagaacctgggtatcaacagggcactgagctggttaatacttaagccatctgtgggtggcaactgctaaaagagcactgtagcacacccaccgcggctttgggagtcacagacaccccacccctggatgctactgcagggccagagcccaaaagcactcaccccggctcctgcacctgcctatctgtgtgctctcccttccctaaggctctttgagcacgcagcagccaaacagatgagccacacccgtcacacgtcctgcatgcagggtcaggggactcccccacagccctgtcacacgtcctgagaggggggtcaggggactcccccacggccctgtcacacgtcctgcacgtggggttaggggactctcccacagtcctgtcacacgtcctgcgagggggggtcaggggactcccccatggccctgtcatacgtcctgagggaggggttcaggggactctcccacatccctgtcacacgtcctgagaggggggtcagtggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcatgcggggtcaggggactcccccacagccctgtcacacgtcctgcacgcggggtcaggggactctcccacagccctgtcacacgtcctgagaggggggtcaggggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcacgcggggtcaggggactcccccacagccctgtcacacgtcctgcacgcggggtcaggggactctcccacagccctgtcacatgtcctgagacgggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacatcaagcacgcggggtcaggggatgctcctgtttcatcatgaatctggtagcaattaggtgcgtgtgtgttaataaaatctccatgtgttatggaaaaatagttaaatgtaaaatgtatcggtcttcaccaaagaagagcaagggatggccagtaagtgcaggaagagacagccagcatcatcacgcataagaaaaggggaccccacttggacaccaccacgaacccacaggctggggaggaaaccccagcaatgcagagtgctagggaggaggcaggcaactggctggctcggcttgggggtggaaatgcacacacaattttcccgggactcagcaatcacaggctttgtcatggacccaagaggaatgaaaatggagttcacaggaaaccggcatcggtggtttatcacagctttacgcacgacagctgaaaagtggaacaatccaaatgtccgcagctggagagctgactttcttacacccattccagggacactacctggtaataccaagggacgggctgctggtacggccctgcacggagggtgctcaagggcagggtgcaggcagaagcctcccccacagtccacacagcacagggcccgtggctacaacacagacacagcaagcacagcacagaaccagatccatgagggcaaggaagagctctgtgtggtccagatgtgacacagccagtcctggcgctagctccgggttttctgggtgtaacacagccagtcctgatgccagctgtgggttttccaggtgtgacacggcaggtcctggacctggctccgggactatacacctcctcctgactcctccagctgtgcacttagaaaccgcattttactgcatacaaatcatatgattatacaaacctgaacaaacctgacacaaaagcaaataaaagctattggcctcaggacaacccttgaccttgacaatggcttttttacataatggttggaggctgtcccctcagctcttgacattcgctccccagggcatgagttttcctaaaggggcctgcaagccccgcctgctgcccagaggcttccccaggcacctccttcttggtgcaggagggccctggacccactagggacttaagctccttttccacagaaacacagcaatggttctgaagggggaaccgcaggtcccagtgactcatggtgaccacacgcctgcatccgaggatgacttcagccccctgtcctctccccacagtgagctgctccccacaggccccctctattgcgaatgccctgagtcaagctgcccagtcttcatccagttatgctgaaaaccccactcttggttctctgccttgatatcaccacgtttccaaagaaagtgtgcaaaactcctgggctttggagtccagcacactccagggtccagggtccagggtccagggtcaacatccaactcagttgctttctggttataggctcaggcaggcacatttgtcaaagaggtgttttaatcaatacattgaagataatgataattccttccatgcagcactggtattagtaatagctgagatattatatataaaatacttgacaaaattcttaccagaaaaggctggttggctgttacgatcaaggggactttaatgggatggggagaagaccccgctcccagtcctgtcatctgtgaatttgttattaataagtatttattgacagtgcatctgcacgcactcctgtctctcagagctgtggaggggaagagctccctgcagggtgaggcagggtgcggggtgagaagtgctgggttaggacaggggctgcacctgccaggcctggccctgtgtgcatggaaggggtgggagagcccccagagtggggaaggctcataggctgccccctagagcagagaacagcaaggtcaggtgtccacacgtaggatgctccctccagcagcctgcagaaggggctgcggaccccagggtgggggtgactggggttggcaggaggaccggggtagggaatacggttctgctgtgcaacacgcctctgcagcagtggcagccaagacccaccttcatagatggtgtctgttcagtaaatgtttgatgaaagcaaagacaggaacagaggaggggagggaaggaagggtgggacaaagagccacactaattacacaggaaggaaaagctgcatcctcagaaactgcagccaaactcacactcacagcccacaggtggggggctcccaagaaatggtacagacgaaagacaaaaacaactccgaactcaaactcacacctcacgggtggagcagggttcctaagaaatagcacagacaaagatggagaagactccacattcaaactcacagcacagcccacaggtggggcggggttcctaagaaacagcacagatgaaacagaaagactccaagaaggccaaagtcagtagacccacaagaggttcatgggggttcaggtggatggggaccccctagctgtattagtcctttttcatgctgctaataaagacatacctgagactgggtaatttatgcaggaaagaggtttaatggactcacaattccacatggctgggggggcctcacaatcatggtggaaggcaaagaggagcaaagtcacatctcacatggatgacagcaggcaaagagagcttgtatggggaaactcccccttataaaaccatcagatcttgtgaggtttagtcactatcaggagaacagcaagggaaagacccacccctatgattcgattaccttccaacgggtccctcccacaacatatgggaattatgggagctgcaattcaagatcagatttcagtggggacacagccaaaccatatcattatgcccctggcctctcccaaatctcacgtcctcacattttaaaaccaatcatatcttcccaacagccccccaaagtcttaactcatttcagcattaactcaaaagcccacagtccaatgtctcatctgagacaaggcaagtcccttccacctatgagcctgtaaaatcaaaaacaagttacttgtttcctagacataatggaggcataggtatttgttaaatacagccattccaaatgggagaacttggccaaaacaaagaggctacaggccccacgcaagtctgaaatctagcagggcagtcaaatcttaaagctccaaaatgatctcctttgactccatgtcaaacatctgggtcatggtgatgcaagaggtgggttctcatggtcttgggcaactctgcccctgtggctttgcagagtaaagcctccctcccagctgccttcacgggctggcattgagtgtctgagacttttccaggcacacagtgccagttgttggtagatctaccattttggggtctggaggaccgtggccctcttctcacagctccactagacagtgccccagtagggactctgtgtgcaggttccaactccacatttcccttctgcactgccctagcagaggttctccatgagggccccacccctggagccaacttctgcctgggcatccaggcatttccatacatcttctgaaatctatgcagaggttcccaaaccccagtacttgacttctgtgcacctgcaggctcaacactatgtggaagctgccaaggcttggggcttgcccccctctgaagccacagcctgagctccacattgactcatttcagccacaactggagcagctgggacgcagggcatcaagtccctaggctgcacacagcatggggaccctgggcccaacccacaaaaccactttttcctcctgggcctcagggcctgtgatgggaggggctgctgtgaagacctctgacatgccctggagacattttccctattgtctcagggattcacatttggctccttgttacttaggcaaatttccacagctggcttgaatttctagtcagaaattgggattttattttctatcacactgtcaggctgcaaattttctgaacttttatgctctgcttcccctacaaaaccaagcacccaagtcaccttttgaatgctttgctgcttagaaatttcttccgccacataccctaaatcatcttgctcaagttcaaagttccacaaatgtctaggacaggggcaaaatgctgccagtctatttgctaaaacataacaagagtcacttttgctctggttcccaacaagttcctcatttccatctgagaccacctcagcctggactttattgtccatattgctgtcagcattttaggcaaagccattcaacaagcctctaggaagtgccaaactttcccacattttcctgtcttctgctgagccctccaaactgttccaacccctgcctgttacccaggtccaaagttgcttccacatttttggttatctacagcagtgccccactctaccggtaccaatttactgtattagtctgttttcatgctgttgataaagacatacccgagactgggtaatttatacaggaaagtgatttaattgactcacagttccacatggctggggaggcctcacaatcatggtgaaagaccaagggatgtcttacatggcagcaggtaagagagagtttgtgcagagaaactcccccttatagaaccatcagatcttgtaagacttattcactaccatgagaacagcacgagaaagacccactcccatgattcaagtgcctcccactgggtctctcccacaatacatgggaattgtgggagctacaatttaagatgggatttgggtacagacacagccaaaccatatcactagccctaaggcaggtgccagttacattgtctcaccagagcaccctgagagccacagccaggagagaaatggtgggcaggacccactacaggtccaccctggtgggcatacatgtgcaggcacctgggcaacgcagctcagcacagcctcatgactccaactcccctccgtgaacagccccgggggtcaggatgtggaggaggccaggaccagggaggatggggccactgcatcaccaccctgggctgaagacccctccaccatgtcctgggtaagccacacaacctcacccactttttggtgtaaaacaggtaaaacagcatggaatttgcaaagtatcccatgaatgcgactgttctcctccccactcccctcttctctcctcagaaagtcgccatgaaggaaagaaatgcataaatctgtcttctgcaaaaacaatttttccagccccattctattcttacagcaggagtccccaacccccgggccatgaaccagtacaagaaccaggccacacagcaggaggtgagcagcaggtgtgcgagcattcccgcctgagttctgctgcctgtcagatcagcggtggtgttagattttacaggagtgcaaaccccattgtgaactgcgcacaggagggacagaagctgcacactctgtacgagaatctaatgcctcatgatccaaggtggagctgaggcagtgatgggagtgctggggagcagctgcaaacacagattaacatgaacagagaggtctgactgcacagagatcacaatcaatcaattgcttgcagacacatatgaaaaccctatcagtgggctttagagtggcaaatgagttggaaaaaagtgcacaataaacatattgcacttggatctttccaaaaccacacccccaaccatggtccatggaaaaactgtcttccaggaagctggtccctggtgccaaaaaggttggggaccactgtcttacagcctattgataaatggcacactccgtcagtatcccacagtacattaatgttcatcatgacatgatgcctggagaacattaaggctcctattaacacatgaggggccctgaagacccacctcctgagctaacgtccaacaagagttcaaaagacacacctcatgcagaactcttattcaacagaatttgaagaactattttgaagaattatttttgtaactcattcaaaaaaagtgatcagaggcaaaagcagcatgcagggtcaggcacttctattagtgaatgtatctatttgatataatccacagggccagtatttgcttcagaacagagcaatcatgcacataatatcatccctataaacaaaatgggaaatagcatggacttaacattccaaagtataatatactcttccaaaggagagattgccctcaccctttgtggctgccagtttaaagtgcagagttttgccatggaatgccctttcaattttttattaattacatggaaccaaagactttaaatagcctccgggatcccaaaaaatgatattttaaaattatccagctttactgtcagaaatttaatttgaagttcaaaagtcaagataaaactaaagtcatcaaaacagaaggacaaaagaactttaagtggtcaggaaagaaaggtgtgggtttgtgttcaattgcagaagagtctcagggtgagagtttatggaaaccccaactagagcccacctgctcaggtgtcttcacgcacacatatgtctcagagaggcacacagtagcagcaaacaactacggccagtttgtgatgttaatgacttttttacagaattacgtaataacgtcattagtattttaaaccctttggcatatgagagccactatgctccggaaagcgtgatcacactgaaggaatccttttcacttgagtccttggcttgaaaatgccactgtttggatggttacttcctgttgagaaccttgaccattttcagggacagaactttaaactctgcttgaagcatcccgcgcatcctctgtctcatcgctggtcatccatgtccctcacacactcatgatttgcgtgcaccaactgtatcacaacctgctgggctcgctcaaggtacttggcacacatgtctatttgtctgctgtcacccaggtggccacatttggaggtcaccacacaggaggaggagctggtaagggcctgcattgcccattaattttgaggatttatggtaccctggaaaccaaaaggacctttcggccagacaccaacacatctctcaggagcacaacacagggcagaagcagccgggatgtggggaccgcgggctgtaaactattaatgcaagatgccaggggcagcacccaacctccagaggtttttcccgctgatctcagtgaaaggtaggcactgacagtatccacagtgtgagagggcaggggctccttaacagttacagatctctgtatgcaaatgaaagtacacaaagccagacacttaggaagaaggcgcttcaacaggcacaggtgttactgcttaagccaagacagatgagtataatgtagagaaaccctgtattacaggagggattaagccagaagggtgtttgtgggagggaatgaaccttcccttcatcaaaaatcactgcaaactgtgtgcataacacccatctgtgtgtttaaaataaaaaatttcatttactaataagtgattacatttgacccttaaacatgcactctttgtaaaagttaccaaaggtaccaaaactgaaatactaattgccagaagacattttcacgagtcagagggccgaccaaacacagatgtcagggtgcacctctgcagcatgtgggctatgcgcatcagtaaaatcacctgcccgccctcacagcagtatttgctgcgcatcagtaaaatcacctgcccgcccccacagcaggatttgctggtgtgacttccgccctcaccgcagaagaatttgctggtgtgacttccattcagtgcatcaacgtcccctaatggagtttctgatgtttaaattttccgttccacactcccaccaatgcccctgaagcatggaataataaatacgaaaccatttgtcctcttctgataacatcgacaagaacctaaatgtcttctttgtaaaccaatcataccacactatgtgagtcccactgtaacaaaagctactttaatataaaattctgggaacaattccagagacaagagtcccaaccaattaaggcaagaaagacaccactggaaaaaaaaaggtttcaattgaaccgatgaagatgtactctgatgacatttcagattttgaaaggatttgaagaaacattaagggtgaaagtgcaacaaccaagtagaattggcctctactttaaaatctcactgtatagcaagcaaagagagctgttttgagataaaatggaaaatcagaagtttgggcatccatgaaacattcttgttaattaaaatccagcataaaattccacaccttgtttcatttcagtgatttaaacaattacattaatgataataatgccttaagtcaacaaaggaggtccatacaatttttcccttttaatggggtttagatattactcaaagtttacaaatgctggcatacagaaaagcacaagttcaggcctgctactgatgagctacgtgataccagaaaacggtttcaagtccgtttctaaatttccacagtctccaggaagaagatgggttggtgaccttgtgcgtctctcctgtggtgaacaccatggatttcatctccaggaagagggctctgctgtgtttccctccatgagcagatgtgcccctcctcccatgccccgagtccctccttccgtgctcctcctccctcctcccattccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccttcctccctcctcccgtgccccaagtccctcctcccatgcccagagtccctcctcccatgccccaagtccctcctcccatgccctgagtccctcctcctgtgccccaagtccctcctcccgtgccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccctcctccctcctcccgtgccccaagtccctcctcccgtgccccaagtccctcctcccatgcccagagtccctcctcccatgccccgagtccctcctcccatggtgcaggagctgcctccgttcatccaggctcattcatccaattcccctcgggaccagggtatgcacttttccaggtagcttgatggggtcaggggagcttatagctatggatgggtgcaggagatggggccagtggggacatgaacctggagaaagcataactgaacacactgtcgatcatccaaatgcccaaacatttaacctggaaaaaaatggatccttcaatccccaatcttatccaccatcaccaaatgtagatgtacaacctaccagcgatcaagttcaggcaacaaaaaacagaaagcccagcccttcacaggctcctactgcatcgactcccagctcttgctgtggtggtttcaagtgttaatgcagctctccagagttttagcaaatctgctaccctaggagatgaatgggaaggtgttagcaatctgccaccctgggagatgaatgggaaggtgcttccacatcctccatgatgaacacgactccacacggcccgatcacccacctaagcactcgccacaggggtgggctgaggatggggggactgtggcttctcaccctctgggatcgcgtctgcccaggctcttttgatgacgcgtctctgtggcagcatgtgttctagaacacgggaggctctgcccaaatgcctctgaggccaaaccgggacccagatccccaggaggctgggaaagtcctgccctaagtggcctcagcttcaaccagcggctgccctggcttcagggcccacacggacagatctcctggtaccacatgggagaccagaaacctttccatgaaactttcagaactgtaaacacagatgcccaattcacatagacactgaaatcacatctgcaagccaaataggtcagggagggctcatcctgcaccacaggagggctgaggtggggccaggaccacgctcactgccttcgctggggtctccgcaggctccagagagctggaaggcagatggtgaccacaaagacaactcttgttttgtaagacggtagccaagggcgcatttacaagtggagtgcgatcgggttacgatgttggaaagcactctctgggtcctggggggactggactccagggggctgcggcatccctgtcagctcagcttggcccggccaggcccggggatgcagctgaaggcggagagctgctgtgaggccctgggaagacgcggtggccaccaccatctgctgaatctgctgacttaaaggcaatggtgctggatggtctcatccaggcggaggctgcagagccagggcgaagtttcctgaaggagatggaatcctgctgtagatggcggcaacatgaagagctgtcaaagtctccaagccgctgccctgtgggattcggacaagaggctgcagcaggaacccgcctctgaattcccagcccaccagctgccctgcagatgtcagacccgccaggcccccaatcggtgagctaatgccttgaaatactgtctctgtctgtacacacacatatatctctatttacacacacatatatctatttatacacacacatctctatttatacacacatacaaaccccctgctgagtctgtttctctggagaaccccagctccacagcagccttctccccacagaaaatactttcggaggattcccccgaccccaggatgtagccacctctcccctgtgtcggcttcactctgcaggtctcggcaaggagcacccctgtccacactgaacaagaagcccctggacccttccgagtggccatcacctgatccacggccacatcctccacgggaagccacggttcacgtcaatcccggcaccaaggtcccagaattcacagcttctgggctcggtcccgcaagaccacccccccatgagggccagtgcagatggacagccaggccacctgcatttcttcccagccagcgacaaactcggctgcccacaacctcctcgggtgcaatttttctttggatgacacagaacttgggaaagcacttcactcaccatcactagctcttataaaggacacagctcaaggagagccaaactgagggacgcacggggcagggtgcagggcacacgtcacacctgccctgggtgcaccaggctccctgcacctccacgtgtctgccaacctgcgagctccatgaacctctcacttagttctctatgcaggtttcacgtacataggcatgatggattaaatcactggccattggtgattaaccccccaagagttgggggggcctgaaaggcccaaccatctaatggtgccttggcctttctggccaccagccccaccctgaagccagccagggctcccagccacctctcagcacacaaaagacactcatcgccccagagactccaagggtctcaggagccaggaaccagacacaaactccaaatacatacgttattattaacccacacacagatgatacaaaacttctttttcaccctccaatgctcagtgctgagctcagctgtgatcgatctgaaggaataggtcaaccctaagggctaagctcggactggcgattagaacctacaaccatggaggcttgatttcacccaacgtgaggcgggcccctggaaggagaagggctccagatgcaggcagggcagtgcctgggcctcaaagtctgcgaagagaagctgaagggaaacaggcgtccgaagggccacacctgggccctgaagccctcggcaggaggcaggtgcggccactgaggccacaccacacttcagtgagtgattcctcacagaatgaaacacgacacacctgctgtacataaagttgtttttaagatcagcccaggctgcgacgcatgtggaggacacgcagccgtgtccatagaccacacgaagtgaaagcgcactttgactgtgaaatccaattactttggatttaagctctgaaatgcaagttcattagaaaagagatgtattgtgccttctttctgtggtggcccctcaattaatcctctggtcattgaagaatgaaaaacatcaacccacaggcttcccttgcacagacaccagagtctgagtgaataattatggttttgattctgagttatgaaacaaacactcctccttattaaataaattaaaaataatgggatctgcgaaagatcaatacacaagaaaggtacatttgcaataacggctgccgccgtcacaaatgcaattctagactcagccaccagcctggctgctggaaccaggccctgcgagaacacggatgacaacacagatgcacggataaatcatcacgcgtcgcattcccagaatagaaaatgggctaaacgcaagttctgtccttcctgctctcctttgttcctggccacatcttagttttcacaaacgggctcttggagaaaagaggtgagagcctcagcaaaggttgtgggatgttaatggacacatccagaaagcagggccctggcccaagacgcgtggtgaggcagccccaggtgctgtcctccggtgcagccaggcctcctgcatccacctcggatgactctgtaatgacgctgttcacatccacagaagacaggaggatcctacggagggatgaagcctctcaaacgtctacacgatactcagctgcgtttattcaaaccgatcttctttgtgccccagctccatccccgccccaccaccctgtcctctcatcccccggctgctgagtgtgcacagaggcatgtccccttgaactcagaggcgccgtcgccctgggccgtgtcctcccacggctctcatggtcacacagctcagtggctgctatgtggaaatggcctctccttgcagccaggggcagccggcacctggaacagcaatgaactcgactaagaagttattcccatgcagcgagtggcactaagtcgcagccgaaccaatttgcttcatgggaaacacatttgccttcaaagaacacgtaaagtggaatcagcagccagacggagttatgaggtgagacctgcggagtctctgagctggaggcccttctgccccaggacagtcacagcaggcaccccgaccccatcccttctccagcctcgcagtaggaccatcgtgctggagggcctcggccaaggtaggagggaacacaggcatctggacaccgagtggccgcaatgctgctcactgtggctctgggagctgagcctgtcccatgccaactgctgtccactgcccggccaggcttgccccgtcccagagggtgcagaaccaccagcccctcagctctcagcgcactttgcgggagagctggccgatgtctcccaagccttctcttctcgcgcatcgtccccttaactgtcagctccactctacaaatgtcctctcaaaatgcgaagctcaaggtgggtatgtcatgccccaaagaggctacgaaaaatggaggggcaggaagggcagatgaaaacccatcccccacgggtgccgcgtcacatgcactgtgtccacgtggcaggctctgtccgctgtcagggccctacaggaacaagccctcctgaaatggtgtgaaacccacccccacctccactaattcaccacttccaaattcgaggggtggaaatcatcctaactacagactagattttcttccctcttgcgacggttgtaacgcaacagccatgtttcacgttcagatgtacagctgcaggaacaaatacttcttattccaaacaccctaacccagcagctgctgctcccttaaagataaaaagaacctgcacgagagacattgacttccattccctggagggaccctctggggccaatggccgaggagaaaggggctgtgagcccacgccatccctccaagcctggaagcccaggcgccaccctcccttgtctgaaaccgcgctccctctcctggccaagctgcaccaggcccgaaatccaggtccgggccctgacacccagctatactcacaggcccatctctccttcggacgctgactgcagaggcccgtcgggaaagagaccatgtcctgggaaggtctctcagccacagcagcctcccctagcttcttcctgaggcttaaggtcaccatgaggaggatacaaatgtctcattttatgatgagaaatgcccacctaccccgcaggaggagaggccttcccacattttcccaccagcacccatgctgcacatgccccttgagatgcaggcccaacccctgccaggacatagagcagctggagtcccaccccagcccctcacagccctgaccagctgcccaggctggatgcagccctgcagccctggggatgggaggaggcaggaggtttccccagtgccaggccctggtcagtaccgggggcgggggaggaaaggagctgcacccccagccagacaaggccacaaacagggcacaacagtgagcagcactgctctcaccagaatttaaaagcaaacagatttgccacctgggatgacgccctcaggaatgagcacctttgagacagggagcccgcctgtgagtcgagagtcctccaccaggcccccagggtggcttcaggagggaccgtttgcagggcagggatgatgcagtactgggctggtgcggggggagtagccatacccaggggagggaattgtgaggactgggctgcctttgggggtgacctttggccaagggacaatggccaggctggggcttccgtggggagggaatgagggtggacctcccctctccctcccttcatctcctgtccatcctcagggtgaggactctgatgtggccatgcaggtcaaactccccgaggaggagaggggctgggtcagggaccaccccagcactggacacagggtgtggacacaaaggcaagcctcctgggcactgtggatgttccacaagatgggtccactcatgagaccgtggctgagcggcaggcacagggcaaccccaagtgttctgtccatgcgtcagctcacacgaggagagggcggcggggatctgctgcacacccagcgttgtctggggaaccatcctggcatggagcagggcctcacaggacagctgcttctcttggccagcaagagctccacgtgggggcacggccccagcagccagtgaggatggcagaacatgtgggtgcagccctgtccttgtgtccgtgggggaggagtcaactcaccggggtctgaccacatcaaggtgctacagaaacacattgtagatcaatgtgtttcaccaactgcgaagacacaaagccgggccctgggtccagtcagcagccaaggggcagggtccttggaagccaagccggagcctcgccaggaccccacaggcttcccggtatcccctgcggacaggaccatcctgctctggttatctgtccacatcccaaagcctcatcggacctgcaggtatgtctcaccccaggcagcccctctcggtagaattttagaaataacttccttccattaaggaagaacagggtgatgagaactcctcgagcacgcctgtcaacctcagtgtctagaaccaccagcccctccagggaggctgaaaacagcaagtccacagagagaaagggctgcacaggcccagctgcccaggcccctgtgcctgctgcagagaaggaaggggagtcctttccaggggcctctgcaccccaggtggccctggtcttactcgatgttggctggaaaggagactgggcaggaagaaaacgggagctggaaaccatcccatcctggtcacagcgcctccaacgcaccctcctcaccccacggcgtctttaaaaaggccgaaacctgggtttgaaaatcctgcaaacatccaagagactcaaatgctgcgtgataaatttagaaaggtcaagtgtacttaacacgctctgccacgaacactgaaggaaaattaaagttcagcctggtttccttaaacatcatcaccagggggcacgtcggagggacttcgctctgggagacgccttgcaggacgaccccgggcaacttcagcctccacacaaatgacacagaaatggttcccagaacaaaaaaggacactctgagcctgacaggggatggaggtgtttccctcagacaacataaaggtctcaggcccggcacctgctgcagaccggcctcagctctgggtttctccctttggtgaatctgcaccttttggaagtggaagtcatctttcagcgtcattttcatcagagtttctagcttttcacagcttagtgggggatgcttcccaatagtgtgatggctctaatgcttttcattataatctcatcgcctaacactggtgaagaaggaatcatgacgtgattgcaacacacttcaaggaagcccacaccgtcttcatgatggaacatcactcaggggcttctcaaacgtggtgagcagcctgggttcaatgtatatcaccttccatcacctccctccccagccaaggccacgtcccctaacacacaatcaaacccaaaccccaaggacaccactgctctgggacccccacccttcatctctcaccccttaaactgtgccatcagcccatccactggcatcctgggtaacaatgtcccacccccatggacacctcgctccccctctgtccctcacagatgcgtggcccccctctgtaccccacagatgcctggacccttctctcccacagacacctggaccccctctgtcccccacggacacctcaacccctctgtccccgacggacacctggaccccctctgtcccccacggatgcgtggttcccctatgtcccccacagatgcctggacctctctgttccctgtggaccactggccccactctgtcccccatagacgcctggctcccctctggctcccccaccaaggagcaggtataatttttcttggcacaaaaatccatggctgctttcagggccacagggagggcattggaggccacggaagtgtgagaggcacaggtgtgtgcagggaacacctgtggaactgctgtcccagcctgcgacggggatgctgctgcctcaccaggagtgacccaggttggcaggtcggggatgagcccccgtggctgtccaagcccacctggtgagaatggagcagccctggttccctgagcacccccttcagagctccgggtggtctctaagtactggctgctcgtccatccccccaggcgcagaaagtgtcaaggcacaaaactcactcattgatgaggggagcagatttttgctgctgggggcctaagaaaggaagacgagctagcgtcaaagcttccagcattcaggacggggcgacaaggactgtaggcaactcacaaaaacacagagggtgtgcggcaggggctgcccctccacctgactcagtgttggagacccgacaccctcacctcctaaacagccctgaccagaggcatttaccgtgtgcccaaaagagaccgaatcgtcacagggacagtgggacagcggccaggctgtgcaggccgcatctctgcaacgcgtcagccagagaaagccgggggcaccccagccagcactcaggaggccctgcccgtccacacgacacctgggccaaccagccctttctgctgtaaaacttcggctcctctacctgcctgagtctttgccaagcacgagggacagtgactgacccctcgttcccgccagcctgagtaagtagccgcgttttcgcctgggtggtctgcaaggttcacccaccttccaggagcctccggagtctggggtggaggggctgcagtacccgagcacggccgctagatggcacgcaggcgcggtctcgacctgaatcccccgtgcgggcacctgcgcccagggctgtccctgcacaagtgaggggtgaggggtgaggggcgaggggtgaggggcgaggggcgaggggcgaggcgcgaggggccaggggccaggggcgaggggcgagggggaggcgcgaggggcgaggggccaggggcgaggcgcgaggggtgaggggtgaggggcgaggggtgaggcgcgaggggccaggggcgaggggcgaggggcgaggggccaggggcgaggggtgcggggcgaggggcgaggcgcgaggggccaggggtgaggggtgaggggtgaggcgcgaggggccaggggcgaggggcgaggcgcgaggggccaggggtgaggggtgaggggtgaggcgcgaggggccaggggcgaggggccaggggcgaggcgcgaggggagaggggcgaggggcgaggcgcgaggggcgaggcgcgaggggcgaggggcgaggggcgaggggcgaggcgcgaggggagaggggagaggggcgaggggtgaggcgcgaggggcgaggggtgaggcgcgaggggcgaggggtgaggcgcgaggggcgaggggcgagggctcccggcctgcgccgccttggatcccaccagccccgaattcgggcagagcgccatggagggcccagcctggagggggagctcggagcctgcagcaggtgaggtcgggctacagacttccctctgccccctggtcacagaggtgagagtggggcctcatcccagtcccgccgcgacccatggggcagagctgctgccctggcccaggcacgcacagcttctcaacagccacatcgcaggctggccctggcctccccaaccagagaccaagctcccaggctgcagaggcagcgaaggccgggacacgcacagggcagcgggcagccagtgccacgtgggctgaggaggcactccctaacgggagacagcgcccagccagggctggttttctcaccgtcattgtcaaaggccttttgagcattttcacacacacacacaaagaagccgtttaaaacaataaaagtgtagtgctggggaaatgattaatgcatatatctctatttcaaacccgcaaaaggaatcaaaacaaaaagacctttaaagagacacacaaaaaggtgacagcatcgtgaggtgaagtctgtgtgtgtgtgtacatgtgcacgtgtgtgtgcatgaatgtgtcacgtgtgtgcacgcgtgtacatgcatgtgattttgttcacatgcatgcacatgtggagggagcgagctgctcccctcctcgccgagtgagttttgtgccttgcccgcttcctgtgctcagggggatggacaagcagccaggatgttagaggccacccagagctctgaagggggcactcagggaactggggcagctccgttctcacagggtaggcttgtgtgtgctttgtgtgcacgtgtgtgtgcatgtttgtgtgtgcacatgtgtgcatgtgtgtgtgtgcgcataccatctccccaagccgcctccacctgcacacaccagcggtgacccgcctcggggtctgtcctgttttgccacaacagctgtagagaatgccaagcagctcagcagtggttcccaaaataagactgttgagagcccagaaatagcccccagagaacactgtaaaagccccaagacaaggaaaaagtacacgagcttgtgacatgatggtacaatggcctcaaggaaattgcagctttggaaagaaactttattttctgtcttttgaaacaaaccgacatcctgtcctctgtggagacccaggccccgctgaagtgctctttcaatttgctcttttaatttgctcttttaattattctgaaaggccatctgctgtaagagtgcctccctgatttaaactatgcctcacaccctcaaaacttacacttcagcattttttccttccttgcgtaatctcaaagcaaacaagattcagagaggctcacttcctgggtaatgcaggagatgccctccgaggtagggacaggggcttgtgcccaatgtggggccactctgcagagaaccacatgagctgcgcccatccaggatgctgccaggagcctgcatccagacaccctcagcggttgtgaaccagccctcccagcggcaggacccccgagcagttgtgaaccagcctcagggttgccctccaagtggccaggggacagggctgacatgaagcaggtcctcagatcgagaccagctctggaggcccaaacaaacactcctcctgtgccctgcaccctcaccttcccttccagagaaatagtgtgtcctgccccagctcaaaatagggacagcacagggctccacccaggaaagctgggggccgaaatgtcataccatttgggcaggtctgggcctgtcctgccactccctccccaccccccagtcactctgtgcctccacttccacatgacaacaacatccctctcagggctgagtctcctcccctgcagagaagatgccttgtgaggcctcttgaccaaaagaaacaggaaacaaatacagaataaaagtataacagtgaataaaaacagctacatgcacacacaactgtgcaaagcaaaacaaaacaaattgaaaagcacaagcagggtgccacggcctgacagtaacaatcaaacaggagggttttccaatgccatgaacgtaaatcgaggtgtgcatgataacaaggagtaggaaccggagggacggccactgagggtggaaccaaagcagggaaatgagaggatgatgagtccccactgatcctgaggctgggaaaatttgcagactcgaagattctgtagtgctgatacatccacacattccatggtcctgagggacactgtctagcttacaaatccatctgtaactgttcaaccagactagcaacccgtcattcatcattcataggagaatgcaaaattacatcatgcacaaagtgctcccccatgtatcaactgcatttgaacagatttgtgttttcaaaaccagggtggtagcaagattgagtatgcccagtaaatgctagatattattatcccactagacactgaaaacggtcccctttcctgggttgtgttgctggccttgccacaggcaatgccgagggcagctgcctcatcctcccccacactgttgcctcacctggtcacaggtgggaagccaggtggggctcggtgagtgtcttctaactgtttctgcattgctagaatggggtaaacaaagaacaaagaaaacatacataaagtacattctttgttctgttattgccgttgtcaaagttaactctctcttcttattttagggtttatttttaaacatcatgcttgcacatagtttgaaaaatctaagtctggttggggaaatgagcaaacctctaacccaccttttccccacccgcatttctactccccagaggtaagcaccctcaactcatttagctgactcttggttttcatctccatatctccacatgacacattcacgttgccatttctcagctttcagatttaggatgtatctattttctgactgctacagaagatgggcctacctctccataacacatcactgtttccaagcttactttctctttcccagtttagttacattacaattttcatcagatcagtattatgtgcttacaatattgtgactttgtaaatgctatccccaactaggctatgtagtacgctgtgactagtattaattttttttctttttgttttccctggagttataaatgtcttatgtatttgcttagtgtccacagtgtctcttcctttcacagtgtcttcttgtttttcctggagttatacatgtcttatgtatttgcttagtgtccatagtctctcttcatttcatgctgtcttcttccatgtggctgtcagggctctttcattagaggctttccataagtgtccagtgatcctgggatgcctgctcatatttaataaggggcacaaagagctgatttagaattgtgtcacctggtgaattgttgaaagtgggtgtcagtataggagaccctgctgagcagtttcactgggaaaaattttctctatttctattcccacagaagcagacctggaataagaaacaattgtagttggccaggtgtggtagtgcacacctgtgatctcagtgttttgggaggccaaggcaggagaatcacttgagtccaagagtttgagaacagcctgggccacaaagtgagatctctgtctctataaaatcatttttaaaaattagccaggcatggtagctcctgcctgtggtctcagctacttaggaggctgaggcaggaggattacttcagcccaggaggtcaaggctgcagtgagctatgatcaagccactgcactgcagcctgggtgataaagcaagatcctgtctcaagaaaagaaagaaaagaaaagaaggaaaagaaacaagggaatggaaggggaggggagaggaggaaatttttaaaagaaaaaaagtgtgacaaggaaggttgggtttccagtgaaaggtgcatcaccagccagctcctactgcaccggaaccatcccattcaaggggtggtgtagctgaggtatttaaacgctcactccttggccgtcagttggagctctcccagcaaggggagtgggaagcgggactcattagtccccaggcacttgcagtcccacagggagcgaagctgggaggggcggcgagtctgcagaccagcaccagtctgggtttgccaaactccctgcatgcaagagatctgctgtgaccacacctgcagggtactcaggccacctttcatactggggtgaggagaggaagtaaacgcttttctcatgtaacagatgcctttatgtcatcgttaaagctgtgctttctgacagtctttagaggttttaatgaggatgcctaaacttacgaggcccccacaaacatcaagaattttgccaaaagaaatgacgtaactgatggatattttttgaagaccaatgtcttagtcacttttgaaccaagcagatgcgctaccctatgtggacagggcagtcgtcatgcacagaacccatgctgtcccatctcccccacactcaggctggagcagcattctggctttgtttttgttttgctttattgctctgtgtctaccagacacacagctcctcagaaactggacagaaagcctcctgacatcaccacaacaaaatcacagccattaagtccaacgggattgctttatggtggctcaagcccatttctctgagctccaaagccatcctgacatcattatgctgcatcattatgaagccaacacacatctaacaagaacacaagatgcgctttgtcatctcagctacgattctccttggggtgaaagtgaggggcgctgggagttgccctcttgcaggtcccaaggcagcatctccccagcaactgagaccagcctcagcacaggacaccgtggtcccagccacaaatgcagacagagcctctcaggccaacctcagagcctctctggagtgcaggcatcctctacacaaacggaggcagccctgctccatgcctgccatgcagctgagacggatcctcaggacacgtcctgcctgcaggtgagctcctcaaacaccaaccagcagcccccgtcccaccccccgcattcccccagatcctgtaaagaacatcctgtaaagaacctcacgaggaaagccgagcagacagcaaacccagagcttccccgactgcggtgggccctgctccgcctcctgtggccaaggccgctcatcacccaggaaccgacacgcacgagatgcagaatctaaaagagaaagcggcaccgccaccagcaagcacaagagggacgtggggcctgatgacggaggcagcagtgatgcctgcggtgccaggggctctccgggttcctgaccctctgacagttcacctggaaggcgggctccaagcccctcagacccaggctcatcccgtgagcaaggaaggctgtgtgtatggaggctccatcccctcgtttgttatttttactgggcttcttcctctttttccagcagtgaaaaatcttcagagacctccaccagggagaaaatagaccggaagctccttctctgtgttgctgccacccaggagccgctggaccccaagggagcagcatggaggcagagagacctggcccagcacagaagcgaagctgccacgggacggccccacgggtgccaagacacgatggaccccaagggagcagcgtggaggcagagagaccctggcctagtgcaggagtggggctgccatgggacagccccatggttgccatgacacactgggtcccaggcattctagtgaagagctgttaccataagaggaactcaaaaagggaaatgctagtttaataactaaattcttaggaagaaatgtctttagtaaaatatcttgatgatctgataatgcacaaaattattcccgagacaaaatttgaaggggctgaaaggaaaacaaaaggacgaatggctggtaattcctaagggagaagctgggaagacagaggggctcaggggactgacggcagcctggaaaccagcaggtgcccagtggagggaagacaaaacgagagcaggggtgcctgaatccatagagatgtccacactgccgcccagacctcccaggcctctctccatccagaccgccagtcaagttcccatctgggaaagggggtctggccggtgcccagagccagggagaggtgggaaacggggtgtgaaagagagatgaggaaagggggtctgaccggtgcccagcagggtcagggagaggcgggacacggggtgtgaaagagaggagatgaggagtcagcacatccagccaccccctccaaacacacctgggaaaagggagaaccccggaggacagcccggtgggagagtggctcacaacaagtccacatacatcttgtgggactcagggaccagccagacacaggaccagggtatacaggtgctgacttttgagctgtccacggcactaggaggcacatgccccagcacctccccaaattggaaatctgggggtacaacctctgtacacacatgcattccagctcgcaaatgagcacctgcctcagagcttcaccttgactctcggaggtggggctggctcatgctgttggccagtgcaccccacgccctcttctctgctaattttgcatctgcactgaatttacgttggtgggagtcagcgccctccaactccatggagacaagactctgctgtgcacactgctgagactccaatatcccacgtgccaggggcttactccatatttggcagataaattaaagccccaaaatgcagagtcatcgatgagtctccttccaatgcagctgtccatgcggccttgggcaagccctgcgatgttcctgcagggaagggaaggtctgggtgtctgcagctgtcgtgcctgctctccggaccctgcgcccgccctagagggatccaagggccatggccaggcagggtggtgtcatggacagctctggtcccacggtggagggacagggtggtgggggctcaacccaggccagggactgtctgtcccttcctggctttgcccagcagaaagcaaaactctgatgagggagaatcatggggtgcaggggcagcaggtcagaaaagaaaagcctcctctgtgattctccacagcaaagggacccttcccagagctggcactgaaaacccatgagcagccccatcccttacaaccaaacacagctccgtttgcctcccacggcttcttcatatgcttcccagggggttcattctcgctctgtttggagacaccacagggttttggtgaaaatccccccacattaaggtctggaccaccttcaagctgtgcacttgggaggttgagcagacagaatgcacgtgggcacgtggccagagagaaacctgccccatcaggccaggggagcacatgtgagcacctctgccagcagacccctcaccagcaggaagccaagtgaaagacacaaacgcacccatgcaggccctgccgtactgatgtgaaaacgtaaataaccagagctgacctgaagagcatgtctccaccaggctgcaggcaggagtggcaaggattccaccctgacatgcaggccccaccccagcaaccctggacaggcccgggcacaggcccagctgccctcgttctgcaacagctcccaggtaatcctcatgggctccaggtttgagaatcgtgcccggagcaagcacatttaggcccaaacccctgggtgtggcctttgttactccaagggccactctggtggcacgtcaatcaccacagagaggtcacttctgttcacgctgcctgtcggactggaagtgggctaaggtgggcagcaggcaggcagtgcggcagccgggactgcgagtgcctggggtctgaggatcgcacaccaagacccactcggggaggggtcctgcacccccactctgaaaactcccaaaaccccacgaggctgaatcttgattcccccagagttctgaaattctgatgctgggatgatgcactttggaaaaaaccatgatggctggaaagggggaaatgaatatttgctttatgcctttagctagcacaaaaagtcacctaattaaggtaatgaggtttaaaatgtagggtaaaagtcacaagaaacactacaattccatttttataattactcatgtccttaccaaagaaaaggaagtccattaggacagacacaaaaatgacacgaagacgttgtggtgggggaatcccagcatgcgcagtcttttcctggtgatttgcagcctctggactttctataataaaaggtatcgccgtgacaataggagagatcaactttacaaacatcgcttaatcaggacacactgtggccccaaggcttataagtgaccctttcactggacgtcaccagaacacctgtgtgcagggtggggacacgtgctggaggtttgtgctgctgtgtcacacgtgggaagacgtcagacctttcctgagccactagccaggaacacatgcggacagactttgatgggaggatgctgaggagacagagattctgtgtgtgcctttgaaggttctccagttcaggcattaaaacctcctgctgcaggggctgtggaccccttaacctgctgaccccggggcaggcgctgaggccaggctgagccagtccacaggatgaagacaccaggacccgtgaggacgggggctccccaggggacgtggctttgggcaattgctggctgcattccttaaatccctgtttggttatatccaccccaacaacaccagtcactcgggagtcctgtgccagaaacacaagccagggcctgcagtcctcggcctccagctccccagcctcagctccccggcccccagctccttggcctcagctcccgggcctccagctccccggcccccagctctccggcccccagctctccggcttccagctccccggcctcagctccccggcccccagctctccggcctccagctccctggcccccagctccccggcccccagctccccggccccagctccccggcctccagctccccagcccccagctccctggcctccagctcctcggcctcagctccccggccccagctccctggctcccagctccccggccccagctccccagctcccagctccctggcctccagctcctcagcctcagctccccagcctccagctcctcggcctcagctccccggccccagctccccggcccccagctccccggcccccagctccctggcctccagctcctcggcctcagctccccggccccagctccctggccccagcaggagctaagttgttacagggtttccccatccacaaagacagcatcacgaacatccacaccccctaggatgcctggagtccacatcctcccggggtgcctgggagatctctagaattcctgggtgtcacatcccctaggattttggggtcctagcaatgccaacacctagacgaaggtcaggcatggccacagaggccaccctagctataggaaaactctctgaaagcttcgatgttagctccaagcagaggcttggtccaggagggctgaaatcctcccatttaaaacctctgaaaatcttgcctttcacaaacagccccctggaggaaatgtttttttagcatgatgcctgataaggacacaacacagagctgcagcgtccgaccgtctctcctccacactggaagggaacaacaaacaaagcctccgcaagcttgctaagaaacggggcatgcacaacactttactgcagcaagagacgatttatccagttatgtggtatcagatatttttaataactacttttctgaatccaaccaagatccggccctctatactcttaatacagtgaaacttatctgtgtgtggagcctgcacttggaaaactcggaaaaccttcccagaagcaaagtgaaatgctgcataccacgaccacaagtggcttatccatgcatgtggccgcacactgagatcccggtggctcatccgtgagacatgtggccacacactgagatcccgcagtggctcatccgtgagacacgtgtccgcacactgagatcccgcagtggctcatccgtgagacacgtggccgcacactgagatcccgcagtggctcatccgtgagacacgtgtccgcacactgagatcccgcagtggctcatccgtgagacacgtggctgcacactgagatcccggtggctcatccgtgagacacgtggccgcacactgagatcccgcagtggctcatccatgagacacgtggccgcacactgagatcccggtggctcatccgtgagacacgtggccgcacactgagatcccgcagtggctcatccatgagacacgtggccgcacactgagatcccggtggctcatccgtgagacatttggctgcacactgagatcccggtggctcatccgtgagacatttggctgcacactgagatcccggtggctcatccgtgagacatttggctgcacactgagatcccggtggctcatccgtgagacatttggctgcacactgagatcccgcagtggctcatccgtgagacatgtggctgcacactgagatcctgcagtggctcatccgtgagacatgtggctgcacactgagatcccggtggctcatccatgagacatgtggctgcacactgagatcccgcagtggtgcttatctcaggaaggaagagctggtcatgcctggagccccctgcatcatcatcggctccttccccagggcaggtgccgctctggaagcctccccagtctctcccgcggacctgagtcctgctgcagccactcgctggcatgtgacactgaccatgccctgagacctgccctgttcacacacctctagaagactacctctcatccccatgccactggataagtggctgactgcctcctggatacctggctaaacttcaaaaatgctcctgattttgtttttttgtattagatttgtgtttcggctcatttcgttcctctgctgttataaacagaccctggatgacagagctccaggatcacagcaggcactccaggcaaattgctttatctctcaacatggaatcaggaaaatgctgtaaatactggacaaagtctgtcctgcacaggcctcgcccacagcaaacatggagctgccagccctgaacaatgagcaaggctgagcgtgctcaggctgtcagcaaggaaccctccagggagacccagcaagagaaccaacatccgcctgtgaggaggtcgggctgcagacaagcccagccctgggtcctgcgtcctgggtcctgggtcctgcgtcctgcgtcctgggtcctgggtcctgggtcctgcgtcctgcgtcctgggtcctgggtcctgggtcctgggtcctgcgtcctgcgtcctgggtcctgggtcctgggtcctgcgtcctgggtcctgggtcctgggtcctgggtcctgggtcctgggtcctgcgtcctgggtcctgggtcctgggtcctgcgtcctgggtcctgcgtcctgggtcctgggtcctgcgtcctgggtcctgggtcctgggtcctgcgtcctgggtcctgcgtcctgggtcctgggtcctgggtcctgggtcctgggtcctgcgtcctgggtcctgggtcctgcgtcctgcgtcctgggtcctgggtcctgggtcctgcgtcctgggtcctgcgtcctgcgtcctgcgtcctgggtcctgcgtcctgcgtcctgggtcctgtgtcctgggtcctgcgtcctgggtcctgggtcctgcgtcctgcgtcctgggtcctgggtcctgggtcctgcgtcctgggtcctgggtcctgcatcctgcgtcctgcgtcctgggtcctgggtcctgggtcctgcgtcctgcatcctgcgtcctgggtcctggattgagacagaagaccctgggccgctcaagcagagcccggctgcagccccaacctggaatccgtccttgccacgaagccgatgtggaaccatcgccgtgctcagtggagggaccatgagttcatggcgtgattagctgggaggtttggaaacagcaaaagcaaaaaggcatctcccacaatgtccagtgactcaagtctacagagcttgtgtgcaaattcccttaaagtccctcctcatcttcagaagatatccaatgactcaagtctatggagcttgtgtgcaaattcccttaaagtccctcttcatcttcagaagttgaaataggaaaggaaaaggcaacacttagaccaaatgctgaagtcaacgtgacatgtaggatgtgatttgttaagttacactgacatctggtggccttcagtgttagaagagaaacacacgagatcctgtgatctgaaacacacatgatcaaatgtgcctttgcattttctttggtattgaaagcagacaacaccagaggcagcattaaacattaataaaatcatgaataaattaataagaacaccactatgcatatttttcaatttaataagccaaaagtataaaggatgattttcttcttcctaggccaaatcttcttaaggagcagattacagtagctttctctacagtggaatttttcaaatagacttttaagagaagaagaggaagaagaagaaaaccgtcaccactgtgtatcagcccggaggtgggtccctgcctgtgagaactgcacgtggtggactcatactgcatcttcagaggaagcagatgttcattacttatttccagaaaatgacatttattactgtgttgcaaaatcaaaatcataaaacaagcaatttgatgggctcagaaaaagtccaaatgataagaaaaggtaaattgcataatataaataaggtgtttcctccgtgtttgcagaaatacaccaaacgtgtgaccacccttcgtgaccggactacagcaataactaagccagtggggtaggaaggagaatcggatcaaaagttcacattttgatcaacgtcacatatgcttgagataaaacgctgctaacgtcaacactggactcaccccagtcatattaacattgacacgactcaccccagtcatattaacattgacaccaaacacagcctaaaactctgttaccacaaacatgacttaaacgatacaaagttaacctccatatttgctatacattctagtaatgactttgctctccttaattaaaaaaaaaaaaaaatcaaaagatcatcctcccagaccagattccaagctcagtgctttatgtacacaatcatatcattttcgtaacaccctgaaagttctgttttcattcatgagaagcccccgcaggtaatgcttggtttacgttaatgagtagatgcagactgcagtgcatctactcatttggggctcacctggggcctcacctccaaaggggctcctggagatggcagatcctgtggggcccacgctgacctctgcagccagaagccagccattgcctgtgttcagggctggccctggcagcatatggggagatgtgtgcaggagcaggcagtgagcaggctggggaggtgggcagtcctcagcttaggagaggacctacccaggcataagcgtggacctacccaggacctacccaggcatgagcgtggagagggcacagaagacctggtcagtctgaggaaggaaagagtggctgctgctaacagatagagtcaggtcaatttccccagggctgccttctgaagctggtttccatgttatgaacatgcctgaaaaggaccgtggttaaagcagctcaaactccggcaggagaatttacgaagcatccaagcccctcctctatgtgaaccaaagggtggctgtgagggttccgggggtctctaacaacagaaaacctccactggctttcaacctcacctgccagggaaggggccaggtagggatcgcgcaggccccctcagaccctcgctctgaagaacaggtgccctcacagagcatgccgacattcagaactgtcctgcagaatctggcaagtgttttaagaattgacataaagagctgagaagatgtgttgacgtcgcctctcaaaaaatctggctttaaaaaataataataaagctagtgtttttttgagcagcttccatgaacttgccttccaaagttttctgaaaacttgagaagatggggtgtgcccccacagccccagctgcctgaggttcgctgaacagcctgggtggctccgaggcgtccccgcagattcagcctgatcactccttcggtttcctcctacggctgcaggcagacctggagttcatccgggtgacctccacagtctctggccaccttccctccatttaagaaaaagaaaaacagcccatgtctgagccacctccccaaaccctctctgccttcaagcatctgacaagctaccctcaccacacaaggcccgctccctctctagagagcctctcccgacaccaaaatgtcaacctaacacgacactcaggacacagctgtcatcccgaaggcaggagatgtgggggaaaggacacagaatgaggtcacgatgccagagtcaccctcgtctcatccccgagtacccaggtgactacagacaggagaattaatctccttctcgtgggatgaagtgacagagtagacacctgtgagcccacttccagctccagttaaggtttcctctggccctgaagttctgcgactctgaggcatgtggggtgaccaagggcagaggctcccagtctgtctcaaactacaggctttgagcaaggtgagcctccctaagcttcggtttccccaacttcggtaaagtgaaataacaaaaccacgagtggctcttaacttctctgggaatgtccagccagagcctcggaatgtaactacgtggaaacagggtcctcgcagacctcattattgaaggaccttgaggtgagatcatctggatccagggtgggccctaaatgtagtgattgacgtccctgtagggagaggagaagacacggagacacagggaaggggtgttggtggagtcacgggtgggaggccccggagggacagtgcagacaagtgcccaggtgaccccagacacggagacacagggaaggggtgacgggacagtgtgctcatggggtgggaggccccggagggacagggtacacaagcacccaggtgaccccagacatggagcgtgagtaggaaattcacttggtggtgtcaggccacagagatccggacaggctgggctgcccctgcgaacccggggccctctcctccctggcacagccttattttcactcctgcagctcccgagaggaggcctcgctcttccacctgtttctgtgtcatgggacccttcacagagcaggcactcaaaacccatgagcaccccatcccttacaaccaaacgcagctccgtttctgcctcccacggcttcttcacacgcttcccagtgggttcattctcccttccccacgtaaagatgtgtgcagccacagctttccggccaccttgaaatgaggtgacatctccagtcgcttcccgtgatgaagtgcggggcctggcactgcgcactgctgcccctgctgggtcctcacagctccttcagcagcctctggggtctcacctcctggtcccctgggcccttgcacatgcccggccaccactctctggtccccccagcactcacggctcacctcctgggagccaaggcacctgcaagtcctgctgtcgtcccgggaacaggggtccccttcccgtgggagatgggatcccccaggtaacacagccagtcagagggcagcatcagaactcactcgctgtccttgtctacactaagcactcaacttcaagttgggaaacctgggtaccaagcagccaaccaacgccaatggaggtggaaggcgccgccccgcggcactcacacccgcctcagatgggagcatggtctcaggggccagggcccaggtcttatccagactcagctgctctgtgacccaggtcagtcactggccttcctcccgggctgcttctctgtggctcaggggacaataggcccatctcgttaggctgccgtgagggtgaaatgaggctgcgcacatgagactggggctgagaacatgcgtgggccaagaacacacctgccagggcccatcgcagcaccctcatcagctccagggcccatcacagcaccctcctcagctgcagggcccatcacagcaccctcctcagctccagggcccatccagtgccctcctcagcaccagggcccatccagcaccctccttagcaccagggcccatctcagcaccctcctcaacaccagggcccatctcagcaccctcctcagcaccagggcccatccagcaccctcctcaacaccagggcccatctcagcaccctcctcagcaccagggcccatctcagcaccctcctcagcaccagggcccatctcagcaccctcctcagcaccagggcccatctcagcaccctcctcaacaccagggcccatccagcgccctcctcagcaccagggcccatctcagcaccctccttagcaccagggcccatctcagcaccctcctcaacaccagggcccatccagcgccctcctcagcaccagggcccatctcagcaccctcctcagcaccagggcccatccagcgccctcctcagcaccagggcccatctcagcaccctcctcagcaccagggcccatccagcaccctcctcagcaccagggcccatctcagcaccctcctcagcaccagggcctatctcagcaccctcctcagctccagggcccatccagtgccctcctcagcaccagggcccacctcagcaccctcctcaacaccagggcccatctcagcaccctcctcagcaccagggcccatccagcaccctcctcagctccagggcccatccagcgccctcctcagcaccagggcccagctcagcaccctcctcagcaccagggcccatccagcaccctcctcagctccagggcccatctcagcaccctcctcagctccagggcccatccagtgccctcctcagcaccagggcccatctcagcaccctcctcagcaccagggcccatccagtgccctcctcaacaccagggcccatccagcgccctcctcagcaccagggcccatctcagcaccctcctcagctccagggcccatccagcaccctcctcagcaccagggcccatccagtggcctcctcagctccagggcccatccagtgcccttctcagctccagggcccgtctcagcgccctcctcagctccaggacccatccagcaccctcctcagctccaggacccatccagcgccctcctcaacatggctcccttccctctcgccactgagcagacttgataacagatgcaagctcgttccagacccacaagaaaatccacagcaagacaaattttgtgccaaagttgggttcaagatcaaaaacaatcctttgtatctcatttgtaataagtcgtaggggctcacgagaaaaggaaagataattcaattttgaatgtatgtttacatttcctaaacagctcacttagcatctgaacccgaatgcacacaaaaaaataaaacattgtctttaaggaaataaaatgcagtgggcctaacatggcccccaattggccaagtcctcttctcaactaggaaactggccactgtccactctgggcctgtgactaacacagatgaggatctcttgtccttaaccttttccgactcccctcccagaagatggcagggctcaagaggcctgaacgggaaagccccgtgtgggctccatggcgacctcagcaggcgagcccacccctctcccgggaggactaacagtgggaagacttctgtgggtgggagatgaggaccccagtctctcagcctggtgtctgtaaaactaggagaacgggcccatcctgcgggtgctggggagcctgtgggacacacaggaagcacttgtgtgtccaggcccagcggtcctgacccagccttttcagctcaacctgggccacccttaaacatggaggcaagggccaggtgtgatggctcacgcctgtaatcccagcactttgggaggccgaggcaggtgaattacctgaggtcaggagttcgagacaagcctggtcaacatggagaaaccgtgtctctactaaatcacttgaacctgggaggcggaggttgcagtgagccgtgatcgtgccactgcacttcagcctgggtgacagagacagcctctatctcaaaaaaaaaaaaaaaaaaaaaaaggaagcaaggggattcctagtgttccagcagggggagaactgtggttctagcaaatcctctaccaagtgagtaccgtgcacttccagagcgtagggaatcaggtgctcaaccccgaacggcccatagcagagctctcccgatgatgcagggcacaccaggagtgaggacagcagcactaaaccatgaggttaagacaaaggggctgacagggagcagtcacctgtgagaatttaaagagcagaattaacgggctggagcattaagccccaaaggacggatccaggagggtgcccgggcggttaacaatggctattcaggcctaagaaggaaagaaataaccttaaaatagaatcccatcccatcctcctggaccagatttcactacagtaattgcatctgtgaggaagagagctgcaaaggaaattagatgttctccgggctcagctgtaagtcatacatcagagccacccactgagaattcccattaggaagaagctggcacgagctcacatgcgggctggaggccgcccccgcttccacggcccaaaaagctgtccccaccgaggtcctcgatctggcataattgccggcattgtgccgtgcctcccgccctggccacatcaatgtggctcattcttcgaggctccactgaacgctgggagctgtgttgaaagtgggggaggggcatccactgatgaagcttccggagcatctccatccagccagctccctcacaccaactgaatgagccagcgtgctgtaaggaaaacactaccagtcatccacatgaggaggggcgggggaaggtacctctgcctgggacaaaagcctgcaaggaaaacaggagctgagcactccagccataatacaaccagctactttcctgatgatacaaccagctactttcctgatgatacaaccagctactttcctgatgatacaaccagctacttctctgatgatacaaccagctacttctctgatgatacaaccagctacttctctgatgatacaaccagctacttctctgatgatacaaacagctaatttcctgacctaccaagaggccagaaaccacacctcaactccctgcttcccaattaatctttactctgcagtccccactctgggccccagcgacagtattggtgaagagacgcaaagctgatgaatgacgtcaaacaaacaaaaacaacctgtagcaggtggcttcaagaaaccctcctgctttccttcctcaggggagagagccagcagccttgctgcctgggtttggaagggtcaccccaggccctacccaccatcctctctaagcccccaccagctgcttcagccctggatgacactggacaccacctgggaccctgaaaatgcaggtgcctgggccccacctccaccagattcagatgtcactgctccggagtgcggcctgcttaccagacttatctgagcactcccagctactgtggatgtacagaaagggtttagaaccatgggcccattctaccaacaagaactgcatataccacgggccccgcctcagagttattgttgaggacttgtccccccaccccaccctacaatggctcattaatatcccatacacgcaaatcctcgtcaaagaccctcaatgaagtatgcaggccacccatgcctcttcctcattcaattgataaatgagaaagtttcttaaggaaaaattaaacaaatcaggtgatttagcctagttttagtcactaagaagggacttcagagtagttcataaattgtctctaaggattttcaataccagagcattcctcagagggctgggtggtcccctagaagcccctgccacccctgtgtctgctgtggctggggctccacatccccatgacgtgtctggtggcagccaccacagtcctgtctcttctaggaatctaagtgttaggttctggtttcttctcttccacatccacctttggtgttggtttcagaaacagcaaatcctacaatccacggttcccaagcctgactgcacacctgaaccatccctaaatactttccacacaggtgccttccctgggccccatgcactggaggaagccttctgtgaaggtccactttggggcccaggaatgggaatccagcttcactccatagtcagccaggcttgggacaactgtggtggatgatctgattgcatccgactgtcctcccttgcaggcccaacccacagggatacatggccaaagtttagatatgcacccccagcccccaaccacacagtccagatttcaattacatggcatgttaaccgagtaactacataaagtacaaagtgtgctgccaggtgtaggcaacaaaccaccacatgttaacagccatgtgggattggtggctgcatggggattggccagggtgcctgtcactcagctcagcacagacagcaaagcatggagctgtgtggccacatcatctcccagggagaaaccaaacaacatttcgcagaagtgaattatcagaagaaagaacagacaaacaaagatataagtgcaccagagaatgaaaagggatggtgctggaagtgaaattccaaagaaaggccagggggcaggaaacagacagcctgctgggaaacatagactggctaccatgtgggacactcacggtgctgcaggaacctaaggaaggcaactcatccgcacacagcagggaagtggctgtgagggaaacgatgatatccaggggaaatggggcaataagaccttcacagtaaagggacactcagaggcacttcaccaccacaaaatggcaaagcacaaaatgttggagggcaatccagactcagaaagggattgacactcagcaagccatggggagaatgctcacaactatcacagcctagacaaggattcaagtgccacacacactacatcgagatgctctacctctcactgtccccctgtgctaagtcacagtgcactacatcaagatgctgcagctctcagtgtcccactgtgttaagttgtggtgtactacatcaagatgccgtagctctcagtgtcctggtgtaagtcacagtgtactacattgagatgctgtagctctcagtttccctgctgtgttaagtcacagtgcactacaacaagatgctctagctctcagtgtcctgctgtgttaagtcatggtgtactacatcgagatgctgaagctttcagtgtcccactgtgttaagtcatggtgtactacatcgagatgctgaagctttcagtgtcccgctgtgctgtcatggtgtactacatcgagatgctgtagctttcagtgtcccgctgtgttaagtcatggtgaactacatcgagatgctgtagctttcagtgtcccgctgtgttgtcatggtgtactacatcgagatgctctagctctcagtgtcccactgtgttaagtcatggtgtactacatcgagatgctgctgtagctctcactgtcccactctattaagtcatgatgtcctacatcgagatgctctagctctcagtgtcccactgtgttaagtcacggtgtcctacatcgagatgctctagctctcagtgtcccactgtgttaagtcacggtgtactacatcgagatgctctagctctcagtgtcccactgtgttaagtcacggtgtactacatcgagatgctctctcagtgtcccgctgtgttaagtcacggtgtactacatcgagatgctctagctttcagtgtcccgctgtgttaagtcacagtgtactacatcgagatgctctagctctccgtgtccccctgtgttaagtcatggtgtactacatcgagatgctctagctctccgtgtcccactgtgttaagtcatggtgtactacatcgagatgctctagctctcagtgtcccactgtgttaagtcacggtgtactacatcgagatgctctagctctcagtgtcccgctgtgttaagtcatggtgtactacatcgagatgctctagctttcagtgtcccactgtgttaagtcacggtgtactacatcgagatgctccagctctccatgtcccgctgtgttaagtcatggtgtactacatcaagatgctctagctctccgtgtcctgctgtgttaagtcacggtgtactacatcgagatgctctagctctcagtgtcccactgtgttgtcatggtgtactacatcgagatgctgtagctctccgtgtcctgctgtggtaagtcatggtgtactacatcgagatgctctagctctccgtgtcccgctgtgttaagtcatggtgaactacatcaagatgctctagctctcagtgtcccactgtgttgtcatggtgtactacatcgagatgctgtagctctcagtgtcccgctgtgttaagtcatggtgtactacatcgacatgctctagctctccgtgtcccactgtgttaagtcacagtgtactacatcgagatgctgtagctctccatgtcccgctgtgttaagtcacggtgtactacatcgagatgctgtagctctccgtgtcccgctgtgttaagtcacggtgtactacatcaagatgctgtagctctcagtgtccccctgtgttaagtcacggtgtactacatcgagatgctgtagctctcagtgtcccactgtgttaagtcacggtgtactacatcaagatgctgtagctctcagtgtcccactgtgttaagtcatggtgtactacatcgagatgctccagctctcagtgtcccactgtgttaagtcatgttgtactacatcaagatgctgtagctctcactgtcccactgtgttgtcacagtgtactacatcattgtcagactcactgttttcatttccatacacacttagattataagagtttgtaacgttttcacaacattacaggtcatgaaacaatcctcattttcctataagttattccagtggctcacatagtccttgccacttctccttcaccatgcaatgaggtacaacctggtattggttttgtgcttgactctgaccctcttgccatcttttgtaaggttctgtgtttaaatattgcatttcaggcagctgtggtgttgccagccttgaggcagggttctggagcctgaagacatgtgtccttggcagtaacctgtgtgtagacccacctttctgaaattagacccagatgctatctcaaagctaaaagtcattttcttgacatcaagcatttttggcctggaaagctccattttagaaaacggctgttttgcaaacattatataagctgtcaccagcaagaattccgtcactgcaagaattccttcactgcaagaattccatcattgcaagaattctgtcactgccgtaatcactcatcagagactgaggaagtctcagtcaagtgcacggggcctcgggactctcggaggtgcccagctccacagacccttccacatgggaaggcagcagagtggctgctctctttcccattccctgctctgggagtgtcagccctgactcacacagccctccttccatgtcacgccaggagcctcaccacgcagcactgcagctggaatgagtgaaatacctgatggaggacttggagaagagagtcgaattcacaagcctccagcactcggtgtggccagcattcaccactcagggatttctaagatcacacgtgatgtctgaccggactcagaagctcacacgtgatgtctgaccggacttggaagctcagcacttcgttattttattatctccaaatccaaaagaagtggcagtcattacttcaaagcccactcctgaaggaaaaggcccactgacaccagtgctggtgatgcaatccacctatgttagcattggaccccgagctgtgcctgaacctcggtgcctgcattctttactcaacaggcatctgttgaaactctgtcatgttggccactgttacaatcttgtgcacaggacctgacccctaaggtctccagagctttggggcattttatcagaggttcctgccacatttgtgtccagcacaacagtgagtaaagaactgggaacatgttctccctcccaattcctcccgttttccttcccaaggcaggcaggacacattgtctcacggcgagctggccttaccctgaactcagagcatcagcaccccaaagctgcagtgaggaggaagagactgcccacccgcgaaaaggcccctcagtcttcagccaacaccacaggcacagcttcagccctctgactcttgctgaccacgggttaccttggatcttctctcctttgagggcaactgagccacatttggctcctttcagaacatagaatcttggctttgtcttttcctgggcttggggtacctgggactccagcttcaggcacagggtccagcacacattccttcttcttcaccaaaagccaatgagatcagcatagttgcaaagctgccttatgtttttaatgagaagagttatttacaaaaagagatggcttgacaaatatcgtgcataagcaatcccaccagtgcgcattgcccctgagttcccttccctctgagacccaagctgtcatggctgtgagccatgcagatgaggtcctccttgtcatcctagtgggcttcccagaagatactccccatcatccgagtgggcttcccagaagataatcccagtgactgagtggttcctgcctcccttctccggccacatttgtgaaatatgtaagcagcatgtcttccatggaagcggggatgaagtgacggctcggagtcagtttcctccgcgtccctgttgatgagacgtggcagttgcatgaggggcaggtcacaggcggttgtggcttacagacgccctgggttccaacagggcctgacagagatgtccaattccagggatcaccttcccattcttgatcggacccataacatcttagaaagcacaatatactcagttctgcccatgtcatcctctgctcaagtatctgagttcaaggtcatttctggactgaggattcccgtaccccattagacgtgtgtggctcagatcttcagtccaggctttggaatcgagggccagccgcaccccttgttgctcccattctggctggtggtcccctggtgcacctgtcatgtcctgcacagctctcaggcctttggttgaaaagctgactggaatcacacttgaaaaaagagctcagcctgtggatattagtgacacccaccctggtaggaaatgaacatgtaaggctgagtttgtttcttggagttttcctatttattttaaagttggggtgacaagcactgggtttttgaacactgagcggagggcaacgtttcattatttatgcaaagtgcatcgacaaagcgacattgaaagtttttgccatattttcctctttgtagtttctccaagtgagatatgtcaagaagcagctttcctgtgatgtgcctcagaaataaatggaaagaaagaaacgcagcagatggcttggattaaatctgaacagtgataagttctgcttttaggacagctgggtaatgtactctttgctcaaaaacatgtttgatttgaaacacaaaaacaatcttatggtttccatgaaaatgaaagaaaaatgaagctgaatcgtggagtaaattgctagttttctccgcagcatgttctgggctgctttgggagccatatgctctgtttgatgtaaatgagatggaactgaaattaaaaagttttacatttaaaagtagtgaccaaacctattcatcaatgcctttgggcattctaataaagaatttttattagccctaaggtttggggttaaaaaaataaagtttgtcttaaccctgaacaacttgggcccaccttcattttcaggtctgtgaaatattcaagcaacagatgctgaagctagagaccaagttactgatgagggaggtagtttggttcttggcaatcaagttctgcattaataatcgagcctcatcacagaaatacttcaaatccacttttcacagaatatctactgaaaagtatcactaaaacgcaattttgctagaatccattaattttacgagctgactgaatcttcctcagagatcaaaaactgcaaaggagctagactacaaggaactgaatttcagtcaaccttttaagaaatgcagatcagaatgcaaatcctaggtaggttcttaaacagcaaaagacagcatccacgtctctgcaaaaggcttgaactctttggccagcttggttggggagagctggaatggcaggttgagaagtaccaacaaaccccatcaatggcagcttccaacaccatctgattttctgaatttcaaatctggacacggaattgagccggaaaactctgaatgctgccagattctcatttcagatgcacacacatactcttacatgtctcaaagaaagtaaaataaaaggaagatagaaagaaggaaaaagaagaaaaagaaaccctgtagtccacatgaaagagcaaatgccatctgaaggcctcagcagctacacgggatgtcatacctgggctgacgctgccggcttctggggccacccttcggacgtggtctcagtcacacccaggctgacgctgccggcttctggggccaccattcggatgtggtctcagtcacacccaggctgacactgccggcttctggggccaccattgggatgtggtctccgtcacacctgggctgacactgccggcttctggggccaccattcggacatggtctcaataatcttcccgagctcggccagctcacaggagctcaagcttacaagtagttggtgtgtaatttgcatggtcagtagagacaaagaaaggcttcaaagccactgcacactcctgctgctctccagagataaagcgaggagagggtgacgatagccaatcagggcccacgccagtttcccagataggaaccatggccgataaacccgagaccacaggtgttccatccctgctactcagcccaaagcaacaaggaagcctgaggtgacaccacaaaatgcaaatttatctccaacgctgtcacttgttaagatagcaaagaaatgagccttgatccgtgaataaactgtatacatcaactcatctgggaaacaagcaagaaacccaagagaaaccacgggggagaaaccgggatccatgttctatcccctgctgctgggccagacctgagcagcacggcagtgaaggaagtggatttggggggcttccctccacccacagtaaccttcctttgctgagtgatgcaagcctgacctttccggggagcacccatgacctcgtggggacacggtgaaccctagggacatgaaatggtcccgccctagcttcctctccagtgccctgcctgtcctgcccagggcactcccaaaatgtctcaacgaaaatgttcttagaggggaagaggtctcagagattagcccctctggttcctcattttttttttttgagacaaagtctcactctgtcacccaggctggagtgcaatggcaccatctcagctcactgcaacctccacctcctaggttcaagcgattctcctgcctcagcctcctgagtagctgagattactagtttttgtatttttagtagagacggggtttcaccacgttaaccaggctggtctcaaactcctgacctcaagtgttccgcccacctccgcctcccaaagtgctgggattacaggcatgagccaccacatccagcccctcattttctagatgaggaaagagaaactgggacattacagtccctttacggccaacactggaatggaatcctgaaaactgctttgcacggagttctgctgtggtctgtagtttgcatgtatcatttcctttaatcctcacaactcccctctaaggtggtaattaccttattttcacttttttagacgagaaagattaattcggaagaggctaaacagctccaaggtctccgagcagagaggcagccgtcggattccggaacctgctggaccaccctccaggcgcccagtgatttctccagggtggacacaggcttacgtgtggcgcaggagtgctctgtgacgtacacaaggcgcatcccacaggtggatgcagagaggccagagaggggaggcacctggcaccatcccgttctgttttcggtgcggcccgttcttcgggctttattaagcaactgcccacgtggaagaaaagcaataatgaagcaaggcgtcgtatcgattcccccagctgtaatggaattccgtcaaggagcaaagcgaggcgttttcagaaactctgcctgttaacgtttattgctcccaaagtctgattataacacactagctccgggggccgagtgaacatcacttcacacaaaaacagggacaacgtctgtgaccaccggagatgaatattagtgaaagaactgactctcccgattcctctattaacctgtctctggctacattcaaacaaatcatatgtgtgtacggaacaggctcatacacacatgccagcacgcgtaatgcccagtggtcagaaaatgctcttcaaaccggggactgagacgcccgcagagcgcggccctgagagccctgagagcagagtcaagcacgatgctgctgcctggccccagtggccatgcatgtgccgcaccctcgagaacatctggggacctcggggcccacaggcattaaccatcagcttaatctcccacgccaggtgtgctcagcaccctcgagaaggtccggggacctcggggcccaggggcattaaccatcagcttaatctcccacgccaggtgtgctcagcaccctcaagaaggtccggggatctcggggcccacaggcattaaccatcagcctaatctcccataccagctcaccaggtctggggcccgggtgtttcggagaaggcattctgtagttataactaccatccaccatcaggtgactgtcggtaaaggaggggaccctccttcatgtggccatcacttgaggccttaagacaaaaacaatcatgttcattgctgctaagaacccaaaacaataggctgaaagtcctgctgatgcactgccaggaaagacgcagagtacgagaccagtctagctgaggcctgcgcaccgccgggaaagacgcggtgtccgagtccagcctagctgaggcctgcgcaccgccgggaaagacgcggggtccgagaccagcctagctgaggcctgcgcaccgccgggaaagacccagagtccgagaccagcctagctgaggcctgcgcaccgccgggaaagacgcggtgtccgagtccagcctagctgaggcctgcgcaccgccgggaaagacgcggggtccgagaccagcctagctgaggcctgcgcaccaccgggaaagacgcggggtccgagaccagcctagctgaggcctgcgcaccgccgggaaagacgcggggtccgagaccagcctagctgaggcctgcgcaccgccgggaaagacgcggggtccgagaccagcctagctgaggcctgcgcaccgccgggaaagacccagagtccgagtccagcctagctgaggcctgcgcaccgccgggaaagacgcggggtccaagtgcagcctagctgaggcctgcgcaccgccgggaaagacgcggtgtccgagtccagcctagctgaggcctgcgcaccgccgggaaagacgcggggtccaagtgcagcctagctgaggcctgcgcaccgccgggaaagacgcggggtccgagaccagcctagctgaggcctgcgcaccgccgggaaagacgcggggtccgagtccagcctagctgaggcctgcacagcgccgggaaagacgcagagtcagtccagcctagctggggcctgcgcaccgccgggaaagacgcagagtccgagaccagcctagctggggcctgcgcaccgccgggaaagacgcagagtccgagaccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccaagtgcagcctagctgaggcctgcgcaccgccgggaaagacccagagtccgagaccagcctagctgaggcctgcgcaccgccgggaaagacgcggggtccaagtgcagcctagctgaggcctgcgcaccgccgggaaagacgcagagtccgagaccagcctagctggggcctgcgcaccgccgggaaagacgcagagtccgagaccagcctagctgaggcctgcgcaccgccgggaaagacgcggggtccgagtccagcctagctgaggcctgcgcaccgccgggaaagacggagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcagagtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccaccgggaaagacgcgggtccgagaccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacccagagtccaagtccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagaccagcctagctgaggcctgcgcaccgccgggaaagacgcggggtccgagaccagcctagctgaggcctgcacagcgccgggaaagacgcagagtccgagaccagcctagctgagtcctgcatacctaactccgccgaggacttacattctgatttcaggggttctcttagcctgtcaccaagtgtttaaagaaggttatgatgaaaccaacaagccaatccgagtgtctttaaactggggccacgaatgaaattcactcctgtaagagggcaggggagctggggcactctctcatcccaaaatggaaaaacattcatttttaacagtaataaaacatgaggtggtgaaggcacagcggcgtcggacgtgactcgcagcgcatccaagacaaggggcctgctcttggtggctcagaagacgagggcggcagcaagaccctcgggggaacccttagggaagtcaccgggttgtccttttaaacgatgtgtgccaccgcacagaaactgcaaaggagaaaactaaaattatttgtaacccaccgatctgaggaaacggctgctggcattggctgtttctctccatggttgagatcgcagtattgggacacttttacagctgcctttgtcatttaacactattccaccggaattttcttatgttcttaagaaactcctaagaagtataattttagtacctgcaaggtatctgtcacagagtcaccattactcgaccaggcctctgtttcacacagtcgggtcgtttttagtcagtgatccaagggggccgggcggtgaaccaagtctaacggaggcagtcacagttcagtgacagagttccttcctggttctgatggggaagttcagtcaccgtgtctgtatgttacttactcgcttctttcagggtcttttccaataaagacagctatttttcatggcaatggaaattataaaagcagctaccgtcatgcagatcgtcctgggggcatcccagctgcaccctggtgccgggacagccttactgcaagaaaaacagggtgtgggaggatttacgagttccagctgagccagctacatcaacctgtgggcacgtggcgggttggtggccaagcctgaactgagaccaaggctttggactcctagcactggctgtctcgcttgctaaaccgtaatagtctcatctaactgctctgtactaagaacatgcttccggatccaaccgatgtgtttcggaggtgccctacccattcaggggcagggtggggctgtcacccagtcgagaggctttcctgaagccgagagcactgggaggcagcatctgagacctctctccacagcaggagctcccccacatctccagggaagaacacgttccagcagatccacagccggcacaaaggaaaccttaggaaggtggtgctaggctctccacgctggtccttagcagctgttcctcctgcagctcagagctcagcatcccttctccaggaccttcccgccatcaggcactctctgcaccacccagctccaccaccatctctgcctcgttcccacggaccgtcagcccaatgctgggtccccactgcagcttccacaaacccttagacccgctggtgatgtgctagctccctcattcccggcctgggagagcctggcctggtcccacctccctcctgccaccctccgctcaagcacatggccatcccaacagcagagccctgtctgagaggaaagaactcagctccagaccgccagcaggcaaacatatggaaagatgggctcaactcagtttctggtttttcactaattcatggcttttttattaaatgcaatcttaatacagatggatgcaggagtgggtttccataacaggccatggatggtgagctaatggcctgaaatgtcaagtccaaatctccaaacaaaagtgatcatttaaaaggaagatgtgtgtagccgtactcgtgggacataaactgttctttttcttttcttttcttttttcttttgagatggagtctcgctctgtcgtccaggctggagtgcaatggtacaatcttggctcactgcaacctctgcctcctgggtttaagcaattctccttcctcagcctcctgagtagctgggattacaggtgcacgctaccacgcccagctaatttttgtatttttagtagagatggggtttcactatgttggccaggctggtctcaaactcctgaccttgtgatccacctgcctcggcctcccaaagtgctgagattacaggtatgagccaccacgcccagctgggacatgaagttttcttaaacaacaatgctttgtaaggatcccaagcagcagaagaatccaactgaattgaaagtgggctaaagagtgcacaaactcagcatgggatgaggtgagggagagcagcctgctggcgctcacaggctgaggggcctgtagacccggaagtcggtaccacttgtgggaagtctctggtgaagatgaaaaccaccccaggcacattcacagaaatgctctggggtttgtggaccctgggcatgttcccagaagcgctctgtggtttgcggggcctcgcacggctcagcgcggcaccccctccctgtggattcccgctctgagagtcaagatcactgcatgggagtgcattgcttcttgtcctaattgacagggaacatttggtggtgtctccaccacaagagacgcagcatggctgcgggaccagtgaagccataaagcccactcggtgccttgtggggccgacaccgtgtcactgcaggaagccgcagcccggcctggatttccaggaagcaaggccagctcagcacagacacaactcccatgacagcttgaacccagctcacccccgctatgagagaaacaccgggtgactgacctggagtgaaaacagcagtgaggaagggggaagagccccccacactctcagaatggtctctggacggagacccccaggcagtggccatctgaccctggctgtgtctgaccgtggaaccaaagcagacatgtttgagcagaaccagagcagacatgtttgactccagtcagcccttgagggagctggctaacgaggaccacccaagaccccagaacatgacaaatgcaaagagcttggactgaggaaagcaagttcaaattcttcactgtgtgattccaagcaaatcagaaccaaattcttatctgaatgttttcagtgacagatcaaagaaaagatcccagccagcgtgagccccaggcacacactgcctcacagcgggctcacactgggcccacactggcttacactgggtatacactgggctcacactggctcacactgggctcactccgggctcaacactggctcaaactgggcacacaccaggcttacactgggcacatactggccacacacttgctcacactggcttgcactgggcttagaccaggcacacaccaggcacactggctcacctcgagcacacaatggctcacactgggcacactggctcacaccaggcacacactgcctcacacgacacacactgggcacatactgggcacacactggcttgcactgggctcacaccagacacacagcaggcacactggctcacatcgagcacacactggctcacactgggcacatactggccacatactggctcacactggctcacactggccacacactggctcgcactgggcacacaccaggacacactggctcacatcgagcacacactggctcacactgggcacatactggccacacactggctcacactgggcacatactggctcacactggctcacactggccacacactggctcacaatggctcacactgggcacacaccaggacacactggctcacaccgggcacacactgggcacacactggcttacagccacccacccgagggacaggctggtgccaggggaagctgtgtctgagtgctccatcatgttatccgggacctgctcgtccctctctctgacctgcctgctggacaccaacaccagccctcaagtgccagcagtgacaagcccacctgagcagaaatgcagattctcgtccagcatcctcagagtccaatccactctaacaggatcccctttggtcacatgacccctcctgagccaatcactgcagccaggaccacggaacattctggctgactcacgggatgccttgtccagggcggggaggactcagagttctcgctggacctttaatgacgtgtgagggagaagagaaacacgacacggtcagggagacgtcacaggttttccccagatcctcaggggaaccacacacagtgactcatgaggagcggcggggccttgagccagggcgaaagcaccgggcgctccaggatcccaggctccttccctgaacaagcatccaaacctctcaagctagggctgactacaaacgacaaagtcctgtaacacagagctcagatagcggatttcaaacgttttgttcatgaaaatgtaacctctgtgtcgtcttggaacagtgttcaggagggggagggtgcaagctctggcccaggccccacctctaccagggaaggcaaacatcacttaaacgcctgcagcctcctgcgaaggttttctgagactatcagtaaagataatatgttttcaagctcctggaatatgtttaaagtattatgcaaacaaacaacagctattagaaatatcactttacaaactttttgttgagatactatgcattccaaagcgttcaccagtgagaagtacacagcttggtgctgcctgaagacgcagcctggcccgggatttccaggagcaaggccagctcagaacagatgcaacccccataaaacagagcttaagacaacctcaccctcactagaatggcttacactcctgctacaaaagaaacacctggtgactgacctggagtgaaaacaggaacgaggaagggggaagaggccccgcgccctgacaaatgtttacagaacaaacactcccacccagacatagattcataacccacaagccccgcccccatcctctcagtcaccatcattctaaattccaggctgaacgtcagctttgcctgtttgaactgtaggtccgtggaatcacactctctgctctcctgaatccggcttctttgcgcaatatcccatttgtgagagtcacctgtgtggctctgtacaacagtagctggtggttttttattgctctgtagtatttaattgcatggaacatcccacagttatttctacattcccctgtgcatagacgtgtaagttatttcagttgtaagctgttataaatcaagctgctgggaacattcttaggcctttttgtatatttaaggatgcatttctattgggtatgtactcataggagtgggattactagaccataaaagacagatatattcagcttccacagatacgaaccaagctgctaggcacattcttgtacatgtcctttgcatacctcagtctgcatttctgttgggaatacatgtatctaggagtgctattatttgatcacagggtaaaaaaaatacatagctacatttgtcactttattctgaagtttacaggcaaaagctgctgatgatacggattgatagcgatgtccacttttcattcctggcactggtaagttggtccttccttctgtttttcttgatcagccttgccagaagtgtatattcacatcttttaaagaagcaatgattggttttgttcattctctctaccgtacatttgttttctattacattatttttctttttattatattcttatatttctttaacttcaattttctgttctttttctacactctttagacatatgtcattttcaccttttcttcttttctaataaaagcatctaaggttataatttatttctaaccatagctttaacttgatcccaaaattcccaaaattgtttaatattgtatttttattatagttcagttcacaatattttcagatttctattgacatttcttctttgacaaatggggtatttagaagagtactgcttaatttccaaacatttagattttctagggatttttttttccatttgtttttagcttaatttctttggccaaagaaatactccgaatgatttcaatctttagcaatatgttaagatttgtttatctgatcaaaacatttccgtctaatagatggtcattttcaatatgtatgctgtgtgcactggaaaagaacacaggttctattttgatagttgcagtgtgtccattagatcaaggccattaatcccgttcttcagacctgcttcagcatgtctctctaaatacatgacaggacacacacaccaataataaaaacaaacatgcataaaaatgtgcattattctctccggtaattatctcaatatttgctttatacatttgaaaattatatcaggtgcatcaaatttataattactgtgtgttcctgatagaccaacccttatatttattatggccctttttatctcggaaaatgcttcctgccttaacatctactttgtatattagtttagatataccagctttctttagggtagtgttttcattgtattctcttccagcgtttcaaacttttatatctcaacattgaaggtggtcccttgcaagcagtgtggttttgttttttagtgacaatctttaatttttgagtggagtatttatctcatttatttacaatgaaattactaatatattgggatttatatcgactatcttaccttgtttttttatttgtctcatctgttttatttttccttttatcctttattgctttcttctggatggagtatttttattattattttgattccctttcttagcttgttagctattctttttgtggctattctagaaataataacacgggaccttgatttatcatggtgcaacacacatcacatcccacatggtgtcagaaaaactggatacacacatgcacataacaaaattggaccgttaccttataccatacacacacacaaatcaactaaaaatggattcatgccttaaacataacacctgaacctgtaaaccgcctagaaggaaatataggaaaaaaccttcatgacattggtcttagcaattattttttggatatgacaccaaaagctcaggcaacaaaagcagaaacagacaagggagactacatcaaactaaagtttctgcaaaagaaacaatcaacagtgaaaaggcaatctacagaacaggataaaatacttgcaaatcgtataactttttaaaaggttaatgtccaaaatgtataaggaactgctgcaacccaataaccaaaaacaaaataacctgattttttaaacgggcaaaaggacctaaatagacatttctcacaagaagaaatacaaatggactgcaggtatacaacaaaaatgctcgacatcactaatcgccagcaaaatctaaatcagcactacaatgagctatcatatcaaacttgttaggatacctattatcagaaaaaaaaaagatgagtattggtgaagactgtatactgttgtgggaatgcaaaaggtccttatggaaaacagtatacaggttcctcaaaaaattaaaaatagaactactatttgatccagcaaccccactctgggtttttacccaaaagagtcaaaatcaagatctccaaagagatacttgcattcccacactaactgtggcattatttgcaatatccaagatgtggccacaacccaaatgtccatcaacagatggatggatgttttacatgtggtatatctagacaatgaaacattactcagccttaaaaaagaagaaaatcctgctgtaagtgacagcatagatgaacctggaagacatgagctgagcgaagtaatccaggcacagaaaagataacactgatgatttcacttagacgaggcatctaaaatagtccaatgcgtagacccagagagaagaatggtggtttccaggggctgggtcggggcagggtgaggtattgctaatcaatgggtatcaagttttagttctgcaggatgaacgagtgctagagatctgcggtacagatcatggctgtcatcaacaatactgtgccatgcacttaaaatgttaagagggtggatctcatgttatatgttctttccacaaaaaaggacatggatccctgacttattagtgtaacacgcattatcgcatcctggataatgccaaaacctgagaacactaactcctttaccttctgtgccaccaatattcgtgttgatttaccaacccattgatagttcccactgctatccctgcctgccttgtttcctggtttccatgtgggtttactttcctcctgccagaagcccctgcagtcttttcccaagagtcatctgttgatggagtctctcgagttctgtctgtcttttcgtaggagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcaagttctgtctgtctggtcacgtcttgatttcatctttatacctgagaaacatttccagggagtagagaacttgaattgatggggtgttttcttccatcacatgcgaggttcatcacacttctggtctccatggtttctggtgaaacaattcatcaatagagattaatttcctatgatttttctctgcttgctttccagattttctcttaaactttggtttttactaattttagagtgatgttcagaggtagggttttctttgtgttcattctgtgaggttgaactaaccacacaaaactgccaatattcaactgttgtttacctttaaaatagctatataatagattttttaaaatccaagctttggtgtctttcttcaggtttgaaaaaaatcatagctctcatcgcctcaaacattgcttctaagctgttttccttctcctcttctgggactccacctacacatatagacctttccaacagatctcctctgcctcatacactccgtcctgtactttctctcagttttgatctgttactctgcctcattatttcccagggaccttcttccagctcactcatctgctcttccttcatactcaatgttttgtgatgcccatctattgagttattagattcagctctagaatttccatttgattactttgtttatagaatcaatttttctggtgaaattttccacttaccctttattttcttgaacatatcaaccacagttattttaaaatttgactgcaacaagtataataactatctgtgggtgtactgttgtcatctgtttttgtgtcttggtcttgcttcttgacaactgaaattcagacattacatatgaaactgcagagactctgggtgagtctatcttcttaccttcctcctcactagacagccagatcgagggtagatccccttaactcaagggaggcctgagacaagaagacagacccatcattcttggaaggctcagtcacctggggtttatcctcacacctatggcatgacccatccggggctgggacctgggatgtgtgcgatggcccctctttcttagaagttcctgaattccagtttcatctcttcagcattatgagactgccagaaatcctgctctgcttttccatagctttctgatcagcctctgattcaactcaagaatttggcaaatgtgtcagaggtgaaagccacaggtgctgattgcctctgtacctactttctctttgggatccagtctcctcagggcctggtaacctttgcaatgcaaacatctatttgtgtgttgatgaccctatgaggttgccaagtgctctgtgggtttcactgcctcttctccacagcccttgcctggtttctcagcctctttcgacaggaatcacaaatgcccccaggagacaggcagcccgcagggagtgggctccctaacagtgcccctccgatgggtcttttttaagtttttttggccaggggctgtggctcacacctgtcatcccagcactttgggaggctgaggtgggcggatcacctgaggtcaggaatttgagaccagcctggccaacatggtgaaaccccgtctctactaaaaatacaaaaattagccaggcgtggtggtgcatgcctgtaatcccagctactgggaggctgaggcaggagaattgcttgaacctgggaggcagaagttgcagtgccactgcactccaacctgggcaacagagtgggactccatctcaaaaaaaaaaaagaaaaagttttattttatttttaattgacaaataattgtacatatttatgggctacggtgtgatgtttcaacacatatatacattgtggaatcatcaaaacaggctaattaacaggatcttggcctctcaaatcccggttgcctccgcagctccccaaagcaggcattctgtggattttacccagcacttctagttgttccccacaggaaatctgatccgatgcaaacagatcattatagccaagagaaggtcagttctgatcgttgttgattttcctggaatttgctaatgatgaatcgtgctgtgtgaaaatacactttaggctgatgcccagctgattagcatatagggtttagtgacatttccactgatagtgacttcctcaaagacactctgaccaggggtcagcaaaccagagccccgggacctaccccacctgtcttttcatgtagggcctgggaaaggaaaacaaaccttgggactccaaaatctccaggctaaagggaaaagtcaagctgggaactgctcagggcaaacctgcctcccattctgttcaaagtcacccctctgaggctgccctgagacaaatgcatctcattgctccctctcccctattgcttatgtaaaaatgcagattcactgagccaggctcaattgtgtattcactggaaggctggtcaaggactcaaaagaatgcaaacttttgtctcttatctatttctaacctggaagccgccatttccagtcatcccgccttactggactgaaccaaagtatgtcttacacatattgattgacgtctcatgtctccctaaaatgtataaaagcaaactgtgcccccgaccacctcgggcacatgcctcaggcccccgtccacctcctgcgcatgcctcagcccccgaccacctcaggcacaagtctcaggacttcctgaggctgtatcatggatgcatccttcaccttgccaaaatactttctaaattgactgagacctttctcagatattttgtgctcacaagcctttgagctaagaatggtttttatatttttttaagggttgtaggaaaaatgagatggagacagggacagagaagaagtggggaagagagaagaaaggaggagaaggaagagaagaagaagaggagaaggagtaagatgaggaggaggaaacagtaatctttgtggctttcaaagccaagatatttatcatttggtcctttacagataaagcttgccaactcaagttcatgaccatctctaattcttttaaatatcaagtcatgatgtgtattaatataaagattgcatattaaatgcatcttccatagacatagaaagtaaagatatgaaaatcagtttgtactgattgtaagacaagtctctgaacgaccaacaagatggcccagtctgtggagctccaggcttatttacggggtgcacctcgtagtgcccacaaggaagctagatcttttggaaataattctgcaatgtggaaataattttgcaacgtggaaatactgaggcctggggctgactgatttattgatgagaaacccagggaggcattggtttggggttctgtgacatcatgttgaggcatctgcatttcctatcacactgtactaaatcagttagaaaatatcttaatttccctatcctcacatgagtcttactgggtcctgacaacctcctggcctctcaccctaatgagtcctcatttctgagtggacatttctcccaaattcagttgcaacaacagatggtgtgtggccacagcccataaaggtagagactcatgctcaaagctgccttctggtaggcaaagtcgccacctcgaacacaccctccaaagacttgacattcagataccaaatgctccaggtccagctcccaaaagctagatggattgtccgttccattcgggcttcaaatcagaggctgtggtggctgtggtatctcaggactggtgcagtagggttctagcacagcttcaggcagacttcctcaacaacagtgatggtgatggtagtggtggtggtgatagtgaaagcagtggtggtggtgatgatggtggtaatggtagtagctatgggtgtggtggtgatgatggtggtgatggtagtgatggtaataggggtgatagtggtgatgtggtaatgatggtggtggtggcagtggcggcggtggtggtgataatgatagtggtaacaatggtggtggtgatggtggtaatactggtgatggaggtggtcgtggtgatgatggtggcagtagtgatggtggtagtgatagtgacagggtggtggtggtggtgatggtgataggggtggatagtagtggtgaaggtggtggtgatgatgacagtggtggtgacagtggtggtggtgatgttagtgatagtggtgatggtgatgggggtggtagtggtgatggtggtagtagtagtggtggtggtggtgatggcagtgacgggggtggtggtgggggcagtggtattggtggtggtggtgaaggtggtggtggtgacggtgatgatgatggtagtgatagtggtgatggtggtggtgatgatggtgatggggtagtagtggtgttggtggtagtggtggtggtgatggcagtgatgggggtggtggtagtcgtggtggtggtgacagtggtagtagtgatggtggtagtgatgggggtggtagtgatggtggtgctggtggtagtgataggggtggtagtgatggtgatggtgatagtggtgatggcagtggtagtgatggtggtgatagtgatggtgatagcagtggtggcagtggtggtgatagtgatggtgatggtggtggtggtgatggtgatagtaatggtgatggcaatgaaggtgatggtgatggtgatggtgatagtgatggtgatggtggtggtggtgatggtgatagtaatggtgatggcaatgaaggtgatggtgatggtgatcagtgatggtggtgatggtgatggcagtggtggcagtggtggtggtggtgataatgatggtcatggtagtggtggtgatggtgatagtgatggtgatggcagtggtggcagtggtggtgatagtgatggtcatggcagtggtggtgatggtgatagtgatggtgatggcagtggtggcagtggtggtgatggtaatagtgatggtgatggcagtgatagtgatagtgatggtgatggcagtggtggtggtggtgatagtgatggtgatggcagtggtggtggtggtgatagtgatggtgatggcaatggtggtgatggtgatggtgatggtgatcagtgatggtggtggtgatggcaatggtggcagtggtggtgatggtgatagcgatggtgatggcagtggtggtgatagtgatagtgatggtcatggcagtggtggtgatggtgatagtgatggtcatggcagtggtggtgatggtgatagtgatggtcatggcagtggtggtgatggtgatagtgatggtcatggcagtggtggtgatagtgatagtgatggtcatggcagtggtggtgatggtgatagtgatggtcatggcagtggtggtggtgatagtgatagtgatggtcatggcagtggtggtggtggtgatagtgatggtcatggcagtggtggtgatagtgatggtgatagtgatggtggtgacagtggtggtgatggtgatggcagtggtggcagtggtggtgatggtgatagtgatggtcacggcagtggtggtggtggtgatagtgatggtggtggcagtggtggtgatggtgatggcaatggtggcagtggtggtgatggtgatagtaatggtcatggcagtggtgatggtggcagcaaggaaatcattctctgattacctgacatggttaaaaatctgagagcaaagatgagctgagaatgtcatcatacaatgtgtaaagaagctgagcctgagaaccctgaaatgcatggtattctctatgtgcaaacgtacgagagctgaaagtgaccagttacctattcatggttatcatctgcatgatgaagaaacactgcaacctaccttttctccactagagggttggttcactagataatggcacctgcatgccatggatgctacgtatcagtattcaacagtggaagcccactcagcattcaggagtaagagatttggtaagtgataagaaaaatttgcagaactacaggattccatttttgttatgtgtgtgcccagaagagcatctaaacagacatttacccgaatgttcttcaccatgattattttggggctttaggatcgtaaggaggtgattctgattttgtggcttgtacccttctgcaccacccagccatgcagcgttccgcctgcttccttttctcctgtgtgctttaattctagttacaggaaacatgcatatgaaaaaggcacggaagggaatgtatgtttccttttttgtcagaaaataaaatgacacgtttccatttttggagaagttaaaacagattttatctcctgccaccattcttgccttacggacaagaggaggacagggcctccaagcaaatgagcacattagtgagttaaaagaaatatttataaatctagagcatagtctttggcctagaaagacggtactaaagcagacagaagccttttcaggaacacaaataagtattaaaaaaaaaaaaaaaagcaaaaaaacaccttttttgttccctttaaaccagaatgactcttaacctggtcaacaagcacattgcaaatgtcttgttcccactaggtggccacaggtcactgggcgagcgggtctttgtgggcagaggcaggagcggaggctgcggaggacgctccaagcccatcttccgtggctcagcccagcggctcccgcggctccagggcagcgccaggcatggcttctccccgaaggcacagaaggctccgaagttgccacctcttgcctgagttgccggaaatccaagggtaggtttatatcaaatcagcagacaaacttgacttctgggtaaaggctaaaatgaatcaacggagaactgacgagactgtttccccactgacgggtctgtaagagttgggggctgcccgccgcctggtcagtcacgctatgcagctcttaggttgaatcctgggctgccctggctaccaggatgcctcagggaggggaggaagcaggaggagcggcgtggggcgactcctcccaacagggggagcagcgtggagcaaatcttcctgatgggggagcggcgtggggcaaatcttcctgccaagcgtgcgagctgcttgtccccacctgggcgagccacctcttcctaccaggggtgcccatgaggtccttcctaaaagtaagactcagcagggagggttccaaggcctgtggccagcaggtgaatcacacaggagcttcctctaccatgtgaggctctgggggtccttgtctgggtgacggtgtcagagtggactgttggccaccagcaacggggctgcctgggacggccaggggcagagctgctcccatgtggcaccctaccccgagtcctgggtgtctgggctcacacccatctctggcctaccccaagtcctgggtgtctgggctcatacccgtctctgggtgtcattccagcagcaccttctcctcctttcaggatggccctgttcagtcagggtcctgccctctcccactgcacggggaggtgctagagaagggagggggcctgtgggcactgccactcacccctccaacaggcagggagacaggcacctgccccagggatgctgcagcccagcacccctccggcagcctcgcctggctccagcaagagcggaatgttcacaggcctgtccaccgtcacctcctaacaggtcctggagaggccaggccacgccagtgccatcacagactgtgctcgggaagctgaggtgagccccagccggccgtgagccccagcgcccaggcgcctcctcccctgttgcagccccactgggtccccaagtccccacccacggccagtgtttgtttctccctgaaaacctgatttgacttcactcaaaatctccacacctgctgcaaacgtcagtttgataaacctgacgctgccctcccggctgggggcaggaatctctctaccacctgtgtgagaagaggccgagcctcagagtcccaggccaaaaccctgttagagcagcttagacacagcaccaagacccccctagacccagagtgagcctaaaatgaaaagcaagtgaaagcctcggaccgtgcagctgctcgccagaacgtctcaggaaaactggctgcggcctttcctgtggaatccaaccgagatggcctcagcctgtctccctttcctcgtcctcagtgctcctcacagaccccaagacccacagggcctgcgtcacatgcacagaagccaggtcctctcctacggccatttttgggatcccaagaaagcccccagtgtcccctcactgctgtgcagcttacaccccaagttcattgctcagggcccgctctctttcatcaacaattctccccctgcatcctcttgaaaacgcggccgcacccggcggggcaccatgccagaccacggccctctgcacagcagcaagcccaccacagcgtgtggaccgtgagacctgccaccgtgacttctccccaaaagggcctgagctgggcttaaccaggagggctggggagagctggatgcccttcaccctcgctgggcaagagcctcctcccaggcatgtcccagcctcagggctttgtctccagagggggcaggccctgggtgacacagcccctcagccccactgccctgtccccgaggctggccagcccttccttatctgcacagcctgaagccttgtgtggctgactcggccctgagcttgttctcaccaccaaaggaagagccaagcgcccccacctgctcacctctgccctgactgtcctcaccctggatcccttccctaattaaatccccccgtctgcaacccaggcagggagtttccaccacactctacactgcacagcagcctccatcgcaggtggtgccgtccctgagtgcaggcgccagaaaccccaaggaggctccttggcagagcctgagccggaccagtgaccccgcggcctctcgggaacaggtcagaggctctggagggccttcaggttcgtctggccctaatctccacccacccctcgcctctgccccagcccataacggggccgtcctccaacaatgagtgggcaaaggtgcagggctgaacgcagacagccgcctgctgctcatcaagggaacagcttcctgccgcatcttggggtctatgctgcctggtggggccaggagaccctgagagggcgctctgccccaagtcagcctgtccctcctttgccccagatggctcctgctcccacctcctcctgtccccgtgagccacagagcagcagacgcatcatcagtggacactggcaagaccatgtcagtgctcagaagcctccgggtcagccctcagaccaccccatgtgagaaggtaaaccccggcgcccaggtgagccctcggaccaccgcatgtgagaagccaggacactcagcatgagcaggtaaacccgggcgcccaggtgagccttcggaccaccccacgtgagaactcaggacacgtgagaacccaggacactcagcgtgggcaggtaaaccctggtgccccagcaccccaggctcctgccccacccagcccaccaacacacagttgcccaaagtccggattcccagctcgccccaggtcttcctgggcacattctgtccttgcaaaccacttagaggttgagggactgtttatggggtgggtgtgtgcctgaatgtgtgagagacagagaaaaattacccccaatctataagctataggtaagaaaaagtacattttaattttacattaaattgaatactttcaactatattttaatgtggaaattcccaggccagtatgaggtgttgctgtggtcggaccacgctgggcccactcacgatggagtctgtcgtgagagctggagccccacccaagccacagctgcccccggcaggcaggccccacccaggctctgcaatggacacacggagacccacccgagccacagccacccccagcgggcagaccccacccggactctgcctgggccacagccgcccccggcgggcagaccccacctggaccctgcctgggctgccatggacacacggagcagcttgaaaatccaatggtccctggtgtaatttcctcagagattacttggttgatgagaaaagcagtaagttttgttgtttggtttcatctatctggatttttggtgagaattctccactgctccctgtctggggagaagcccagccccatggcagccccagcctctgtccaccatcaggcacgctgggctgtcacacagccacctgtccagggcacccatgacatccggaacccacctcaaatctggcttctgtggactgaaggcggccggcctgcagcctcctagctcctgttcccacggcctcacggcatccgtcactttcgagggtcatcacaatatgaccagaagcccacgggtggctttgaaagagatgaaggcggtgacatacgtgcccagtaaggacgcagctaggatgccaggtggggcaggccaacagcagctccaggcaggaccaggatggcctctgattgtcaaacagatttaaaatttttgctctgaaacactgaaacattccttcccaagcaaggacagagccatgaatccacagccaatctggagttcctctctgggcctgggcagcctctcctagctccccagacaacactcggtgcctccctgcagcctccaccgttaagcaaaagcgtggatgtatgaattccaatttaggttttagctaatgcttgcattccagccattaattgccttgagctaaatacctaattggctgtataaattccccaaatggaattctttggcaccaaaaaaaaagaggaaggcagctaataaccactacagagcacaagacccgtctccataattaggccctgacggactcaggccagggcggcaccacctgcccagctgggcagcccagaagcagcagggccccagggagcccggtggctcagccacacatgctgcccacgcggcccgataaggccgacccgcccagcttgctcccgctgccagagcctcttccccacctctccaggaaacaaagccacctgcacgggtacccggcctgccttgcgtcctgccaggcccctggaaagcaaacatccctccaaggcctgggccagtggtgggctgcgtcaagctgttagccaagcgggcagtgaagacgaaggctgccccgtagccagggagctgacctctctgcgcaggtgccggggtacgagcaccagcagagccgagagcgggggcagtgctgaagcccctgctgccatccacaaaggggcctcagagggttggaaatgacaagccacggtcttgccccaccccggctcctggccatgctacccagccacacggcacagggcaaatgccagcaggacacaggccctcagcccggcatcatcgtcagcccgaggatgctgggccaggccaggtgccgactcagcagggcagcaagagggcctcactgctgagggtgaagccaagcccagcatggcgtgccccactccagccactccaccgccagggctgctttctgggaccactcccaggatgaatctcacagggaaggccacaggccaggtcggcaacaacatgcccccagcagagtggcccagacacaggagcaggctgggtgtctgagaatcatccttagaacacagagagaagtggacttggaaggatataaatcagaacggtaacattattttagtatttattatacattttctaaatgtttcataatagccatgtattgcttcttaattagagaaaatagtaagttagcatgaaaaccccccaaaaagagaagagatctggggaggaggagggaggttggtttccacactgctttcatcaggccagaggcaaacagaagtctccgcagacccaggtctgggcagcgctgcagtgcaggagggtggggtggggagggggtcccctccagaggagctgagtcttcactggcgcctgatgctgaatttgaggcccccaggggagcccctcagcgggagggccgtagcatgaggggctcctcctgcagctcccactcctgggccaagggcatggggcagtcccaccttaaggtcagagctgaactgacaagtgttccccggggctcccagggcaggccccagtgagagttcccctggcactgctgctgggggcatttccagcctaagacgggttcaaggcaaccccactccagtccagccactagaacgagactggactgtccaggtgctccagccccaccagcgtttccaatggtcaggagcaacggcgttgggtggttaggagaccagtgggatgccacatatctgtggggatgaggggcacggcactttgcactttgtgtcactgtggtgtccaagatggaattaaggtgacacccccgcctcctctcaacagatgttcaggacatgaagggccgtgacaggcagcacgtgcccactcagctggattccaggttcctttgtgggactcggcaccacctgtggacaacagggtgtgtttagggtccagggactttcacaccagaggaaaagtaatcctgacttctcttccctcccagtgaacactgaaaacaatcaaacgtcaaagtccgttttctcccaggtcatgcgtggggtagggatggtgtctccaatgacagataccaaaaccaacaattccaggtacatgtcaatcccacaactcaagctcaagaagcttccagaggaagcaagggctggcccaagggcaggtgagggtggtcggcccacagggccctcccggagcagcagcagatacaatcatgctatagttcagtttgctcgaagagtggagtgtcagccttggctcaggagtcaccaagagaggacgatgcacagattcccacaacagcaagacacacagcgcagtctgagtccaaacaaacaccaataggcagaagcaagacacacagcgcgggccgagtccaaacaaacaccaacaggcagaagcaagacacatagcgcgggccgagaccaaacaccaacaggcagaagtgaacccgtgaggcttaattcatagtcaggaacatttggaggagttcagcccttacttctttgccttagtgatttccaaactcatggatgccacttcagtgtggtaatggagccaggatgagtggagagcatgtcacacatcagtttcccgcagcccctgcactggtgacccttagttcattcacaatcgcataatcccttgtgattttcctggcaaacaggaacactaaacctctttttcttcctaaaatatttggtttacaaagttaagcaaaggcaaagctacaacacaaaacgttgctgtagtacagacgaatccaaggtggccacagcacagatgaacctggtgaggatgccgtggtgccacagactgggtgactcacacagaaacgtcctcatggtctggaggctggaagtctgggatgggggtgccagcacagtctgctctggtgatggcctccgcctggcttctcaccgcgtccttacatggaggagagaggactcttcctcttcttacgagagcactggtcccttcacggaagccctgccctcaagaccccatctaacccaatcaccgcccaaaggccacctatcccatcgtgggagccccaccctcacgggtgatctaactcaatcacggcccaaaggcctctcctcccagcaccatcccctgggggtttggccttctacacactgagttcaatgagacacattcagtccataaccgctgcctcagagaatgtcttcccacacacaaggacacatacacacacactggtgaaacacaactgagattcattcttgctttttttaacctcatagatataatagagaaatgcgcacaaaaacgcatcgtatagcaaacaatattaagtgaatattcatccaaacagcactcaagaaatagtcccgccagcagctggaacccccacccctgctgcaccttcatggggagccaccgccgacttgatggaagctgtgctcacggccgcgcctgcctctgcaccagattcacagggcctgtcgtctttcacaccttccttctttcactcagcttcatgtctgtgagatgatccgagtcgccccgtcatggctaaattccactgttccattgtatgaaaataaaataatcttcctctcctccaccaccaaagtgcatgtgggtcacgtccagcctggggagactgtaaacgatgccacctacgcgcttccttgcgcatctccctgaccaggcgtacgtgtgcttctgctgcgtggagggcaaggagcgaaacctcagccgcagcaaacacacctctccacattccagcacacctgcccacctgctgtccaagcccccgaggagctcagaggttgtgtatcacagccaggtgcttccaggaactccccgccccacgtcgcagctgcacctggagctggtgcttccggtttttgcccgtctagtaggggagctgctgaatttcatacggcttccgtcttcatcactccaatttaataattaggttgaagaccattttacgtatttctcagtcatttgaattttctccttagaacttctgaaatgttttgcaaatgtttccttcgttgccttgttctcagtgatttgtcagggtcctctctgttttgaacgtgagatctttgtcggttacatgtcatttacatgtgttgaaaatattgtctcccattctgtggcttgtcttttaattaattctctttacggtgtcttttttactaagagttattcttgattttaatatagttgaaattatcagtaatttcctttgcaattagcactctttgtgtcctgtctcaaaaccttcctctccgccctaaagtcatgaaacattatattctcagttgaaaacctttatagtcttgcctttcacacccatgagcacaggagttggtgtctccgaaagaaattcggtccaggttcatcttcttctaatatggattccagctgttctcatcttccttttttatttcaaaatgtcttgaggtccttctgtgtcagcccatctacctaactccgtcttgaagatgaaccacaacttgaagggtgtttagaacgctcgcggttttttcctatgataatgtttcacagaatcattgcgcatttggttctttacacccaggcctgaacatccatcacataacttcccaggagtcaggctggtgagttaaagttatgtgaattttaatttccttagatattgggctgtcttccttaaaaaaattaattccatcgcaaaattattaaaaattcccccacgttttcttccagtacttgtaaaattccattatatttttaagtctctgtgccatctggattttattttggggtaaggagtttgggagggacccagctatgtattttccaaatgtctggccagttgtccccaaatcattactgaataatacatcttttccccaccgatttaaaatgtcatcattatcatataccaaatacccatacgcatttgggtctatttctagactttctattctttcccttcaatctgcccgtctgttccccactctggcttaagtgtcccatcactgcaaagcactgagtgtgcaagactcaacgccccacacacaactttctttttcataacttttctgtttagtctcatgtttgtgtctgaacctggactttaaagctagttcgtttaatttcaaaaaaaattgttaatatgctgttgtgataacttacatgtataggtttattcagagagaattcatatccttacagaattaaaccttctcacccagaagcactgtctcccctgcccagcgggtcctccccatctcccagtggagaccatggacctgccgggttcaccgtcgccaggctcctcaaggccttccccattctccctggttcacccaggagctctgagcacgccacgcacctgcccctgcaaccttgtcccgggcggcctcctgccaccccaccgatttcccctcccactcacagactgtggcatctcaaggtgaccttgggctggagagccaggattccagcggacacctctgggcttggggggctcgataagacaggtggagtgagtgaggtcaggaggggatgaggagggagacacaaaggaaaggaagtgaccagaacctttgggaaacacaaagaaaaactatgcaagaagagaaagtcccaacaccacagttagaagtggcacatttggggcggctgttgcaggatgaagcaggagcatctcttggaactgcacaaagagtcttctcctccagagtaacacggggtcttactctgttgccccgtggctcaggggcacagagggccccactcggcttgtctgcaatcaacgctggtacagctgcaacacagggagcaccccgaggatccacccatcactgcagctgcagggctgggcatgatgcttttaacttgacagtgtgaaaactaaatgttggctaacacagcctggacgtaggggaattgaaagaggacagtcctcaccgtacggtgcagggggcaccacagggttggctaacacagcctggacataggggaattgaaagaggacagtcctcaccgtacggtgcagggggcaccacagggttggctaacacagcctggacgtaggggaattgaaagaggacagtcctcaccgtacggtgcagggggcaccacagggttggctaacacagcctggacgtaggggaattgaaagaggacagtcctcaccgtatggtgcagggggcaccacagggttggctaacacagcctggatgtaggggaattgaaagaggacagtcctcaccgtacggtgcagggggcaccacagggttggctaacacagcctggacataggggaattgaaagagaacagtcctcaccctacagtgcagggggcaccacaggggctacacagaggaggactgagtcaactcctgatgagatggtgtggaaccatatggaaaagtggcagctgccgcaggacctcaacgtgggagaggctactgttgcccctgggtgagctcaggaaagaggggcaggatctgttgcttcttattttaagccctatattactcggcttttaagtgaaccatatatatgcattactgtcacacaaattaactgaggaaaattgaaagcctcatgtctcctaagtactaagcattcaactgacatttgttgtgcactgaccatgtgcagggaaccgacggagacacttagaaactcagcaaagcagacaagtctcctcctatgaaactcacattctaggtggggacagacaagacacaatgcacacaatcaccgatgtcaggattggggacggttgctatggaggacagacaagacacacacaatcaccgatgtcaggactggggacggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcactgatgtgaggattggggatggttgctacagaggacagacaagacacaacgcacacaatcactgatgtgaggattggggacagttgttatggaggacagacaagacacaacacacacaatcactgatgtgaggattggggacggttgctacagaggacagacaagacacaacacacacaatcactgatgtgaggattggggacagttgttatggaggacagacaagacacaacacacacaatcactgatgtgaggattggggacggttgctacagaggacagacaagatacaacacacacaatcactgatgtgaggattggggacagttgttatggaggacagacaagacacaacacacacaatcactgatgtgaggattggggacggttgctacagaggacagacaagacacaacgcacacaatcaccaatgtcaggattggggatggttgctatggaggacagacaagacacaacacacacaatcactgatgtcaggattggggatggttgctatagacaaagaagagatgaagagggtgcaggcttgggggcaggttcagtgacagcagagtggagtgtggatcattgcaatgacgagagagcctcttttggccactctgttgacctcgaacatccccccaagcagactacacactgtcaatgtgttcaaaaacagagatgacggctgttgcatggaacagacatacacagcctcagcgaccccccgggggcccctcgaaatgtgtttgtcaggctgcctccacgcagcccacaggcatggagcaaacacacgctccacttgcttcatgatgccaagcacagaacccacttcaggaaaacccaagaaatggcccccatggacccccaatcccactacttcccaccctaaaaacaaaatgaacagaaacaccacacctccaggcagccagcacagtaagcttttcacttaagtttttattatagaaatgttcaaacatacacgaaagcagagaagataacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcatggacgccatcggccatggccacccatcgctctgcagagaagacaacggcatggacgccatcggccatggccacccattactctgcagagaacataacggcacagatgccatcggccacggccacccattgctctgcagagaacataacagcacggatgccatcggccatggccacccattgctctgcagagaacataacagcatggacgccattggccatggccacccatcgctctacaaagaagataacggcatggacgccatcggccacggccacccattgctctgcagagaacataacagcatggacgccatcagccacagccccccatcgctctgcagagaagacaacgacatggacgccatcggccacggccccccatcaatctgcggagaagacaacagccacccatcactcttcagagaagataacggcatggacgccatcagccacagccccccatcactctgcagagaacataatggcacggacgccattggcaatggccccccatcgctctgcagagaacgtaacggcacggatgccatcggccacggccccccattgctccacagagaagataatggcacggatgccatcagccacagccacccatcgctctgcagagaagataacagcatggacgccattggccacagccacccattgctctgcagagaacataacagcacggacgccatcggccacggccccccatcgctctgcagagaacataatggcacggacgccatcggcaatggccccccattgctctgcagagaacataacggcacggatgccatcggccatggccccccatcgctctgcggagaacataacggcacggatgccatcggccacggccccccattgctccgcagagaagataacggcacggacgccatcggccatggccacccatcactctgcagtggctcatgtttcactccatccgtctcccctgccacccctccctgttttccagggttgagggtggagtcagttagagaaaatctactacaccatattctgtgtatctctagcaaatgaggacttatctcattttattttatttaggggagacggggtcttactctgttgcccaggctggacggcggtgacacaatcacgactcactgcagcctccacctcctgggctcaatgattcccccgcctccatctcccacagcaccaggatcaccacaactcacccacatgagggctttaaaaaatgtcatcacaaacccagtatcacaccagcaacattagttaacagcaactggtctttaataatgttctagtatccggtcagtgctaaattccattaattaaaaaaaaagtcatcttgtagttaatttgtttgaattaatatccaaggagggtccatcatacgtctacacagcaatggcgcacgcagggtggattcagtgtttgtggtttgctatgaatctgatgagccaccaagaatccaggctgagtcttctgacccctttcctgatgcttatttcctgaaagcgtccttatctgtttgcacagtatccacgctctgcattcctcctaactccaatgaacatccccagaatccccaatgagaagaaaccgtgtccctcccagggctcctcagcatctcgggtgcaatgtctctggacacttccagcgggcaggtgtctaccctggccttgataagcagacaccactagccctgaaagcaaaggtgctacctcggcctgcgggaccacagcggatgcgcggccccagtcagcacacggtgaggggcgttaccaccaaacctccctctccagggcgagcctggcctggggggagtcacagtaaagccaccgtcaaaactccttccaagttcattagcaaaggtgctacctcggcctgcgggaccacagcggatgcgcggccccagtcagcacacggtgaggggcgttaacaccaaaactcccgctccagggcgagcctggcctggggggagtcacagtaaagccaccgtcaaaactccttccaagttcattagcaaaggtgctacctcggcctgcgggaacacagcggatgcgcggccccagtcagcgcacggtgaggggcgttaacaccagacctccccctccagggcgagcctggcctggggagagtcgcagtaaagccaccgtcaaaactccttccaagttcattatttacaccctgagtgttctcagcagggccaaaacttcacacctctgactgaattttcatccatttggaagggttccgggtctcctgggagttttagaaattgggagtgagaagacgtggttgaaaactgaggtgaaagctctaagagaaagttaatttggtgtctcctgggcacttcacagctctgcagtgcccagggttccattatgcgtccctcagtgtgaaacacagcaaaccttattaaatacccttctagcaaaatcccccatcctccgagcttggcctgtgctccgcttcctcctttcctgccccagacgccacagcaaacgttatttccccgacatctggtggttttcaaaggacaatgctcagaccagtgcaccaggaagtgggccgggcgagtgatctgcagtccatcgggatgtccaggagatgctgacacaggctgagaagctcggcccccagctcccaaagcttaccacggccacctgggggaaaagctgccatgtcttagaaatattgacactggcctcattccctgaattctgatttgtcaagaggtgtggcctgaccacccggatcttttaaagctcccccggtttttaaaagctctaatagtcagcaaaatgcaaaaccacgcccccacccaacagccccatgatgtcccacgaagtcgaccgccggagccctgacaccagcatcaccctctcgtgcggtctcccaacagccctgcagagccagaaccatgatcgtccccactgcacacctcggagagctgaaagttgcacagttatttactgagtagatttgggattcaaatccaaatcctactgtgaagccggtacccccataacaccaggctgggcgggctccacgctgcctaagagcagagactctgcctcatttccccttctagtcccagcaacaagcacagagtgagacctcagcacactaaccgtggacacacctttgatcccagggccccctgaggactgcgtgatcttcagaggtgcaccctccacgcagcacaggccagacaagggaaactgcagggagcactggcaaaggacacatgtggggaagacacgagaggcaggagacggcaacatctgtgggggcacaggagagagaggacagggtgccgcggccatcacagggtgacaccggagccttggtgtggctgccctgggctggacttgctgcacacacagggccacgaggactttgggaccacacgtgctgatgtctccactgtccagaggaagacaccaaggcttgaggctgtggctccaagtgcacacagttgcacaagcacacatgcatgctgcaccacaacacccagatgagaatccagagcccccactgcctgggatgaatgggctccagaatccagagcccccactgcctgggatgaatgggctccagaatccagagcacccgcctgggacgaacaggctccagaatccagaggccccgcttgggacgaacgggctccagaatccagagccctcgcctgggacgaacgggatccagaatccagagcccctgcctgggacgaacgggctccaggggcccgcaaaaggacgtcggctctgcaccacccctacctattactctatactgagccgcaaacccatgcacgcctcagtccaaatgtcatagcttctctttctcccactaccctgagggccacacacacatgactcggagaaaggccacagcctgtgtgtcacaggatctccctaaatgtccagtggcccctgtccagccgctgtggctgcccacatcatggtgctgggccctgccgtttctccatcatagaaccaccaagaggcaaccgagaaacccaggagcatggcaacatccacagtctccaggatggggccctatctacatgctcctcctagaggggctgtgtaccgtgagcacaggagggtcatccagctacaggatgggactctatctacaagttcctgctagagggtctgtgtgccgagagcacaggagggtcatccagctacaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcagaatgggactctatctacaagttcctgctacagggtctgtgtgccaagagcacaggagggtcattcaactgtaggatcggactctatctacatgttcctgctacaggggctgtgtgccatgagcacaggagggtcatccagctacaggatgggactctatctacaagttcctgctagagggtctgtgtgccaagaccacaggagggtcatccagctgcagaatgggactctatctacatgctcctcctacgggggctgtgtgccgagaccacaggagggtcatccagctccaggatgggactctatctacatgttcctgctacgggggctgtgtgccgtcagcacaggagggtcatccagctgtccggaaatgaaaactcacagtcaccaagcatacgcagtgccatctgatgagaattcatctgctctgtcctgcacggtcccatgggaaagtcaagccatggccccagctcccttcctcaaccatcgttcatgatcgagcttattctgatgttgatgcaagaaatgttccacccacctttggctggcaaagcctgcctagaaatatacaagaacagatagtagttccagtaaagcacagagtacctcaaaatagaagacattacagagagaaacgtgtgcacgctggcagctagctgaaaagtcagctgatccacataaagttggttaggaaaaatcttctagagatgcagaccatcattgcacaaactacaacatcctcaaacccaagacacactgcagagaaataacagctcttcctttctactatggaggattctgcccgacagtcatgtggcttcacttaagatcagaagtgacctggtcaagaagcatagaagaaacctcaaatttccaaattcccagtctttcatttttttcttggttctatgaacaataaaatcttacagcataaaggccgggcgcggtggctcatgcctgtaatcccagcactttgggaggccgaagggggtggatcacgaggtcaagagatcaagaccatcctggctaacacagtgaaaccccgtctctactaaaaatacaaaaaaattaaccgggcgtggtggcaggcgcctgtagtcccagctactcgggaggctgaggcaggagaatggcataaacccgggaggcagagcttgcagtgagctgagatggtgccactgcactccagcctgggcaacagagcgagactccgtctcaaaaaaaaaaaaaaatcttacagcataaaaactgaagcatacagaaaatggtgaaaaaaaatatcattctaggtgcattttcttccagtgttttccaaagcataattacgtactttttccaaagcactcaaattcattctgtagcctcggggctgtctcctgccactcccactgggtactacacgcgagcatttcccggaaccatggaaagagcctcttggccacctgctgtagaggctgactgcactgttccctgctatgcttggtcatatgggttgttttaaagtttttcaacattataaataaagctgtaacaaacgtgctttcaattatttttcacccacattttaaaaacacgtctttagtgtgggttcctacagtctgagttactgagcctaaagacactggcatatttgtgacttccaaggaaacaacccatactcaccccatggcagagaatccctgccttgctgcaggagccggcgcttgggtgaacgcctcccgtccttggatagaaccgcctgggtgcttcggttcgtacttctccttccatgctttcagaccccctgtgcttccgcccacgccctgtgctgctctgctttctaggtccacacaccagggcccctctctgggaccatcttgccccaggctttgatcccaacactcgccctatatctccaaataaaaataaattgttgggttctttctggaggagtttgggtgagcttgtttatcccaggatgtcacttctcaaaggcagtgcagatcctcatacagcgggctgatgctcctgaccacctccctcccagcaggcccataaagaccctcagacgccatgcaccggaggcccctgtggcttctactatctggcatttgtctggtgtgctggcatcatctataccacacccggcctctgtcacaccttctgctctcacatgatgcgataccgtacttgcatttgacagaaaacacacagagtcctagagatgatatgtgaaaattaaggggtgcctggtcctgtctcggccatgaaaatggtggtagagaaagagggaacacctgcctgttagctttcctgaggatgacaagtcatttactgccttaaaactaagacaaaaaggagtggttcctcaatgaattcctctcccctccttccaccctgagacgtgtcatatagctgcctcaggccctgtgtttctcacgtaaaacctgtgctgatgacaggttcattttcaaacacaggaaggatgtccagctcacagtccgcaaaactacaagctaagctgcctacgattgtgtggggatccaggaaaacagaggatgagttgaaggttgggacacagaccccttcaggcaaatccacacacagctcagttttattgaagaaaatcaataacataaattatttcaaatagcagtgcaacaacttgggggttacatttattttattcagcacgaataactggttctattcccttgtgctcattttagcagtgatgatttgaactcagatcattagtttcatgtttccccagcctggctgcacattacagtcaactgtactaaaaccataaaccccaaagccccagatgggagatgccgacttggtcagtctggtataggatctggatctgtgtacttttataagcttcctacatggttctagtcatttgggcaacaccaggtagaccaagcccctcaatatgcaagtacagaactggagggccaaaagggcaggtgagcccatcatcccctaactccatcttttctcatttctgtcccccaccccaaatcatcaccattgtcaccatcatcatcattactatcatcaccatcaccatcagcatcattactatcatcaccatcaccatcagcatctcatcatcattatcattaccatcacgaccatcattgttgtcatcatcaccatcaccatcattgtcatcaccatcatgttgtcattatcattaccaccatcatcaccatcatcattaccattaccatcaccaccatcatcaccatcattgtcatcaccatatcatcatcattgttatcaccatcctcattgtcatcatcattgttgtcaatatcaccgtcaccatcatcattgttatcaccatcattgttatcatcaacaccatcatcatcatcaccatcatcgtcatcaccatatcatcactatcttcaccatcatcatcaccatcatcatccttaccatcgccatcattgccatgccatttagtaaacaatcacttcatcatcaccgtcatcatccttaccatcgccatcattgccatgccatttaataaataatccttcatcatcaccatcatcatccttaccatcaccatcattgccatgccatttagtaagtaatcacttcatcatcaccgtcatcatccttaccatcgccatcattgccatgccatttagtaagtaatcacttcatcatcaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcaccaccgtcatcatccttaccatcaccatcattgccatgccatttagtaaataatccttcatcatcaccatcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttaataaataatccttcatcatcaccatcatcatccttaccatcgccatcattgccatgccatttagtaagtaatcacttcatcatcaccgtcatcatccataccgtcaccatcattgccatgccatttagtaaacaatcacttcatcgtcaccatcatcatccttaccatcaccatcattgccatgccatttagtaaataatccttcatcaccaccgtcatcatccttaccatcgccatcattgccatgccatttagtaaataatccttcatcatcaccatcatcatccttaccatcgccatcattggcatgccatttagtaaacaatcacttcatcatcaccatcatcatccttaccatcgctatcattgccatgccaatgagtaaatatcaccagtgccagattctgtgctacacccttatgctcattatcattgaccttcagatcaatgtattatccccattttagagataagggagttgaagttcagaaaggctaagtaattttcttaggataacacagctagttacagaggctatggtgttcttatcgcagactggagctaagctgctgagatacaagtccagattccagcaccaatcagctgtgtggctgtggacatttcctaaagcatgctgggcctcctctcctgggccttgtatgtggagatactaagagtgcccatcttgcagagtttgtgcgaagtgacactctggtggctctccagccttcaaatccagtcctatcaagatccatcatgattactcccccagagactgtcttgattctcccactggatgtctcttctttcccaccccgtgacccctttgaattcttaaaatgctttcttggttcttcattcataccacaccccttactcccttactgtatctcctgtacacatcatttatttaccactttatccctgcagtagacagaagctcatgagggcattttttcattatgataactgttttcactaacattcctgagcatctaatctatgccatctaatctttagtagatactgtactaaatattttatttgcagtatcacattaaatcttactacaaagaaggcattattgctatgcttactttagagacaagcaaactgaggcttagaaagagtcagtacttggaagcactgaaaggctcagctctcacagtccaagtaccagctgtttaaccactgcacagtttatatccttcccaagacactgccctgaatgcattgatccaggggcctccagtggatgcttgggaaaagccagctacctgccacatgtgtgctggacttgggctgggcaaaaacaaacctggtctctgatcacgtaagcctagaacccagaaagccagcagttatgggtgcagtcatgtgggctaagctactttgcctggggacccgcagtcacacgtgctgagcagctttacatactttcaggccttgaacccagatccctgcctcacgcctcacacaccccacttcctgttgcatgatgcatccatgcagtaataaaatggacatccttaaagcagataacaaaatccaactcatcattttgtaaaatttttggatgtacatttgaggcgtgcaacatgatgttggatacatacatgcatactgaggtggccactgtggtcaagagttaacacctctgcctccaccctctcctagaggcaccctctgggcaaattaccagtaaacaatccaatgttgttactacatacagtcctcacgctgtgcattaggcccctgggctcactcctcccacaaaactgcagcttcctaccctctcatccacatcttctcattcctcgccactcccaccccccaaaccataaccagctttccactctctgtttctatgtagtcaacttttttttttaagattctacatatgtgtgagatcatgcagtatctgcctttctgtgcctggcttatttcacttacttcacactatttacaacatcatgtcctccaggttcatccatgttttgaaaatgacaggatctccttttttaaggctgaatagtatccattgtgtatgtataccacaattgctctatccattcatccatcagaaacacctgtactgtctccatgccctggtgaatagtgctgcaatgagcatcagggtgcagacacctcttctgcccatttaatttcttctggatctataaccaaaagaggcgttgatggtagcactgtttttaatttcttgaggaacctacacactgtttccataaacagtgtgcaagttggccaggtgcagtggctcacgcctgtaatcccagaattttgggaggctgaggcgggtggatcacttgaggtcaggagctcaagaccagcctggccaacacggtgaaaccccatctctactaaaaatataaaaattagctaggcatggtggcacatgtctgtaatcccagctactcgggaggctgaggcaggagaatcacttgaacccaggaggcagaggttgcagtgagctgagatcgtgccactgtaggacagagcgagactgtctcaaacaaagcatccaagtgtcccttttctctacacacttgccaacacttgttatcttctgtctttttgataaaagccattctcacaggtgtgagagggtaagtcactggggctctgatgtgcgtttccaatgattagtgatgctcagcacctttcccatacctgtcagccatctgtatgtcctctttggaaaaatgttctattcaggttctttgccctttttaaaattggagggtttgggggttttttggcttttgggttttttttgtgtgttgtttgtttgtttgttttgctattgagttgagtgagttccttatatattttagatattaacaccttatagatctatggtttttcaacattttctcccgccctgtaggctgccttttcattttgatggtttcctttaccgcacggcagcttttcagtttgatatagtcccactcatttattttgcttttgttgcctgtgtttttgggtcttgtccaaaacttcttgccgagaccaatgtcaaggagctcttcctgtatgttttcagagttttacagtttcagatcttgtgtttgggtctttaaccaattttgggcagatttttgagaacggtgtaaggtaaggtcccatttcattcttttgagtgtggatgtccagtttccccgaaaccatttaaagagacggctcttaccccagagtctgcttcacacctagttgaccatatatggtcaggtttatttctgggctctttgttctgttcccatctcatccttttacatggcgtgtgtttaagtcactggccaaaacttgggtaattctgctgccaaagacctgggagcccccggggaaggccctgttgatgtttctgttgctgttgcgtttgttacactgtggcaagctgttcaaattcttgctttcaccgccacccatttaccctgtgctactttacagtagctagtctaggatgcaactggaattgtggggctcaagtgaaacaatgtgcataaaatctcccgtaaattataactcacactgcatgtataagcaaaaattgtggcatttttacagtcttcctacatcttcagctaatagccttaataacaaaacacagaatattgtcactcaattagactagggttatttacctaagacaattttgcattgcaatttgcaaattcttaaatggcaaattagtcatttgcattgatttgcatgtccacagagaaatatctttcatgctaattatgtttttgctaacaaaccatagaagtaataatgaggaaactgaattccctcaccgcacctttggctttgttacacaaagcacagctggcgtttcagggtgggagggtttcatcaggatcgtcttgcccagagatcctcaactctgatagcacattacagtcacctcgggaagcttcagagaaaaagaaaggacggcaaagcctgggtcccgcccccaccccgcccctcgccgccctcagctgacattctgattcactggcgccagtttatgtctgggcatcactatttttcaaagcttccaggtgtttccaggtgttaccaccggcatggctgacccccttgttttgcacgtaagaaatccaacgtgcacagagctgtggcttgaatagagaggggtgcgcagggtggtggcagggcaagacaagcccaagcttcctgactgatgcccagtcccctatgcttgtcccacaaagatcgagactctattgtgcatacaggcatgcacaccccccacccacacacactcccggtggagcaacagcgtgcacacccacgcacactcccgatcaacaatgtgcacacccacacactcccaatcgatcaagagtatgcacacccacacacactcctggtcaatcaacagtgtgcacacccaggcacactcctggtggatcaacagtaggcacacccacacacactccgggtggatcaacactatgcacacccatgcacactcccggtggatcaacactatgcacacccacacacactccgggtggatcaacactatgcacacccacacacactcctggtggatcaacactatgcacacccatgcacactcctggtggatcaacagtgtcaggctttcagactgaggaaaggaaaacactgtttttggctgtgcacagtggctcacacctgtaaccccagcacttagggaggccaaggcaggtggatcatttgaggtcaggagtttgagaccagcctggccaacatggtgaaatcctgtctctactaaaatacaaaaatgagccagtggtggtggcaggcacttgtaatcccagctactcaggaagctgagggagcagaatcgtttgaaccccaggagggggaggttgcagtgagccaagatagcaccactgcactccagcctgggcaacagagggagaccatctcccctgtctcaacaacaacaacaacaacactagtccacaatgaacacaccaaaaaaatgtgtaaagtgtgggtctagttcttttgcatctttttaaagaaagaagaagcaaaatcccaattgttgagtcatcttcccctgtggtcagcagcttgcccagctccaccgagcactcgctcgagagcgtttctgttccttgaaaacaaatgagaacgacaacagcaagatgctcctcaatcattaaaaacaccaaagagcatctgttcgtgccccagcaagtgagagagaaaacctggccaaaaaaaaaaaaaaaaaaatgcaaagaattgggagctgggatttgttctagtgccatcataaaagaattgggagctgggatctgtcctattgcatcacaatgggctgtcgccataacaggagctgggatttgtcctagtgcatcataaaagaattgggagctgggatttgtcctattgcatcataacgggctgttgccataacaggagctgggatttgtcctagtgcatcataaaagaattgggagctggaatttgtcctagtgcctcataaaagaattgggagctgggatttgtcctagtgcctcataaaagaattgggagctgggatctgtcctagtgcatcacaacgggctgccatcataacagggcctgacatggtggaaaatcgtcaagtagaaataaaagaatctcatttggacatagtttataagcaaatatggttatagcattttatttcaacaactggggaaaaaaacataaaatttattctgttttgcagaaaaactaaggccgaccaataggatttgactgttagagagacaacaatacattttcctagtgacttgtgggataaaccgcttgttgcttgtttttattttttacatttctgcatctttccagaatctcaagtaccctggatttgacggaacttctcccggtgggtgctcaacacagcgctgccttctcctctaagagctcagctcctgaaaaggttcacgcgaggatgctcacagcagccaaatgctgggaacaacctgtgtgggtacaagcaagacgtggtgtgtccctcgacggagcacgactcagcgacaacaggagcaaagggtgggggtaggaaggtagcgttgcgtcaccccgaccggctgctcagtcagttcccaatctagctccttgttgtaccctttccgccttctctctactgcacttgaccagtcttcaaaaaattaaaaaggaacaaatgtatacagtgggaggtgaggcaagagggggtcggagcattcaccgaggtggagaacaggctcagtacatcttcccgctcatgttacagtgaaatgcgtgaccttaggtgtgtgtttccgtgagattttatagatcacatggattttttttttttttagatgaggtcttgctctgtcacccaggctggagtgcggtggtgagatctcagctcactgcaaactctgcctccaaggttcaagcgattctcctgcctcaacctcccaagtagctgggattacgtgcgtgcaccaccatgcccgactaattctgtatttttatatttttagtggagacagggtttcaccatatttttagtggagacggggtttcaccatgtcaaaggttttttttgttttgttttcataaattgcactcctgtccaacctcacagtgctcttttaattggtgagaagctgagcaaagcttcctcctctctgaaggacaataggaaaaggccagcacgagaggccagcacaagagggtggggctcttctttggaggcaaagccagcctctcctgagccagctcccctcccgcctccccctcctatggaccacgcccactggacttaccaagggatcttcaacagggtctcacccacacacagcactgctggtctccagtctctgggatttcttctaattctgaggacaagtttaaaaccttactaatggctgggcgcagtggctcacacctgtaatcccagcactttgggaggccgacgcgggtggatcacaaggtcaggagatcgagaccaacctggccaacatggtgaaaccctgtctctactaaaaatacaaaaattagctgggtgtggtggcaggtgcctgtagtcccagctactagggaggctgaggcaggagaatcgcttgaacccgggagtcagaagttgtggcgagctgagattgcgccactgcactccagcctgggggacagagcgagactccgtctcaaaaaaacaaaaacaaacaaacaaaaaaaaaaccttactaacaaaattgatttcaagctaaatgaataaagaaaaggaaaactctctacaaatcatttctctgatttctgaattgaaaagcaaccaagaagactctgacaattggcgggcgccccggccccagggcccctctcaggctgggtgcgtgtctgttgcccgttctgtcggctgagaccactgtcagggcaaagagaagacatgggacagccaggaaatgtggcccacctgactccaatcatgcttccggccccgccacggttccggccccgccacggttccggcctcgccacggttcctgccccaccacggttccattcccaccacggttcctgcaggcatttcatgtaatgcaattattcttccctgcaacattcatctgaccaatacgtgaccatttcctctcttttgccagcatcatagagagttcacaagagacaaatcaaagtcaccgtgggtcccagtagcaaatctagaacctgcatcttaaggcaaagaacgatgaaccaccataaattccgtgggcctttgagaagccgaagggtgagctgattggaggaaggatgggaagacgcccgatcagtgtggttccagatcagattctgcctgtgtgtcacccacatttaacactaagggaccaagtttgtcatctgttaaatgagaacaaaaatacatgccctgttattgtcagtgacggtgcagaaatctaacacgataacatataaaacactcagaaaggcattaacccccatgcagtgcactattattactttacgccatttcagtcacaagagcaggtgctgggtgttattccagctcaagaatatctcaaagcacccaggcctggaatagagagagcaggttccaaagcagccccaggctaagctttgcacacagactcagaccatgaacatcacccatcagttagagggaaatcactcacccttcaatgcactcttaacacagaccccacctctatggaaactgcctcaaaagacagagcagaccaacgtcccaagaatgattagacggcgcctctaaaataacaaggccgttgcatgcaagggcccgagagctggccgtccacatttcctcccaactccaccttcagtgacactgcgtcagtaactgggaggcagcagtggcggcggggcgggggccttacactagagaacccggctgcaaatcaggtcccaaatgctgcaaatgctggtggttaagcatttgcccacactgcactgctgagccactgagattaggcctgaaattagttatgggttttacccacgcaccgaaagacatgtgtttgttgtatgcataatctttagaatccacgtttggttcgatatttctgctttaatgataaaaggttttgtgcttttcaaaatggtatggccacgcacagacattatccctccaaactcctggtcgtggctgaacctcagcagcttcacggtccccaagatcaatttcctatctcctccaatcctgttagcaaatgaaccaaaattaaatcaggatttggcagatttctctaaacactgcagccactcagagtcctgctaaggagaaagagcagctgtaaacatatgtgagaacccttgaagctcttcctgccataagcacacttccgttctctgaataaacccctctgacgagctgtttcgggaggctacatccacgcccaggacagccgggagggcaagctgcagcctctgcacggcctctgctgtgtctgtgcaccctgattgagaagcctgcgtatcagagacctccaagtgccggctcgcctctccctcgtccataatttagtgacaatctccatggcaactagactccaagaaaagagaaggaaaggtttcccggctctctgagcagcgggtgcttcgtaaactgcaaaaacacattccccaaacatggtgtcccaaggacactgtcagcctcagaaaatctagagtgatctgaaatgagctcattcaaacttgacctcagctttgaaaaccacacagccatccaactgtctaacagtcaaccatgatagattggggggaaaaaaacattttaaacattaatttttaaaaaaaggttggctataaatagcttaaaaaccaaatgttttaagtatttaaaagaaaataaattgggaagcgaaaactactccagtataaatctcagatattaacattccttggggctgatatctaatttacttaatgtctttcacacaggcccatgacaacccttcatggtaaaagcaaaaaaaaaatccctttctcctacgtcagtgacatttctaggtagacatcaagatctcgcgcttaggagaccaaaagcaaaagcaggctataagcaaatgaggtcagccctggcgctgggcgggtgcagcactggcccagcccccgtgcggccccactgtgtcccctcacagctggtcatcagccacagctaagccaggccaacccaagaggcacagcgaactctacaggactccacattcaaaacttgctccttcatcaaaaagcggagtaaaccgggagattcagccatgggaaggccttggaccccaggacctctggaaaacactgcgtgtaactggcaccccgagtcaacttttccctgagaaatgctcaaccccatttagtttttggacatgcctctggaaatatgaaaatgagtttcatctactaaacaattccttatcctctcaaatctctgaaatttaagggtttagaaagttaatttgataaatgggaaagtcaacccagcagataaaagggaaaacggtctttcaagagcatcttagtaaatgctgcaggttgcacagagcatgcccatgtgcccgcccaaactacgggccacctccaccagagtcaaccgcccagcagaatgtgggcacccctcctccgagagggaccctcttcccaaggtcagctaagaggcgggtgcccgtctgagagggacccttttcccaaggtcagctaagaggcgggtgcccatctgagagggaccctcttcccaaggtcggctaagaggcgggtgaccgtctgaccactgagggagtcgggagtggggctgcccatggctttggggaagcactcgctgttcagcgggagagaagtcaaagagagaggccgggtgatgccacggggtgccctgtgggactgtgcacactgcgttctgcagacatgggcatcctggacagctgaaaacagggcaatgatgcaaactggcatttgcgcctcctggtgccccacggagacaggccctgaggagcctggtggtcctcgttcagctccagggcagatgctggcgagggaggaaggtgatcataagaaccccggctgcagcacagtctccaaccttctcatgcagaagagctgggggtgcttgggaggcaccagtttccctgacgccacggtggcaggcgggagggctcaggacccgaaaagcaacaagctcccagaggagcagcctgtggatgccaccaacgagcacagttctggggaggccccgaagggccccgaggactccccggcttcccctgtctagggaggccccgaagggccctgaggactccccagctccccctgtctggggccagatgctgctcttcctcctgcgagtgggaacagcttcagcacctgttctagttcccttgattcaggcacccccggccactctcccagcgagaccatgaagatgaggatgctggagaaaggtgaccttgtgcacgcttcgcccctgcttaacaagccagccgtgcaccagggacaatcaccaaggacgggcccactcagcagaggaacccccagcaaaacaccctcgggagggcacgcccgcctccacccccagctgacacccacaccccagccgggcactccaataccttctcggggtttttaggacatgcccctgctgggctcactctccagcttccttgaatcctacctcccctctcaggcctgtggggtcaagcagctattctaactactgtgaaattgaacttccaagccaaggcacacacacacctggagaccgtcttggttaacgggtaatttattctcttagtggggattccagtccagtctacataagcatcattaaggcagtctcacggggaagaagtttgggagtcagatattagaacttcattgtgcagaaacacaaaacccagagttctttccttaaagtcctgacttgagggaagacttgaaaatccagggctgcacatctgggctcggaaacctgcatatcatacttactacgatttgtgttcctcccgccatttgtttgttggtttgtttttgagacagagtctggctctgttgcccaggctggagtgcaaaggcttaatcactgcaacctcctcttcctgggctcaagtgatcctcccacctcagcctcccgagtagctgagaccacaggcacatgccaccacacctggctgatttttgtactttttgtagagaaggggtttcaccatgttgccaggctggtcttgaactcctgagctcaagcaattcgcctgccttggcctcccacagtgctgggattacaggcgtgagccactgcacccagtcccactgttaatttagaaccagacacatcgtttctccactatttatgactttagttacaaagccacaccagatagcaccaaattcaaatcatatcaatgacgccgatgcgcacagctgtcccaacacaagacagcagggccatccgttgccagcacatgaatgactgtaagtcaccaacaactgccagccaaggacgcacgaaggatcagcctgtgtctccgtgaaaattcacagcacagacgccgctcgggagggagaggagagagaggggccccagcaggcaccctcaccctgtctgtgccgccaaggggcctgagagtgtgaccctgacaccgagtcaatctgcttctccgcctgaggctgccaggcagcctggaggctggaaaaaaaatgtaaaacatgttcctctaaaacgagggcgtccttagcggggatgctataaatacgcccaagtaagaagagacgcgagaacgtcaatctggttctgttcctcccgcttctccttcctcccagcaaacttctgaggagagaaaagtctggaaagtttgaggagcgaaccgcatcttcagagccattgggtggggtcacatgcatacatctgagctcacatgtgtgtgagacccaaactgagctgaactgattttaactcacctcaagtcactaatctgaagtctcaatatcacgtcactttttctgttaatacaccaaataaggctgagcttcacatagttcaattcagtcattcgtttccatctccttttaggttttattcattggaatttgggagtgcaatgagactgccagtcacacggagtgatgcggtctcgtgtctcacagctgtgggtcttcccgttgcctcagcccctctgagaggatgaaggggcggggccctgcccacaaggtggctgggacatcttagatggtccggttcattactaaccaataatgcaaagatggttagaccatttcagggccctggctgctagattttcttcattaagcacatatcatgcagtcctgtctgacattttaacacgcacagaaaacagggcacacagcaaacaggaaatgtctgttacctccgagtgggagtgagatttggtgaagggacacaaaaggaatttttactttttattctagatagttccaaactgttcattttgaatatatccatatacgtataattcattttttaattgattttaattgacacacctgaaagagaaaagtgggtaatactgtaatggccaacatcttcccttttcataaaatcagactttgctgccatcatccactattaaaataataccgaagtgggtcaagagaggcaaccgagaatttgattttaaagaatgtgctgaattttctattaaagcaaaaaactctttgacaccccaatagtgtatgcttcctgtaagttcaagaaatccatgtctatttccaaggcagcatcacccacccctcaccccaggttttcagcctggcctgggatgtggataggccccctgctgcctttctggaaaaagcaactgaaagctcagccaagccacggccaggttgctcttttcagcccccatggggaccaagctgccccaacaggcaggaagcacaggcggtgtccacaactctgcctccacacatccacccttggccaggaaagagggaggcacctgaagacagagaaggggagagagcgctggtcagcggagcagggacaggaccgagagcctgtggggcaggaaaccgagtgggaagagccaaggggtggtaggcaggccatgctgcagagtcaccacggagcgtgggacaggcacggcggcaaagagagtgggctgagtgggtcatcacacagcacgggagccgcggccccaggtgctgcttgaatgaagaaggctcagcccatgactgctacgtctggtccccaggacccaaactgtccagaaatcagccagcactcctgcaggtgcactgcagtggacggctagaggagggaaagcagcgccgtacagacactcggaaaactgcagactggaaggggcgtgaaagcacaaggtcttgatcattctcctggcattcggtgctgtgcgtagggtgagcaatggacgccactggggaagagtgggaaaggaaggctcagcacgtcggtaacgaatgaggaggcagaggcccgctctgcgtctcaaagaacgggtgggatgcggagccgtgacaagggcatgggaaagaaagtggagtgggaataacgccaaaattaacctgataaggaagctgctttcaacgcatccctgagctggacccacatggagaaggaccacacaccccaaggctgcccttcagttttgacttgattctgtgggaaagagggagccactgaaggtttcatatcaggatgactgtggggggcagacgagaaacacaacttataaaagtgggctctgacttgtgtacacgccgtacagagatgtaattcagtggctgtttaattagcaacttgtgtggcagacacgttcatattctcaatgacaaggagctcctacacagtccaagaaaaagacaaaactcagtgggaatggggcaaagatgggagcagtaacttacagaagcagaggtgaaagtggccccacaggacatgaaaacacgtgtcaccgcgacagtcactggggaaacacacatctaacaatacccacattgttgggggcagtggctcccgtgtttctcagctgtggacatgccacaggacaggacccacgagtgagtgtttcgggggcagaagaggtaaagaacagaggccggagatgcagacagaccgaggtgcaaagtggctgcctgagagctgcggcctagaacaagtcaccgaactcttctgaattccaatttcctcaccctaaggctgtgaatggggctcatgttactcaatgtgagtggggcggcgtggcacaggaggtactcagcctggactttctgtgagcgctcaatacaaaacagcctggacgttgctgcaagcggcctggagctcccgaatggtgacccactcgccgacagcctccctccctctctcctccgctcttctttcctgactaaagccttcttgaagtctggaggaagcagagtgaacgcttccgttggatgagctcagaactttttttcctctccattttcatgattagcaatcacaggctgcgtctgccagctcctgctgtgatctgggggacacccagagtgcagcagcaactctgagacgcagagctgttctgttttatggaactggcaaaaaatagaataataacttttgacacctgggaggctgcggaaaagcacaatgggtttgaaaaacagatgaggtagcaactgagagatctacgctctgtgaatcacaaaccactcagagagcctggaaatgctgaggccacatggcggagagaccaggtcctggctgctgcctgtgggggtgggcagaatgagccttgcattcccggaccctccagtgcccgaaggctgattctcggagagctcacagggtactacggggtggcgggcgcaagccagctctgcggcgcagtgggcgtcatcctcgctgctgtgggagcgggggctcctgctctggagatcgactgctgtttgggtaatgacagcagcaccatgcaacaactgagccactggttctctacttggcaggaatttcccaattgggattctagattccaagaaggtagggtctggcaactgtttctgcagcacaaattgaattcactgcttgatcaaacctaaataaagagtctgaggagcacgaccttcctaggagcacgttccagctttgttccacgtcgcgggggttgcgtctcaccctgaagccttgtggcaaccctatggaggagtccatcggcaccattttcccagcagcacgtgctcatcgcctgtctctgtgctaccttttggtaatttccacagtgttggatccctgagctgtgatccgtgatctttggtgttactgtcattgttttggggcaccatgaaccgtgcccatagaagacagtgagcataactgatcaatgctgtgtgtgttctgactgcgtaactgaccagccattctcccatctcgctccctctcctccagcctccctattccctgagacacaacaatattgaaattaggctaattagcaaccctacagtggcctctaagtgttcatgtgaaagaaagagccgcacctctctcactttaaatcagaagctagaaatgattaaacttagtgaggaagccatgccgaaagccaagaataggccaaaaatgaggcctctcgtgtaaaacagttagccaagttgtgaatgtaaaggaaaagttcttggagaaaattaaaagtgctactccagaaaacgagaaagtgaaacagccttactgctcatattgagaaagtctgagtggtctggatagaccaagccagccacaatattcccttaagccagagcctaatccagagcaaggccctcactcttcaattccatgaaggctgagagaagtgaggaagctgcagaagaaaactctgaagctcgcagaggttggttcatgaggttgaaggaaaggagtcatctccataacataacagtgtaaggtgcagcagcaagtgctgatggagaagctgcagcaagctctccagaagatctggctgagatcagtgacgaaggtggctgctctaacaacagattttcaatgtagatgaaacagccttacattgaagaagatgccatctaggacttccatagctagagagaagacagcgcctgacttcaaagcttcaaagcacaggctggctctcttgtgaggagctgatgcagctgaggactttaagtcaaagccaatgcttgttcatccgagggcccttaagaatcatgctaaatctatggctgcctgtgctctgtcactggaacaaagctggatgacagcacatctgtttacagcatggtttactgaatattttaagcccactattgagacctactgctcaaaaaagattcctttcaaaatatggctgctcatcagcagtgcaccagtcacccaagagctgtgatgcagctgtacaaggaggtgggtgttgtttccatgcctgctgacacctcgtccattctgcagcccagggatcaaaaaataatttccatttcaagacatatatacaaatattttgaggtagagtcttgctctgtcgcccaagctggagtgcagtggtgcgatctcggctcactacaacctccgcctcccaggttcaagcaattccttgcctcagcctcccgcatagctgggattacaggcacatgccaccatgcccggctaatttttgtatttttagtagagacagggtttcaccatcttggccaggctggtcttgaactcctgaccttgtgatccacctgcgtcggcctcccaaagtgctgggattacagacatgagccactgcacccagccaagacttatattttagaaacacactttgtaagatgacagctgccatagatagtgattcctctgactgatctgggtaaagtaaattgaaaacctcctggaaaaaattcaccgttctagatgccattgagaacacttgcgattcatggagggaggtcaaaatagcaacattcacaggagtttggaagaggctgagtccaaccctcatgcatgactttcagggattcaggacttcagtagaggaaggaactgcagatgtggtgggaacagcaagggaaccagcattagcagagctgcctgaagatgtgaccaaattgccacaatctcatgataaaactttaacaggtgaggagttgcttcctagggacgagcaaagaaagtggtttctggagatggaatctactcctggtgaagatgctgtgagcattgtgaaaatcagaacaaaggattcagaatatcacatcaacttatttgataaggcagtggcaggggttgaaaggattgactcttaattttgaaaaatgttctactgcgggtaaaatgctaccaaacagcattgcgttctgcaaagaaatctttcatgaaggaagagtcaactgatgcagtcaattttatttgtcttattttaagaaattaacacagttgccccaagcttcaagcaaccacggccctgatcaatcagcagccattaacactgcggcaagaccctccacccgcaggaagattacaacttgctgaaagctcaggtgatcattagcatttttagcaaaaacatttttaatgaaggcctgtacattgttttttagacatagtgctattacacacttaatagaccacagcctagtaaaatgtaacttttatatgcactggaaaactagaaaatctgtgtgactcactttatcgtcatatttgctttattgcagtgccctggaattgaacccacaatatctccgaggtctgcctgtagatgctaaatcagtggttttttttatattcacaaatgagcccattcactagtttttcttgggcaatttctgaagcacacttttgggaattgatatgcaatgtttatatagactggattcagaacacgctacctcaaaatatggcagggtggccctcgagaaaacggcagaagcagaccacagaaaccagaattcccccagccccttctcctcggaggcaggtcataagaccctcattccagaggggcctccctatgcccagaggggaatgtccttatctccgaagacacagaagcagctagaagactccagacaggccttgctgagcccttcagcctatgacatcagagcacgccctttgccctccgatcacacttctgcacaactgtccataaaaacaggcttccctgtttcctgggtcttcatttctgaaggctcccatgtgacatagaaaaccggtattaaataagtgggtagggttttctcttattaatctgtcttttgttacaagtctcagccatgaacctggagaggggtgagaaattactttttccccactatggtatataaatcttttatttgagggctatgggggtgtctcttgtgccatgaaagcatgattcatttattcttgtatccactcactcaataaataatttcccactgatagcctttgctgcttgctgtggccgaaaatccaaatagggttaatcacatagcttcaaagaattagggagacactctggatttgaatattctaaagtcttccactttggggacaacgctagtgcttttagtacctaagttgcaatgggaggtgattgtttgctggaaaaactcccaaatctgagagggacaagcttattgttctgctttgtgcccagatggtggagccagcattttcaaccatcttgttttgtgttgggttgaatgtcctgggagggagcccatctgtctggggtcagggaagtaaccccttattaaagaaatgcaattctctggctatatccttcactatgcttacctccttgcctaactgtatcctcagttcttttttctttcttttaaaaaacagctttattgaaacataattcatataccacataactcagccttttaaagtataggagttggccgggcgcaatggctcatgcctgtaatcccagcacttcgggaggtcaaggtgggaggaccacttgaggtcacgagttcaagactagcctgggaaacatagtgagactccatcactgcaaaaaaaaaattttttttaaatagccaggcatgatggtgtgtgcttgtagtcccagctactagggaggctgaggtgagaggattacttgagactaggagttcaaggctgcgttaggctaggattgcaccactgcacgccaaccttggcgacagaacaagtgcttgtcttaaaaaaaacaaaaaactgtaagagtcaacggttttctgaatgttcagagttccgtgaccacctcaccgtccacctcagagcctctcagtaccaccaaagggaacctgcccctctgccatcacttcccatgcccccaacactttccccagccctacacggccacaacctactttctgtctctaccgacttacctctcctggacttatttacttatttatttacttatttatttatttagagacagagtctcactctgttgctcagactggagtgcaatggtgtgaactcggctcaccgtaacctccacctcccaggttcaagcgattctcctgcctcagcctccagagtagctgggatcacaggcacgcgccaccacgcccagctaatttttgtatttttagtggagacggggtttcaccatgttggccaggctggccgtgaactcctgatctcaagtgatctgcccgcctcggcctcctgaagtgctgggattacagggtgagcctccgccctggcctcctggacattttgtataaatgaaatcatgtcccccgtgacttttgtgactcggtttcttcctctgagcacggcgattcccaggttcctccgcgtcagtgtgccggtgcttcctgcctccctttccacggccggacagcactccaccatcacagacgtcctcggttcctggtggttttctgccctcttcagtggagaaagggcttggaatagaagaagctgcagttggagacgtgaaggctgtggctgtgacgccgccacggggagtcggctgcaggaggagcctccccaccatcagcgtggccggcggagtgagccacgagcgcaagggcacccctcccagccgctgttgctgtggccccggccgccagcgtcccgggagggcacctgcggagggaaggcagacaccctgcaacggcccgcaggcccgtgtcacctgggccaccgagcgcagggcttgtgggtcgtcacagcataattcagccttgagccacgagacacggagccgacaggtgtgtagctgagccatcctcccccacctgtcagtcaccattcttccacctccctccaaacggagagcgcgacttgctcctcttgccctcctggacgtccgggatttccgcccctgggctccagcgctatggtgtggtcgtcctgacgcactcttagaagctcggccacccctctgcgcccctcctgctcggccacccctctctgcgcccctcctgctcggccacccctctctgcgcccctcctgctcggccacccctctgcgcctctcctgctcggccacccctctctgcgcccctcctgctcggccacccctctctgcgcccctcctgctcggccacccctctctgcgcccctcctgctcggccacccctctctgcgcccctcctgctcggccacccctctctgcgcccctcctgctcggccacccctctctgcgccccgcctgctcggccacccctctctgcacccctcctgcacaggcctctcctcctttctgagctcaaagggaatggtggttccttcatgtgcctccttcccacctctcttgtccttttagcaggaacatgctcacgtgaaaaactggaaaaccagagaaatatgaagaaaataaaagtcactacccagagagagccactattcacagtgtggtgtatttctttgagctttttctgctatccacattttcgcacggctgtcatcgtattagatgctcagttttggatcctgagtttttcatttactttctcccacctgcattttccgacgttattaacaactttttgaacacttctcttttaatgtctgcttaacatttgaatcatgtgaccataacatagctttaaagaagcattctcctttgtttaatattaatgatttgtctactgttttaaaattaatacaaacaccactgcagagagcagctttgtgcttcaagttttctttagtattttgggtaatggattattttattggggcatattctcacacatcagattgccgggtcacgggccacctcccttatgtggcgtgaacgtgctggccagtcagcgtccatcacgatcacgtcaggccatgctcccaccagcagggcgtgaaagcgaccagctcacttcccgacataagcgtgatctattttaatcttcatagatttgttttccttttttctattgtggagtagttgattattatgcctttagaatgtttaggacataccacctgtgtttggatgtgtcccatttaaagttatcaaccatgaaatcaaatccgctttaaaaattctttgaaacctgttttcctcatatttaggatgcccatgtaacagcatctaaactctcttttctacaagctgttccaggattatgtgattgctttatcttaagctttctcttccagaacccttacagttttttctataataaccaaagttactccagagttatgaattaccaaggaattgacccccagggtcactttaaagtttccaatcacgacttcctcctgagggagctggcctaaaacccttacagctgaagcattcgattacgttaaatgagcatgtgcagaggctgcagtttcatagttccaattgcatattgtggtaaaatatacgtcacattaaaatttaccatcttagccattcttaagtgtacagttcggtggtgttaattacattcacactgttgatcagtcatcaccaccgtctattcccagaactcttccatcgtcccaaactgaaactccaccaattaaacactgacaccccaactgtcccccagcccctggccccatcactctaccttctgtctctatgaacttgactatctttagtacgtcacatgcgtggaatcattcagtatttgtccttttgtgactggcttatttcactcagcataacagcctcaagctccccccatgtttcagcgagtgtcagcactcacttcctcttcaaggctgcgtactattccatcatgtggatggaccacgtttcacttgtccattcgcccatcagtggacactgggctgctttcgcctttggctgttgtgcattaactgctatgaatatgggtgtgcaaacagctcttcaagtctctgcttcctgtgttatggggtacgtacccagaagtggggttgctgaggcaaattaaaaactctatttttaattttttaggaaaccaccatactgtttccctcagcaacgacgccattttacattcccatcagcagcgcacaagtgttcaatttctccacattctcaccaacaccgattttcaggggttttttaatactagccatcctaatgggtgtgaggtggtatgtttatcttttgactttctttttattaataacctctgttgggcttttaaaaaacatatccaagcttgataagattatatattcctacacgtaccttaagaaaagagagggggaaagagagagagtgagccagagggagagaaagagaccctgcggctggtgacagaatgttctagactcgcagccgccccccaccgcaccctgggctgccgcacccctggcccgccagcctcgggctaaaccagtcaccatggcaaccataaatctgagccagcacaggaaccacttctcctatcgctccccgtcagcctcgcaaagcgcagttttctaagactgggcaccactggcttcgctgtttcctagaccttcagtgcatcataaaaaaaaaaaatcaaatatcatctgtttctacaaatcaaggcctgaatatgtgtatttacatttaaattgcttttcctttccaaggaatccacagtcattatctggatatgatgttgagacgactctatgtctgggaggcaagtcaaggttgaggagaaaaatgtctgagaatgatcacagtcggacacccaggccggcctttgtcaaggagccggggagacagcctcggcttttattctgctggggctacttacggctccaattaaattaaacacacacacctgcttccattatcatcaaaagctgttgagtccaggcagacgacgtaggattttcaatatcgctatttttcttaaggctgcctccaaattaaagctgcacggagtagatgccagggagccccagggggtcctaggctgggccagaacctcacccaccacccacactgcaccccacgagctgccggttcccacttgtcacactcggcacaggaatctcccgaaagaagagaaaacagcagaagctgccgccgctgaggacctgctctcctcttggcgcctccaccgtggcttcccttcccgaccccagaagctgcctaggcacagacacagaggtgcccccagccccaaaattccatccggaacccagggctggtcccacctcagggcgcacgagctcctcggtttcgcttctcagaccctcagaggcattcacctcggctccccctggatgcaccagtgcaggggaggcctgtcctgaaaggccccaggagggcggcaccccaggccagcgccctgccctgcacctcagtcccccgccggcacccacgtctgtgcagagattagtgggtgcgaggggcctctgggcaggccccgccatcctcgctaggattaaatccgctcctgcccacagtctgaggacagatgcgcagggagctggggaaagagaaggcctcgctcagtgcgccccgggcccacacgcagcccctgacttggagaaaggcggctccgcccagcgcttttctgaggatactggagtttaaccctcccctgcgcgttcagagcgcacagcgcccagttcaccagcatgacaggcccgggtggcgtctgccctgggagatgccctctgcctgaccgcgctggagggaaggggctctgcaggacccgctgctcgccgtatttcataataactgccgtcctcatgggctttcagcccaacctgaaaacacagcgtttgcactgttttcttatccgcctgataagagaggaaaatcagtggcttaaaggacgaaaaacctggccgggcgcggtgactcacgcctgtaatcccagcagtttgggaggccgaggcgggtggatcacctgaagtcaggagttcgagaccagcctggccaacatggtgaaaccctgtctctactaaaaatacaaaaaattagccgggtgcagtggcgcacgcctgtaatcccagctactcaggaggctgaggcaggagaatcgcttgagcccaggaggcgaaggttgcagtgagaggagatagccccgctgccctccagcctgggcgacagagcgagactctgtctcaaaaaaattttttaaaaaaggatgaaaaacttgccgaaggacagagcaaaacaaaatcagaaagcaagggttggtgcgagcgatgggcgcccagaacccgggcaacctcttctccccacccaccgaggccgcagcccatggctccggggttccatccgcctcctctcggcagcgcgccccgggcggccccagctccaggccagcggcggggctcaccaggctgggcgctgcgcacggcgggcaggagaggggcagaccagggcgcagcagccaggaccccacactcaccgttcacacaggcctcggacgctccgcagaggccctcctcgagcaggcagcctgcggggaaacagagaagagacgcggtcagctggaggggaggaggggggtgcccccgaggctgccttcctggccccctggtgaatttcagagaaaccgccggtcaagcaggctcctccgacccggcttttccgagatggggccgattattctgaagccagaacgctgcgcccctgacccggccacgtgcgaggcctcctggcctagtcccggagcccagctctcacctggaccaggcccacagctctgggctgagggtcaagccggcgtcatcacaggagactctctggccgcgggagcagcagcggggccggggcctccccttgaggcctcccctgggcccggcgcctcccctggaccgggtgctcaccgcacgcaccgcgtccctggaagcaaggctgccgggcgccggggagcggaggcttccagggaggtaacgagctccgcggggagcccggctgcgtgggaagcaaaccgtggcgtccgtggccacagacaagagacgcaggagagggtcgggagaggaaaggaggcagcggaggcagcagagacgaagacgggcaggaaaggccagcgcggctgggccaggccctggaggagacgcggggcagaggcagcgcctcagtccccacccaggaaggggctccagaagctccgcggtgcctgggtggccaggcgaccccaagccacgcatcccccgcggccgagcaggctggcaaaggttggcgttcggctccacgtccacgcctgtcttaaacacagagagatgggtccagaaagcaccaccccgctagggagcggctcccgcgagggcgtgagcaccctggacaccagaaccgggagggccccagggccactaggcgggagtcgcaccgccagcaaaggccaggtgtggtgtgaacgcgcagtgtctttcactcattcctgcaaagcacagtgccttcaatgctgcttcaccagccgacaaacgcctgttcatccgctaagatccctgtggaagccccagactctcccggggctgcccaggcgtccttttcgggactcgccacactgtgcagtgactgtggattgagtgtgtatttccctctcctggagttcaggagccgggcacacgcctgtttccaccctctactgtttcctcccatgccctctgtgtgtctggcacagggcaggtgcccaggagcaaatgggtgaacaaagaaactgaggaatctggagaaagttatgaattactgagggattcacccccagggtcacgttaaagtttccagtcactacttcctcatgagggagctggcctaaaacccttacagaggaagcccttggttgccttaaaccagcacgtgcggaggctttaaaactaaacgtcattccagacctaaggcagcacagagcctagcaggacccaacgctgggagttcacaggaggaggcagcctcgctcgtctcacaacagcttcacgagccttccacagttgcagggcggcccctggctgggatctgcttcctcccaggaggtggcctaggtgcagccctggcctgcccagccagtgcctgcccagcccagtgcccaccaccatcgcctgccagcagtcacaggcgggtggacaccccacccattgacgggagcctccaatccaagcagagattgtttttggtttgggggagtttttgtttgttttgttttgaaataacaatctcatgaaaaacagatttttttttttgatggagtcttgctcttatcacccaggctggagtgcaatggagtgatcttggctcactgcgacctctgcctcccaggttcaagcaatccccctgcctcagcctcccaagtggctgggactacaggcgtgcgccagcatacccaactaatttttgtatttttagtagagacgggatttcaccatgttggccaggctggtctcgaactcctgacctcaagtgatccacctgcctcggcctcccaaagtgctgggattacaggcgtgagccaccgcgcctggccagcatttcatttcttaatcccatttacccatcagctaaccccacattcagtctgcattctctgcattatttcttcattcaacaagtgtctgagccaggcagaggaggtgaacggcctacaggagcgtggcagggaacgttctgagagacacacacctggcacttgaacagcaggaggagaggcagacaccactccccacaaaagcagtgaccttgaaaaggtcagcatggaggttagaggtcctctcagatcctcacgcagtgacctccaaggctcccctcactgcctcccagagggagagcctcagctgtgagggcccctcccgccccaggcacacagaggcgcacagagaaggagctgggagcagtaaggatgtgaccacaccggagatgtgctggaggttagtccgatgtcgtggaacgtccctggtcccggctctggcaggagctgcaggactctgctcaggattctagggtgcatctccagcgtggaggaacagagaccttgggggaaggcagatgcagggatgctgcagacacagctcacgttctaactccatgtttgtcacgtggaaatggcagatgacggagctctgctaggagaggcaccgggaagaaagcccctgttttcttcccatctctgccttaatcgtggctgacagttagatgtgatctgaatgagatgtgcatcaaatgatctcttggatcctgaccttggaaaaccacctgttactggcatgtgcccaacctgattcgttactccagaggactgatgagaagtgacagtggaaaacctgcagcactccttggtgagaggcaaacacagcagcagcatttcacatgattaccagagctgcaaatgttatgcatatttcacccagccagtggatatgctaatttgactgctaagttatttgttctaaaattacgaaagagcaaatttcattttaagtatcagccacctactaatagtaattatgaccataaatcatccagagaaaagacattttctctggcagacactggttcaacccagcccaggcgcctcgggcacacgccttcctcgagtgggctccacacccgccatgtggcggcaagtggcatcctggacttgtgtaccctgtcggctcacagactgcatacactaaggtccagatgtcattctgaggccaagaagctaaatccacaaggaaagccaacagcggcctgtggggcccttaaccttgtgtgcccagcacttaaaactggaattccttcacttcaatgtattatccacccttttgcatgaaaacatgtgacattccccaaattctcaaattgctcctctgctgaaccctatagcagggctgtggtgctcaggggttcctcctcactctgtattcacagggtatccctcctgcttcagcacagagacaagcacatccagtcatgaatgcatgtgcacacatatacacacatgcacccacaagcatgtgcacacatatacatacacacatgcacactcatacatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacgcacacctgcatgcatacacacatgcacacactcatacatgtgagcatacacctgcagacacgtacacatatgcatgcacgtacatgggtgcacgtatgcacacgtacatgggtacactcatgcatgctgatcttgttctgattctgcttccctactgtgtcctcagaactctaagcagtatcttgtcaccattgtggtgccccttttttcttacccttctcaagatgaaaatggatccagttttgcaaggagtcaggctggatctgcctctcttaccccaatcactcctaagagatgtttatggagagtttgttgttcattgtggaaatacagtaaatgtgaacagagcccaccacctctctcactggctgggaggaagctcggcacatcctgtaccacatgcacctgctctgcttcctcccatctctgggcgtcgctgtggccaaggcagacatggcctaaaaatccatggcccctgcccaaccctgtctctaccaccaccgtggaaggcccttcctgggttcaggcttctcgcctgactgccatgagggcagagaaaggctgtcatcagcagcaggatgcacacgccttctgaaatgtgtgctacactttccactgaggcccataaaatccagctgatgtgagctggcatcccacagcaggaaccaaagagggaggaggggaggttcctggacagcaggctcagcaccggcacctgttgcctccaagctgcagacaggactcctcagaagcctgtgagctgctggccactcactaatcacccttcctgagaggggctcactgaagaccctgctttgaggctggaatgaccaaggccctgggatccaactgcaaacaggaaagcatcttcccagacagcaccaacacacacagcaacgggaacgccaggaccccgtggctgtgcaaacatggagatgcaggtctgttggggaagttgctgaacctgaactgggacagcccctgagaaggggatgcgggggcttcacctgtgtcagcaccactcacttggtacaaggaacacacacagatttcctcatctaaaaaatataacgaagcagagtgaagtaatctatacccagccttttcctccctggccccgccagcctcccccgctcttcagagctcacagactccacgcccaatccgaccctgttactgtcagtcactctgtgtctttgtcctgtccccctctacagccttaaaaaaaaccatgccagcaccccaggaaccccagtccctactgcctggagcaggtcctttgatgacagatgtcacctgcagcagtggcagtctcaccaccgtgggtttcaatgccagagcccatcccagatgtgattcctgtcaaagccatgtttcccacctctccctgcagaaaacgctagggcttacgacagcctgaggctctggggttatgttaaatcacattttttcctaggaacgaacgcatcatcatagaaaaggaaggtgcagtgtttgaagagatgctctttttaaacatcatcctcatttttaacattctggagagagagcagggtgcccaggctccaaccccacctcctctgcagcaaacacaaagccatgcacctggcaaagcctcccttctcccttgcattctcagatgtaaatgaggatgcgccctgcccactgcagggggggtaagagtgaagcgcctgcctgctggcaggtgggcattgcctgggccatagctaccccccaatctcagcatcccctcctggcagcacagacccttgggaccaaggagtccccacaccccactgaggttttctaaatgtttccatcggatcgaaaacaacgtgttaaaccagggcggcatccaggcaggaatagaaagccatttccacattaagaacccctattctaggaatcagcctgaaaagtgagagattaaagcgcctcagcccggaggcggggctgcctctgccaggctgggcgtgggaggacagagacccccagaccctcatctcaggcagccctgcggtcagggcatctggcttctgtggcccaaggctcaaatgaaagctgtgattgcaatttcaaagacaaaaggaagagggagagagggaggaggaaggctcctcccagatctgtctctgacaagagggaggcagccctggcagctcctgccaggcctgattgcccatccctgactgtggcttgcggacagggcttggggggcagcagggggcagcaggagacagcgctcagcccctctgctgagagcctatgaccaagggacctggcagcggcctggacggaagccagcccacctccacatgagagggactgactgcttccctgaaagcccagtcccagtctggggacaacccctgcagtgtcccccttccctgcagcctcccccttcccttcagccttccctccccttccctgcaccccttcatcttccctgcaccccctccccttccctgtgccccctctcccttccctgcagcgtccccctttcctgtggcccctccccttccctgtgcccccttccctgcgccccttccccacgccccttcccccttccctgcgccccccttctgagccccctccccttccctgcagcctcccccttccctgcgccccctccaccttccctgagccgccctccccttccctgctccccttcccccttccctgcgccccaccttccctgcagcctcccctccccttccctgcaccccttcctcttccctgcgccccctccccttccctgcaggcctcccccttccctgcagcatcccccttccctgcgcccctccccttccctgcgccccctccaccttccctgagccgccctccccttccctgctccccttcccccttcccccttccctgcacccctcccccttccctgcagcctcccctccccttccttgcaccccctccaccttccctgtgcccccctccccttccctgctccccttccccacgccccctcccccttccctgcagcctcccctccccttccctgcaccccttgctcttccctgcaccccctccccttccctgtgccccctccccctttcctgcaggcctcccccttccctgaagcatcccccttccctgcaccccctccccttctctgcagcctctcccttccctgcgccccctcccccttccctgcgccccctcccccttccctgcgccctctcccccttccctgcgccctctcccccttccttgtgccccctccccttccctgcaccccctctcccttccctgcgccccctccccttccctgcgccccctcccccttccctgctccctctcctccttccctgcgccccctccccttccctgagccccctcccccttccctgtaccccttcccccttccctgtgccccttccttgttccctgcgcccctcccccttccctgggctgccaagcaaggggctccgttgggtgacatgcagccccaccttggccaggtgacccagccccaccctgcccactgcacgtaggggtgggtgttgctcagtccccttcacctgccgatccagagtatggagccccccagtaagtcctccccaattctgaggctttcaatcacagccccagcccagcgttttggggacccgtcccttccttgccttggccacactctcagcgcagggcatttctggaggttgacacacatggctgcattcctcgcagaggagggtccacagccaaattggtagcaggaggagggataatcacccagaagattctggaaacttcagcctcaatgcctcagagagcaggaagatgggtgccccatcctgaggactgcacggtggcctggatcttagacctacaaggcaggaccccaaaacagttattaagtggcatgttctctgcgccgctgcacactcaattgccatgaacgatgggagctgaccgctggcaagttcaggccaaggtttctcctgcaggcatgagggcctgccccctgcacagcctctgggccctgttcctgcggggacacctgtccgtcccctgtgctgggaggaggggcctgaggctcacactccttccatgctgggcctgttctgccgggcacagatgtcacacatgagcaggagctgggagggcacacacaaacatggatgagtgaccgtgccttactgcaaaggtggatccttggggctcaggcccctccaattcacctccaccccatacgcctggtcagtccgctccatcacaacggtgatgtgtgtgctcagcagaggctgaaatggccaaggtcctcctcacgtctttggcttctgtaaagtcagttcttgtttgaagctggggccacaattctaaggcagttcctgatttcagatcctcctgttcacaaaatcagcttcccacagaaaaagaaccagctcactccaccctggaagaagggcagcgagctgggtaccaggacaaccatcaagtcctgtcatttatttttaggaaaaacaaaacctcttactttgattaatttccttatttcaggttcctaattgcacagatttatttaaactctcttaagagtaagaaattgtaccaaattcaggatacctaccagaattgtttgttttatttttaaagtccaggagttactttttgggaaccgcgctctccatgctacacattcctccttcattcgtttgaagacattaagagcagcaacctcaactatatttattctaaatggcacgtggttttaatcagctcttggtttttaatcggctctggttttttgtcctcgatttcctgaaatgggataataccttcaaaagaaggatgtttgctgagtcattcttcgggactaagaaaacatttctaaccttgctttcacagataaaaagttaaagacaagctttgaaaaagtatctgatgaaaatccttgaacattaaatactgcaggtgcaggtagccaggctatgccggggatgaaatggttaagctaatctcagagaacttcaaccggtaactctcatgtgctggattaaaatatagtatgacccatgaaagaacagtaccaaaagtgagaataaagtgaagaaaggtagatgtattgctcaggattgctgagacatggcacacgtgaaccacacagcctaccctgctgtaaacgtgaactttagacatgtggtacttcagacacataatttaaaaggtaaacaagctttttagcagtactgggctgacttagttgtagtctctgatgaaagaggaaaaatccagttcatagtttctcagtcattgttaaagcaccaaagccctctaacaaaaagaccttatcatctcaagacccccttaggaaatgtgagttatatcatcattatcatcatcatcatcatcatggaaacagcctctcccacactttgatgtgcatgtgaaccagctgggccctgttaaatgagtatttctattccctgggcctgggacggagccaaagattcagcatttccaaagcactccctggtgactcgtccgctgggctgcccaccacactgagaagcaagggcatcacatgtagaaatcatccgtaaattgaaaacttgggtcagcacattataaaaattgttaaaagtaaatttaacaaactctttacaatttgttttctggatccaaattcttcatcacccggataacaaatgattggccttatacaaattattttaggccaggcccagtggctcacgtctataatcccaacacactgggaggcctagaggtcaggagttcaagaccagcttggccaacatggtgtttagtctctactaaaaaatacaaaattagctgggcatggtggtgcatgcctataatcccagctacttgggaggctgaagcaggagaatcacttgaacctgggaggtggaggtttcagtgagccaagaatgtgccactgcactccagcctgggtgacggagcaagactccatctcaaatatatgtgtgtatgtgtgtgtgtgtgtgtgtgtgtatatatatatatacacacaccctccagtgtgtgtatgtgtgtgtgtgtgtgtataattttaaattaattatgtggggaaaatcatacatcaactaatttttacaaatgtattaggttcagttttaagactggatgtatatttaaatatacattgtaatttaattaagatttaaaagacaaaaactgcttcctggccctgatgattagaactcttacacttgagctaaaaaaaaaaaaaaaaaaggtttattttgaaaactttatttttaagtgatgagataggaaagaatattgccttctgctcctttagacacctgtccacaaacaccactcgcattgtgggtgagaggaatctgcacttacaataatgaaaagacaaattagatccaattgttactacagtttccccttttaaccctgatatttgctacaggcaactggatatgccacgtgagaccttatcagaggatgggactgacactttaggaggatagtctgaggtgaatttgaaaaataatttctttttatcttcctcttgagctcgctacatttccagtgtgctgggaattactaccgtccactgtagatacaggttaattgacacagaacaaagaagaaaaactacttaaaactctgtaaaagtcccccagggaattagcaagtctcagctggtggcagctctggagggcacaggtgctgtgggtcgttaacaaaaccaggcttgggctcaaaaacatttgaaaaatgtgagttgaagtttcacacactcttctctgtggaactccgaaccttcactattccaaagggccacgctggcttcccaggaaggatcctgcagacgctgccaaacgccccagccacaaaaacgtccacccgctgcctctcactggggcgcagcaaaccagacaacagaactgaagttgaaagacgtgaccagggctgttaaacgccatccagcccaacggttttcgctcttaagcccctgcagggcctgttagaacaaagctgcggggcccagtccccgagtttctgacctaatgcgtccggagcaggccagagaacctgcatatctaaccagttcccaggcaaggccggtgctgctgggccgcgctcctcacgcggcgggtcaggcaagcggcttgcacacgcgagggtgtgacaggctccgggccacgtccgctgggagctgggctctgcggcttcccgcctcccgctcggagtccaaatgtgtgaggctcggagcactcagggcgcccttccggtaatgggaatgttatcagctttatgaagtctggtgcttttctattttcattatgttaaagcttttttaactatgacattttcgtgccttcccaggcaaagcagcaacaacccacttgcggagccgcagaggggaaatcatcactccttcctggaaggaaagatgagttttatcatctcttgtgttttaagttatcctcagaccctctccccgcccggggctacagccaagcaaacagagcactgcccagggactccaagggtctcagagcctctgtaccccccgatttcagcagatggagcgccccagttcaggaggccccagtgctcgcattcctgcacccaggacgtgatcaatgggccaatcctgaacgggagaacagcctgccttctgctgggaagccctgttcccatccccgacacaacgccaggctgaggctgaggctgccttcttgtgaatcttccaaccctgtccccagtctgggaggcagatccaagaagacagctctgtcagcagtcgcagggggggacctcctgcctccagacagcacagcagagggaggggcagtgccagagccccggccaccctgtgttggagtcagagaccaccaaaggcgctgtcacagcggccttttctgtgtagccaggcagaaaagtcaccaaggaggccaacgcgtgtttcggcagccctggattttttgaagttttatttattgaggatatgttgacccgcctggagctttcattatcgatctacttagtgtcatagagtcaagttctacccctgaaagtgagacagcctgagccaccagcaccgcgcccagctcacatcgtggcttctaaccgcgtcaccatcctcctagctctgcggatgcctgcgatgtccgaactgccttaaggtgaggcgagtgtcagcactgaacacaaagcctcaggagtgataaagccgtcacggagtaaaacgcaccatcctctcctcgttccgactctctgctcctctccctagagcttgattccatcccagggccgggagaaaagtgagagaaattgatctcagcagcttcaagcacaagaagaactggcttgctctggggtaggcaaaccatggtctgccactgccatatgtttctgtattaataaagttttatggaaacacagccacgcccacttgcttacagattgcctatggccacttttgtcctataataattcaatagttgtgacagagactggcctgaaaggaaacaatttttacaaaaaaacttagccaactcttgatttattagaaggagatcaggttcttcacaagatcaaaagaaggttagaaaactgacttggagaaatgggcaggaaacaagacaggtgcccaccagaacactgtcacaaccacacagcaccatcacatctggaccagccctggacacagccacccctcaggggtccatggccaccagccccacccctgctcctcgggacgccttcctcccggctgcacttgccgagtcccctggagcacggaaaaggctgtgtcaagtggtctcacatcccccagttcacacagcgaggctaggtggacacacccaaacctggacgtcaccacacaccacgctgttgattccacagcctgattttacaatagaaaatagattcttttcttgtcaaattcacgctgagccacttttccctcacccccagccactgtgtccatcaactactgtgtccatcagccactgtgtccatcaactactgtgtccatcaactactgtgtccatcagccactgtgtccatcagccactgtgtccatcaactactgtgtccatcagccactgtgtccatcagccactgtgtccatcaactactgtgtccatcagccactgtgtccatcaactactgtgtccatcagccactgtgtccatcagccactgtgtccatcagccactgtgtccatcaactactgtgtccatcaactactgtgtccatcagccactgtgtccatcaactactgtgtccatcagccactgtgtccatcaactactgtgtccatcagccactgtgtccataagccactgtgtccatcaactactgtgtccatcagccactgtgtccatcaactactgtgtccatcagccactgtgtccatatgactttcaccactggccccttgactccaggatgggactctcttctcatccatgtgtaattccaaactcacatttgactcagatacccagtctaaacctttctggactctaatgtcacaataccagcttctctctaccctcacagctgtgtaccatgtgcaggtttaatcaacaggtccttgatgtcttcatctgactcactgaaacaagtaggaaaaaagaaagcagaagaggtggatggaaggatggcaccccttcctcccccggcctgtctccccaccaggtttcccaaactggaagcatccgttcattgcacatctctgaagaggcagagccggcaccacaagaatggaggacttggaagtaacagtaccgaacactgatgattctactgagagaatggaaagagctcctggttacgaacaaaaagttacagatattagtcatgttaccatggacaaatcactcactctgtctgcacctgttcacttgaaacattattgggaactggccagccacggtggctcacgcctgtaatcccagcactttgggaggccgaggcaggcagatcatttgagggcaggagttgtagaccagcctggccaacgtggagaaaccctgtctctactaaaaatacaaaaattagccaggcgtggtggtgtgtgcctataatcccagctacttggggggccaaggcaggagaatcgcttgaacccgggagtcggaggttgcagtgagccacactccagcctgggggacaagagtgagactgtctcaaaaaaaaaaaaatggaaaaaaaattattgggaattgttttatatcataaaagcctagaaaattaagaaaatgcagaaaatctcaaagaataatacaataccagttaactcattacctagagataaattccttgttaatattttggttttcagctacttttctttgcatatatgaaagacctggggtcatactgtacacacacctttaatttttgtccaacttatacatcctggggtccatgtccaggatgtgcaggtttgtcacataggtaagtgtgtgccatggtggtttcctgcacagagcatcccctcacctgggtatttaggccagcgtccattagcaattattcctgtgctctccctgcccacccccacaacaggtgcccagtctgtgtcgttccccccccatgtgtccatgtgctcccgtcattcagctcccacttataagtgagaacatgcagtgtttggttttctgttcctgtgttagtttgccgaggataacagcttcccgctccatccatgtccctgcaaaggacatgatctcactcttttctacggctgcatagtagtccatggtgtgtacgtatgtaccacactttctttatccagtccctcactgatgggcatttaggttggttccatgtctctgctgttgtgtacacacaactttataacctgcactttttacttataacacattgtgaacaattccctgtccttagtatttctcatcatgaattttaatcactgcttaataactatttctacacatgcacatcatctagctaaccaattccctcttgaagaaactttacattgtttccaatatttcccattaaaaataatactgcaatacgcaatcttgattgtaagtccttggagagatctctgattttttcctcttaggatacattcccataaaaagaattctagatattttaaaggtatatatgtaagactttcaaaatatcttgccaaattgccctgtcaccaacagaatatgagtgaaccttgaaacctcagcttcttaatttgttaaaatgcaaactatgttcccctcctcaccctatagggttgccgggaaaatccaaggctctaacaaaagttaaaacatgaactctgatgcaggtaggattatcatcgcatcataaatcactcagggacctgcctcttttttcccactatatcactgaggcataagtctgaaccactgttagtcaaaaaaatgcataaatgaaataaaataatataaacccatgggacacttctggcaaaatgaagcctccaggcaaggccatgctttgggacctgctgatgcgatttgctgccacctccagaaccaccaagacggagtaaaagcttttcgttccatgtgcagctgtgtgtgctccatgagcgtgcagaattctctctgttggctggttcccaggccattccttctctacaaaggtgacatctaatcatgcacaatggaacacctgtgtggtgtccaagtcccccgttcactaccagagaaaaattaatgcagggctgtcaacaggctcctaaggttaaataacaatagttttaaaatcctgagctgtaacacaaaggcacatttaatttgaaagcatgtatttctgcctctgccttttggtttagaggacttcattctgccctggacagtgagaagagggaatggggagaggaagaggaagaaaaggagtgtgaagtaggagggaacggaggagccggggtgggaggggggtggggtgacctgagcacgcgcctcactcctggaaccctgattcttccaccgtacacgtgtatgccatcaccatgccctgcgtccttaaggggttcaatgtggtgctaaataacatgagcccaaatagtgcctgccataagcaggcatccagtaatcccaagtggtggctgttaacaacacactgagtaccacctggcagctacagtgggtcagacgctgcaccgggtacagcaggaagcacagagcccaccgcgcgtcctcacatgtgatggccgaggggccacctcagggctgcagagggtgaggagggcaaagagctggaatttccagagggcttgggacgtgctctggtacagggcacacaaggccggtgctgagacactgtgcagctgggagagggcgagttctgtggggaagcacagagaaagcagaggctccatgggaggcttcggcgtcggacaaccccagtggaacaggcgggccattaggagaacacaggaaagtgagacacacacaaggaagtcccctctccccggaggtgccagactcaggtggggctgccactggcagcaatcatgaagaacatggccaaggctgcgggctccacagtgaggctgaggattgaacctgagtttgagcccagctttgtcctccttcagtagaatgactaagtgacaccggccacacaggtgtggtggcaattgtgcagagcaaagcacttcagaggcttcctgagccaagcacacgggagaggaacccacccaggccacctcccgcctagcacctactgcatctaatacccacacttcatttattttgcttaacatccgtcttctccttgaatgggagccctacaggcccggggtctacaggagccccatgaacagtggacttttggccaccaaggcagtggtgtgatgatggtgacagccacggaggagtgtggctactggcaggaagggccccgatcctcccccaaccccacctccacccaggcttggccactggctagctgtgacatgacaaggcggatgccgggggcctccgaaggcctgggtgtctcctcactcccccgcccctccgccatcgccataggaaggacacacctgggccagcccgatggttgcaagagcaggatggcaggtgcatgggcagagacactagggccagcccagcccggagcagccacaaccaatcatgaaggacaccgctctggttcggggtggtttgatggctggccaataccagggattccaacctgactagagaggccccagcatggtcagctgaggaacatcaggaggttactggggggaatgggctctgagctaggtttgaagggtggagaggcagggagaggggtgggtaagctatgggtcagaacaggcatccatgaggatctctcaggacccagggcttggatgtggggcaaggactgcacacatggatgtcagtgaggaccgtccaggggacagccctgcactaggcaggaaattgcacacagagaggtcagtgaggactgtccaggggatagcgctgcagtgtgcaggagactgcacacaagaaggtcagtgaggaccatccaggggatagccctgcgctgggcaggaaatcacacacatggaggtcagtgaggaccatccaggggacagccccgcactaggcaggaaattgcacaaacagaggtcagtgaggaccatccaggggacagccctgtgctgggcaggaaatcacacacatgaaggtcagtgaggaacatccaggggacagccctgcgctgggcgggaaatcacacacatgaaggtgagtgaggaatatccaggggacagccccgtgctaggcaggaaattgcacacacgaaggtcagtgaggaacatccaggggacagccctgctctgggcaggaaatcacacacatgaaggtcagtgaggaacatccaggggacagccctgcgctgggcgggaaatcacacacatgaaggtgagtgaggaatatccaggggacagccccatgctaggcaggaaattgcacacacagaggtcagtgaggaccatccagggaacagcctctgcaacaggcagtggacaggagaccgcatgcacggaggtcagtgaggactgcccaggggatagcgctgcagtgtgcaggagactgcacacatgaagatcagtgaggaccatccaggggacagccctgcgctgggcaggaaatcacacacatggaggtcagtgaggaccatccggggaacagccccgtgctaggcaggaaattgcatacacagaggtcagtgaggaccgtccaggggacagcgctacagtgttacgaaggtcagtgaggaacatccaggggacagccctgctctgggcaggaaatcacatacacggaggtcagtgaggaccatccaagggacagccccacggtgggcagaaggcaggtgggcaggcggcaggagaccacaggcatggaggtcagtgaggaccgtccaggggacagccccacgctgggcagggggcaggagatgacactgtggtcatccgaaagctttcgatggtcggcaggactatgaattgaaccagtcagcgggggcttccacaggctgctgagcagtgaggggacatctgagaaggtgtatgtggcacctgtccaagctgattagaacaaggagagtcaggagtgaggaggatgcatggatcatcagggccaggatgacagaggaggaacaggggaagtcagggtcaggacgagggtgtggccgtgactcagcaactgaaagaacacaggagctacccagctccaggggtgtggtgaaggcagcctgtggggagctggagaggagcaggtgcggaagtggctccgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcagggcaacgtgggatgctcaggagggggcctcagcacgcaggaagctgagctcacaaggggtcggattgcaagatctcttcagaggtggaagctgatgcgggtggaggtgggtggtttctaaagataagaaggggaggaagaagatggggactgggaggggagagggagagagagagcagaaggatgagcttctgttgaagagagaggcgccacacacagcctccacgcagcctccacccagcaggcgggaccagtggacaggctgcagctcacagggtccttgctcaaaggcggcagcaaatgcaccatccacttcctttccttgccggcccgtcagtcacagcatcggaagaatgaatagtgctccctgatccctaacgtgcaatcggggctggagccggagacccctccaccctgcagtcagggccagcggggctgtctcaggcagcacatctaaaggcctctccaagccatgcacccaccctgcaggaaagagctcagcatcctggcatcaagtctgccattcaggccacactgggacttggtgtccagtcctcatctcttctttctagaaacccaagttaaagatcaaggtgacacagaaccagagcttagcagccaaaatcagaatagcacagatgcgtagtcaccccaaagcccatctgctttgttccgggatcccccagcctcatttccatctctgtcatgggctctactgacaacacactagcagaagagaccacacgtctgtcagcgcccacaggcaggtggcccaggggagcagggcctgtcctttgcccaggcctgaggccacacgggcagagtggcagtggagggctggcatgcacacagaggatggtgacttgcagtgctctgttccatggccgagagggctgtaagtgatttggtgcatcttagatagtcattccacccggcaagcaccaactcaaggatgttcatggccctcaaatgtacacttgaggccaggctatgaggggagcacgaagatagaggacgagacacaagtcaagccttaaaaagccattctctcggcagagaagaacaggcacacacaaccaagctgcccattccccagagctgctaaggagacagtgttcgcagatcttggatcagtggagacaccctgagagagacacctcagagcctgtactttccagatttcaaggccacacccctaaacctgtttcctggtgtgcggggacacatttagctgggcccggttctatcagggaatatttaacatagtttcaatgttacaacttggcatcctcggcttctccctcttgggttctgggggagccccaatgacagaacaacttagaagcccagggtgctccgaggaaacatttcaccaactcagcccacggcacccacaccaggtgctcatagacagctgctaaagaaatgagtgaattaatgacgctttctcaaattcgcaccccacaaaaacctcattcacactaagtgtgtgtgtttactctctctctctctctctctctctctctctctctcacccagagtccaggctaagaccatctcactctcttcagtttttatcttttccaagatttcatttcttaaaaagattctacccttctttgcatccttttgaactccctcttctattcctaaccctgttctcttttattttcatattgtaatcacaaaataattcacagatatcagaaattctcctatttgataaaaaatactgtaattccatgtaagagaaacagccatgttctttaaaaactgaggaaaagaagagaaagagaaaactatgagtaggtcggatgtgaatgtaaagaataagccgacaggtcggatgtgaatgtaaagaataagccgacaggacactgagggcgttttgcaggatcacattcttctcagggccgcttgctgggaaacgacatgtgtcgagttcccagcagtgggagggctgtcgtcgaggaggcccaaggaatgtaccttcccagcctcccacaggggattcctgccacccatgtgaggtcacatggggttggcaaagaaccttccttgagtaatagaactatcatcaataggtgatttgaatttgtttttctcaagttaaaatattgaaaacagttggtcaggagttgacggcaagaaatgccagatgaaattttctggcacctttgaccctgcacctctgagataagatggcagtgaaacctcctccgtgtctacccttcatgctcttaccttttcctttccctcctcacctcaaaatgtcgagaggcagctggatgcgctggtgtggtcaggatggctacgcaatgctatttgcacttcaagttttaccccctatcctgggtcctgggccaagacctaaagagcagtgtggtttgtgatgttattaagtggatcggacagagactatggaaatgcgaacgtgcacatcacatcaacctgtgcagaacttggaagggagaacccacggctcacagaggggctttttcctcctagttctcctaaaccatccacatcttgtagaacaaagaacaagggtcccaacacgaaaaaggaggccatccacacaggctggtgccatccctcccatacctgtctctgtagacatgctctgtgccttgcttggaaaatggaaacttctccaggcaaccctggccgcacagctttgcctctcacacaatcgcacacatcagcttcacccatgtttccggctaagcgtcatgtccccgcacacccctgggcaccagtgcaagacacggtgggaggcagcatgctcacagctccttgggtacaaacgggttgttctcacagaggccggaaagagccagggttcccacatgcacattgctaagtgaaagcagccagtctgaaaatcctggaaaaggcaaaactatagagacatttaaaagatcagtggttgtcaaggattccgggagaggaagggagatgtgagtatgtgaaatagatgatttttttagggcagtgaggctatttctatgttactgtaactgtggataaatgacatgcatttatcaaagcccactgaacttcacagcacaaagaggagccttaatttatgcaagtttaacaaaaaaaatcaaggatgcttcagatcccgggacagaatgccatgcagacggtgatgacagaatcctgcagcatcacagatgtgtgaagccactgacaccaacggggcaggagaaaaagtgctgacctacatagctctggaaacgagcagagcctgtaaaactgaaaggaaaagatcctgtctataagcactgtgctctagctgataaacttgtttcccaagaggtaccagctagcaattctgactctaccacacatgcatgcaaagtgaacaatgaggttaacagctggcaggtggcaggaggaagttctccctattggagtggaggttacaggtaagcaggaggcagcgtctggaataatccacatggtaagagcctggagttggagacgtgaataagagctcatggttagcttggtatagatacagatggtaacagaaatatttataaatatgtgtatattcctagatctcacagtcacacccacatgcacacactcacacacatgcatagtcacacacacacacacacatcttctcgctccgtcagctgacatgtcctacaggcaaggacatccccgcagtaatgagcacacaccacgcccagcacttgatttccaaaaccattctcagatagaagggactgggactgcttggagaaatggctaattctaagactgagacaggaaatacacaagatgagcctaaagcctcttgtagtgtcagaaaggaaggaagtgttttcaaaaagccataaagatggacgtattcaaagggacagtttgtgtgaggccacggaacgggctgccggcagccgaagctggaacaatgtgagcaaacaaaatgaaaagtgttatgttatagcccaaaatataacataaagtgttgaataaataaatgggaagaaagagacaaatctcctgtgcagaattccaaacaatttctgtctatcctctgccttcaaggaagcagagcatgacgcgtcactcacgagtgtgggtttacactgtgccttccctcagagagtgcagcagggaaagagggaagcggggtgagggggagaagccgcaaccctccccaccaagccactgagcacagttggtatccaccatgatggcgcacactgagtgtgtggctttgatctgatgtgatgagaaggcacttcaccccaatcttcctccccagaactcaaacacatcagacaaatccaggccaggggacattctacagactgaccaggcctcctcaaaactgtcagggtcctcaaagccaaggaaagtctgagaaaatgtgatagccaagaggaccccaggagacacgaccacgaaatgtatggtagaatcctggatgagatcctgggacagagaaacttcattaggtgaaaactaaggaaatctaaataaagtagggaatttagttaacagtcacataacagtcattggttccttaattatgacaaactgtgtactaatgtaggaagttaattgggaaactggatgtgaagatatgagaactctctgttctaccttcagttattttagtaaatctaaaactgtcctgaaaaatagtttattatagacagagagagaaatagccacatggtagaatatatgaagccatcaaaatgctataggttaatacttcttaacacagaaataggtttatgctacattaagttttaaaaaacaagatgtaaatgtggaagatagaaaaggcagccccgaaacttaccagtggtcatttgtgccgggcagcgggaatgttttggcctttgatcttccttttctgcttatctgtgtttcacattttcttcaaggaacatgttaacatctttttaacccattatgaaaaattatacaagttatgggttattcaaagctcagtaaaagccactgatacactaagttgatatttcaaagggtgtgattttgaagccctctcactacaggctttatcaacgcacgatgactgcacaggtctgtcttagctctaaagcacccagcactctgcatcaacaccacgggcatcaaatgaggcggatggaagcctacaaccctcaatcagtaacagcttgctgtttcgtccaggactgacatagaaggattattcagggggccctaatctttctcttctgtctgctgaggatggtcttacctcatcacaggtatacctggtatacctctggctgtttgtggagagcccctgaaaacacagcagtacattctcctcgtttatcaatgaggagggatggccacgaaggggagcggctggagagagggagtgacggagaatgcacagctgcatggagatgaccccaggatggcagcaaagggcattcctcagaatgacgtgggctgcccagtccctgaacaagcatgggcctggcaggggtgttcctcagatgtttgtgatgcaattaaacctctgtggtccatgaaagagaaggatctcagctgtgtccacttagggtgtccctgtgagacacgacacatccctgcaccccaggtgatggcgatgcctcccactggcaaaaaggatccatgtgtgcagcaaccccacctcttcctcagtgctcacgggtgcgtcaaagagaaacaaaagaaggatacctactttccaaacacatcatccatcaacatgcatgcagctgtttactggaatttgctttttcgttacttaagctaatgaggtcatttggaagatatttatgaaaataaaacataagaggatgaacctgccccatccatttggttaacaggaaaacatctcgcagatgtaacagccatggctgacttccagaactgtcaccatccgcctgcctcaaagtcactggcacgtgtgtggtttgctgctcctggacccgctctctcaggggcatcatcatgaggcctctgcagagccagaggaaagaaaatcatctgaagaagaggattccgtgaccactcttattttatctccacagtactgtttcttgcctaatttgtgccgaacatttacgatgacaaagacgatgatccgaaaacagcaggcagaacaaggttgcactatggcgaggagaactgggatgcggagagaaaggggcagccccgggcacacaaagcggccgcgtgcaccagctggtgtttccctctcagtgagtgtattttttttttttttttgaggcagtgtttccctcttgttgcccaggctggagtgcaatggcatgttctctgctcaccgcaacctctgcctcctgggttcaagtgattctcctgcctcagtctcccgagtagctgggattacaggcacgtgccaccatgcctggctaatttttttattttcagtagagatggggtttctccatgttggtcaggctagtctcaaactcccaacctcaggtgatcagcccgcctcagcctcccaaagtgctgggattacaagcgtgagccaccatgcccagccgtgcgaatgtaatttttaaaatccagcatctcaacatcaggaagaactttacagaccagtttcccttctcactcaatttggctgcatcacccactgctcccaatgggaggcgagtcccaggggctttttccacctcattccatgctcgcctttctacatcatctgttacatgctcaaggcttccccatcggcctctgcaatccctcttcccagttccttcctgtttccctactctccatcctcctctcctgattcctttccttggcttgttttcacccacgtgccactgaaataccagcgtctaccaaattttcactatcgacacctcccacgcttcatcctctgtctggtcgtctctccacagccatggctgtagtcaggaatgattcctaaatacgtttccacactttttccaagagttccaccttcatagtccagtctttctggacgttgtaacctctatcacacaaacatttcatacttgatactctaaggctgagccccttttcactgtccccctccccacctaccatgatatccacagacacgctggtgattgcacctcacagaagcctctctgggcttctccccacgccccggccgcctggccatctcttgcctcaaaggcctcctaaggagtctccatagcattaagtaatttaccttccaattcattctcctctctcctacaattaaaagtgaatcattccagccagcgcagtggctcacacacctgtaatcccagggctttggaaggctgaggtggaaggatcacttgagcccaggagttagagaccagcctgggcaacaaagtgagaccctgtttctaaaaaacacataatttaaattttaaaaaataaatgaaaatcctccaataacatgcagcctcttctgtatgaagccaaaacttccttacaaggcacaaaggtgctttccccttgttccttcccatgccctcaactccccagccccctcccagcctgccttgcacccagccctaggcagccacattcttggtgctttctgcctattgttcttggtgctgttcttggtgcttctgcctatagttcttggtgctgttcttggtgctcctgcctattgttcttcgtgctgttcttggtgctcctgcctattgttcctggtgctgttcttggtgctcctgcctattgttcttggtgctgttcttggtgctcctgcctattgttcctggtgctgttcttggtgcttctgccttttgttcctggtgctgttcttggtgcttctgccttttgttcctggtactgttcttggtgctcctgcctattgctcttggtgcttttcttggtgctcttgcctattgttcttggtgccgttcttggtgcttctgcctattgttcttggtgctgttcttggtgcttctgcctattgttcctggtgctgttcttggtgtttctgctattcctgtaacctgcaaggcttttctccacactacaccatggaaagtcctctctagtaaaccgtagcccagcagaaccactcgtgagtcctgtgattccttccaaaccactagacctggggcaccttgggccccagcatggtgcctcactgattttggactgggcacaacacgattcatccaaacaccacttgacaaaggccagcaggacagaacagtacaacgctggttccacagtgtggtcctcactgaagacagggcgggtggcattgacccccattcctgtcccacagttgagggctgccccacaggcttcctcctcacttcgggggtgcaagcctgcaagaccaaacagcccacagccttggaggaggcagagtgcgggcagcgccccctcacagaaccgcagcaacgacacctatcaccgcccaccacaggcgcactgtgggctgatggggtgggccacatatggggaattccagaacgtgaccctgtacctaaatccctgcagttcccaagtctccctcagtccttcccagacatctcttaaggggcctgactctgcctcagccccaccgccccccagcctgagccccgttccacctcctcactggcctcgctgcccctctgcaatctcctccaacagccgccaggatcatctttacaaaatgcaaaggtcatattgctcctgagctgcaatgccctcaggcagtcccctgcctttagggtggagtccaagccagcctcatggacagcgtctccagactcttccccaccatagccaggcaggcctccaggcgcttccagactcatccccaccatagccaggcaggcctccagatgcctccagactcatccccaccacagccaggcaggcctccccaggcacctccatccccttcgtcacacatcccacacaccccggtttgttcccaccaggccttcactaacatgccactgcagaaaaaccttccctcccccccagtctgactagagtccactcatttttcaggtaccaagttgcaccttgcttcctccaagagggctccctaattcctgaccgggcggggcacccctgcaacattctcccagctccctggactctccctggcccagctctcgccaactgcattgtgattacttaagaacttgctcctcccttaaaagaaaatagactccaggagggcaagagtgggtttatctcagttactgccatggtgtctataaaatagttagagcccaatagttcttactgaatcaatctatcaattaattaatagagacgatacggatttcatggggtgggaggatatgaacattaatagagacgatatggatttcacagggtgggagaaggatatgaacattaatagagacgatacggatttcacggggtgggagaaggatatgaacattaatagagatgatacggatttcacggggtgggagaaggatatgaacacacagggacatcagcgcttgtcctttctggacttagcaaaggccatactcagtagctcaggtgccaagtaagccagaagtgaagaaaatgcacagccaagccgggccagaacgtccacagaggctaaaggatacggctcaagctccacctttaaaagagggtaggactgagatcaacagaggatataaacagattaccaggacggcatgaccatagaggaaggacccacttgaggaggccacagcaggacaagagggaaggacgaaccttccccaaggctaagggtcaaacattcgagctgattaaaaatgttacttgaggccaggcgcggtggttcatgcctgtaatcccagcactttgggaggctgaaacaggtgaattgcttgagctcaggagttcaagaccagcctgggcaacatggcgaaaccccgtctctataaaaagtacaaaaattagctgggcatgttgctgggtgcctgtaatcccaggtactcgggaggctgaggcaggagaatcacttgaatctgggaggtggaggttgcagtgagctgagattacgccactgcactccagcctgggtgacaaagcaaaacaactctgtctctaaacaaacaaacaaaaaaacaatacttgggctccaggatgcccatcatcctgcagcagtttgcactgagctccctttatgccaacaggctcaggatccccaaagcactgcagcagagaacagccgtgcagcatctcaggccacacagtacacaggcgtcgtcactgtttccaagaacttccttggctgaaaagtcatttcaaactttggggctattttggcatctaagtgggaagagggagaaaacattaaaagaagtcccttagtgctgacactgtcctgccagccagcacatctcctcattttatgaagtcggactcatcccagctatctgtgtgagacactcagttggccatgacagttaaattactttttcataccgagaacagaattagtctataaataagtaaagaggtgctagggctgagtcagaagtgccgattccacctcaagctccttccctgcccgatctgcaggtggctctcagggcatgggggaccaagctgtgtttgagcctttgctttgcatgggtggctctgaaggtgatggaatgggctggcattctccagcactctctggcattttctgacattctccagcactctcctgcactctccatgttgatctgggtgactctggaccttcattctaaagatactcaagaatctagtggccatacaacatccccaagggagaaaggggccctttttctccaatgctgctgatgctgtttcccatcatataaggactttctcccatcccaagcagccaagggaaagaagtgactcacctcagaaagaagaaaaagggaagaagggttacccaatgcctcccccatggcatggaaattctccattttccccacaacgccagcacggtcacactctgcaagcaacacccatctgttctccttacattttccaactttactatcattagcctgaaaccaagctttcctgttcagtgcaatgactactctgccaaacacacaagttctgaacaggacatgtgccatgggaaacatttcgatttaatgagcttttccagtgcaacacagaatgattttttaaatcccagggatgtcccccactcaaacttgtcatttcttttaacaaaacaacggcaatgccaagaaaggaaagcattttctggccacagagtgggcccttcagctccccttccaagagggagccctgacacggaggcagaaggacttccatcccctaagaaaaacagagtttgggatcttgaacaaggtgcattggcagcctgggtctcacaccgtcccttctagagcaggaaggtgtggaaaggagagtaaaattccactattgtgaaattcccccttcagcaatgaaacggactctgagaacttatttttcctgaaaattattatttatgtccatctagatggtgtttctatgtttactgccactacaatttaaaacagttcatgcccttcggtagacagtttctagacgagtctttcctggatgtttgaagcaggttctccaccttcagctcagctcgaggcccctggagaaacactccccagagcaggatctccagagaaggctcccttccgtcaggagcaacagtggctccaaccccgacttccaagctctgggcggccttccactgttttgtgggtggtgataattccatttaaagtagcacttacatggttttttagaaaagactataactcctggatttttttcaaccatattaccaatagaaacaaacatacgaagaacgatcgggtggctgcttatcagaaaatcctaatccctgcctcagccatgcccagccaggtcacagtgagcacgtcctggtttccatgtctgagcaccagatcggtaaccccagcctcttcactctcatgagggtgcagcaaagattcagcaggaggatacacatggatacgctgggcaaaccacaggcaccctgcaggccatgagggcctggccgagatctcagccagccaaggaacaggagatttcagccacgtccctcttatctctcccacagcaggattccaagtgctgcagccaggaccttattccatgacttccctctgtgcgaggcgctcagtcctgcagacgcagtgacttcctgccccagctggaatgctgtctgcgtagtcatactataattttatttgtattatttttattgttgtattgttattttatatttttttccccagtactttcaatcctctgttggtcgactcaggcagaacctgagggtatgcagggctggctgtattcttgcccaaagggacctgagaaaacatctagaccaacgcacaggactgtgtgattcacccgaaaccacacagttagttgctgagttagagacagtactaggtgtctggcttcccaacagggtgaattatttctggaaattgttttttctccctgcatctaaatttaacaatgaggaaatctattagtaatcagcaagatgctgaagcagtaactccaaaatcagttgacgaatgatttctcaggagcagcacgctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaaggtgaagtgagggcatcagcatggtctggagtccgtgaggcactcggaccaccggagccagcccaggggttggcacagtctgcagggctcagcgtctcccctggttctcacgtggacattggctttccttgtcttgagagcagctcaccatcacgagttcttccaacagcccaagtcttcatttccacacacttgcttctgtgtgtggcagatgtggagctggagagaacagacctgccgtgagaagggagagggcagcaaagatcacccagaacttgctgggactgagatgaacaaaagttacccaaaaatgggaatttcaagaatagccaagggcttcaacagaggatgagctgacacttagatttagggattgtcagcatcaccgtggctgctgacatcttgaaaactggaaaatggggtctcagaagaacaagataagagcgcaggaggccagggtgtgactcttggggtccaggaggggacatcacaggaagcacaagttggaggggccagacgggttgcagccaggttggggtctggggagccccagtgtgaccaggggcgggggtggtgggtgagcctcagcagccagagtggtgcagacacgtcccacggtgagggctggtgcggacaagagattagccaaaggagcagccaccatgctgccgacagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctccgaaaagacagcccttggaagactgtggctcaggatgcaaggctctgactgaaccctcaagctggccctccatgcgaagaaatgctgcgtcccaggccctgcacagtgctggacttcccagctccaggctctggagccggctgcagagcacagcgtgaggcaggccctgaccgctctggaaggaaaagcacctctggcaagtagtccagaggtgaaagtttctctattttggaaactgggcatctgccaaggagaacacacggccccctaatgtgcaacaaaaccgtgagacccgagcagaagctgcagcagaaggtagcacgggcaggatgctaggccccaggggccatgggctacgcacgggccaggtttccagcctgccagccccatccagacttaaggacggaaagtgggaccaaggctgagccgctccgcacccctcgctctacagctggacacaggctctgcagaaatcctgagctggggccaccccagcctccctggcccagaacaggcgctcactgtatctcctcccttcctcctgagaggtcctacgggatggagtattaatagtgccgtgtttaattattattcagcataatcacacatattacggggatttttaaagatcctttcatgcacaatgagtatttatctaatgtgccctcctcattcccaagcagccctcgggggcagatgcccccatctcccaggacatctctgctggtctctctccacggcacctgctccacagccacctctctctgctgtgctcacacagtgtggaagctcccgcttcagcaagaggaaagccccgatgatacagggtgaagacgcctcccctcacagacctcagacctgtcccagagccctgacaggaagacccaagctctcctgaagccttagggtctcaacatcccaagccgacaatgcccccccattgactcggctctctgcagacctgcagacctgcagcccagcccctactctcccctctggctggcattgtgcagtccttccttcctcagcagcgctgtgtgggaagggggactatctgcccagtccctgaggagatgatgacttcctacagcttctgaaagggcccgctctggggggagccacatcaggcagacacacggctcctggtgttggcagggtgccggcggaatccagggcaggattcacttgtgtggcgaaggggtcacccctcgtgcaggctcaggccctccctgcccacctgtggcggcgaagggaactgacaccactccttcccggtgagctcggcagggctgcatctctcccgtgggacgctgcagagataaccaggtagagccacgctcacgagaaccaccagccactctgagctaggacggggcacaggcaaccacgttcccacaaacacagggtctggaggtctctccgctggtcacggcctcggaattccgacatgctggactgtggcttgggaaactgactcggttgttctccattcctgatcccatttcctgtttgtgggtgtgatggctgagttgtgcaccccaaagttcatacactgaagtcctgacccccaggacctcagaatgggactgtatttggagatgggtcttgaaagaggtgatttcagtaaaacgaggtcgccggatgggcccggatccaggctgactgggtccttatggaggaggaggtgaggacacagacacgcacagatggacaaccctgtggggcacagggaggagacggcatctgccagccaaggggagaggcctctgggggaacctgccctgccgtgctctcatcttggactttcggcctccaggactcagaaatgtctgttgtttgctaagccgcctggtttgtgggggtttgttagggagactgagccaattcatacagtggattccgccactttctttctaacacaatgaagatagagttggtgacctcctcaaaccttcataaaggcataacttgtaacaacacaagttatggtttgtgacaaatatcaccagaagccccaagcagagtcgagacgtgcgcagaaactgcacaagccaacctggctcaggcctgggagagcatccctccgaggagcatccctccgaggatcccccacagccttcccgtcctcggagcaaatgcagctgtgtccttcccgcaccgtgggcctggccctcacctccccccaccccacacccagcttctccaccagctccccaggcctcctccccacaaggcgcgtcctgggcctccctgaccccggccatgccccccgccaccggagccacttcactgccttccctggccacagctccctgaagacagggccagcctgcgtctccgtgtccagtccttggacgtgctaaatcctcagcgagtgtctgccaagacacatgtgatgagcaggtgaaggaacatgtctgacctcctgcttcagtgccatggaggcctcaccagccccaggccatgggctggcctctccatttcctccttctgagaataccgtggagttgggattgtgtttgcctgtttacagggactacggtcagtgtccctcccaggccgctggtccttcctaacacctggcggcccactgctcagccatgtgggggttgtgcacagggcagggctccgaggtgtgggctccactctgtgggggggtctcacagcagccacacagagctggccattccctcaccgtgacctctgcagagagtagaattgtctgtgtacatggggctggggccaggctgtcctccgccagctctcaccccaggctcccctggtcttcctgccccgtatcccagattcatcagcaccagccacatctcacctgccccacaagctgcgcctcggtgctgctgtctcaaccaccttcctgtgtagcagggaccacctacctgtgttgcttgtgctatgtctgttggtttaaagcccatctctgatcccgcccgacacacagcagggactcagcaggacactcagtctaaacgacagggtagggggcaggcagggacagccgaggagctgctcctgggtgttcctgtgttgtgtgagcacatggaggaagttggtgtgtactaagcagtgaagctgctagcaactggctgtgtaacagctgccaagtaacacatcatgtttccacagagctccagaggcatcagcctaaacaagaggctcccgagaaggtgcactcatacagtgtggtgggggtacccgtgcttgggtgcaggacaggcgggggcacccgcctgggcagcctccagatgctgctgaggtttgccatggggtatgaacgccaggtgacgtcccaaaacaggccactcaatcactccccagagccggtcagccgtctcttgccctgtgaaatgcacatttacaaagcgtcacctggtgtatcaggaacaggttcacttgctgtctcagacctgtgaatgcctacatttcagctgatttagaaccacgcatgctgggccaggctcggtggctcacacctgtaatcccagcactttgggaggctgagggggacggatcaagaggtcaggagattgagaccatcctggctaacacggtgaaaccccgtctctactaaaaatacaaaaaaaaaaaaaattagccaggtgtggtggcgggtgcctgtacttccagctactcgggaggctgaggcaggagagtggcatgaacatgggaggcggagcttccagtaagccgagatcacaccactgcactgcactccagcctgggcaacagagcaaaactccgtctcaaaaacggaaaaaaaaaaaaaaagaactgtgcacgatggacactggcctcggtgagtccacaacaggaagcaaacaaggattaaagtgcccggaattggaagacacaacatttcctacacagcctgagtctaaggtgatgaggggtggaaacaccagctcctcagggggccagccctgtgagggaaacgtgtgctcacgaaagtcagcctggccttcgagcccaccaaggggctttgggatcacacagccaggggcaaatctcagctctgcagcctgagaaaagtcacccaaatgcctcaatccccttctcagacaggcagacagacaataataacaatgatgcctgggacacaggacattagaatgcccgcagcactcacacagcacctggtgggcactaagcacccgtcgctgttggtcctggggctaacgctgatgggaggagcagctgcgtgcatatttacttctgaatattttcacattttaaaatcatctccattttgctttggaatgcgtggcatctctgctgtgcaggtgctgacacgccccagagcaagcattggctgtgtcggcagaggaaggtgggaaggcccaggggaggccagcaggaggacggactcaccaggacacccccaaggacagggaaggtgctgctgaccacggccagcaacgacgagccatggtgacagctcacacacagctgcaaactcacatcgctgcctctggaaccacagagtgctctgtattagatattttgtgcatttttgaccaaaatgagtcaaatgtggggagagtggcaactgtgtgagtctgggctccaatcagcagcgaagatgcagtgtgggaatgacagcagcttccctctgcggacacagcacacactcaccacacctgggctgtgtccaccagccccaggggctgtggggaggggcggtcaccagaaggggccaggcgggagcaggaccagctcacagtctccccaggcctccccagccagcatgagttctcagcatctcctctacacacatggacaaacaccacacacacgtgtacatcacacatgccacacaccacacatatgcacaccacacacgtgccacacacagcacacatatgcacgctaccacacacatgcacacatgtatctcacataccacacacaagcatgcacgccacacatgccatacacaccacacgcatgccacatgcacacccctaacttaaggcctagctccaagtttctgtcacaaccaagagggaaaacagagagaatgcaaaagaagtgagatccattcctaggacaggctgaccccaaaaataagtagaattacgtcagatatttagaacatggaattagtgatttggttccctggctagtccatcaaagcctgtcgatccaaaatacaatttaaatgccacatgcttgcaataaaaagcaatggaaagcaaggtctttacagtaataattaagtgaagcaatgaaattgaatccaaaattattttttgtttctcttcaatactgatgctggtacatgaggaaaacagaacaagcataattggactgaatgagggaaggtggcaatttgcggaggctctgcaggagctcctgggaatgctggggacctggacatcccacgccggcctccccgtgtgccacagactcagctctgctccctggagcaggtttcatgcactgggacagggagctctggtaccccacgacttaaacacatagagcaaggcggggggggttccatgtgggcaaggtgaagagaaagcccacgatggaaccagctacagcacacgtgtgagagcgtgtgcctgtgagcacccatgtgtgcatatatgtgtgcccatgtgaggtgtatgtgtgcaggtttacactaacatatgaaacagagtgagtgctggggttgcaaagacccagaccacaaagagctggtggcaaaggaaaagaaacatgcacactcccaagatctgtttcacagcagaacccactccttcctgctcctgaggggcgaggcaagaggtgtcgggccatgtgggtcccatgcaggttccaggaaggacgttcactcagcagagcaggggaatggcaggctggggggagctagtgatcaagtgccctcaaaacatacacgtgtgtgtgtgtaagcatgtgtacggatgtatctgtatgcggatgtgtgtggccacatgtatgtatatgagcatgtgcatgggggtgtgtgtgtgaacatgtgcatgggcgtgggtgagcatgtgcacacaaacaaaaacaaaccacaacagactgtgttcaaagcgagaggatccctaagctgcgatgagggaactgaatttaatgtcctaggttacagcccggccaacagctgccccaaaccatgcctgacacagcaaatttacagacacatcaccctacagcgctcaggtaacggcttcccagccacgccccattacccacgtcccatgctgccatccaagaaacgctccagggaagggaagccaaggctgtcagttcacatctccctctccagagtcgagctcaagcccgcggctgccaccctccatgaactgatggggaagggggccacaggaaggccccaaccccatccagatccaggcctgcgagcccaggggtggcacagaaacagcaggtgttccctgagagaacgacccagggctgtggcaaagccccctccaggctcagctcatcccacctgtggggaaggcaccatgaggcctcctcacgaggcagacgggtgtttgctgtggtggacagatgcccacatctcacgcgcagcctcctggaaggcagcagatgcaaacaccccagctgagaggaggaggctgaagcaagtgcaggaaagaacaaaaccaatgcaccactggaccatcacctttagagaaaaaggttaagaaatctgtatcacataaaacaacctccaaacaccaggctcgacgccctcacccaccacctgccctctgctcatagaaagaacgtggtgaacaggagcatattttacacaaacacatgcctcctcccagccacgctggctccaacctactaggcacctggaagctgaacgcatcactgcactcacacgtgcctaaacacttaggtgcgccgagaagcccaggcatttggggtttccactgacaaggacacggaaggcaaaaaacccaaagcaacgtgggtccttccctctgaagggtcagataaaccggcttattttattcttagaataggtttttgccacagtgaaaactgaataaacaacaaagtcagaaaggggcgtgtccatccacagactttaatcctgcattaacagaggctccctaaagaagggggtgccggagggaggtgcagaccgcttcagggttggcccagcacctgggtggtgcccatgcccccagtgtaaaaagatcctcagctcgtcgggcacgaccttgctttgttatctgctcttggcctctgtccattctcaagccacgtcacgtctctatgaccaggctcttagatgcccaaaagcgacattgggagaggaaactgtcagcccccagcgtggctcctgtggcttctgagaagccccagatgtcaaacaggcatcagagcattccagtcacgtgccccacagagtcatcacggagacagcagagacagccatgagatttgctcagactttcagcaaacccccaccgatgcctccacactggaagttggagcgtggtggaccgtgcgttataataaagttgctattgtatgtgactttgatcctacaaagaggaaaaaacatgggtaaaaagtaagaaaagaccaaaaacgtcactaaacttcaaaaacccgggacatgatgtgattagaggaacagcatggaacatggcaaaaaatacataacaaaacaacaaaaaccagcaacaggcgcttcctccagacacaccacggcacacttcaacctgttccttacaagactacattgagcgtgctggtgttaaatgcgtgcaggcttccgtgcaggagccctctgcacatggcagagagaatgtggcccgtgctgcactctgacgcgcagaccatcttgatggctcagggacggccaggctccaccacacctgctccctcctgactggcctctctctaccaagccagggacaaggcctcatccccagaaccaccaaaggattaacttaaagcaaaacaaacacaagcaaacagaacagaaatgacttgggttcctgtcactttgtgctcccaagccattccaagagaccagcaattaataactcgcaaagaattagctcacctccaacaaccacgggagcttgaaaaccacttccttccctagttttgttacttgcagaatgaactgattctcaaatccctggagatactgggctgagtgcatttgtcctaattacagcaacatcatcttcctcagtgcaccctcgctcacagggcagcgcccaagatctgcactcaccaaagtgagcctctcacagatggaatctgtgcaaactttaagtcccaacaaaactttgccaaactcacttgttgagcaagaagctcagaaatggagatttctaggaccctccgcatctggctgcaaatcccagacacaaaccatccaaggagatcgcacctttgccttccactgagtggcccaacgtggagtgctaggaagccatcaggagccagacagacctatgtccactcccggaggcaccgccaggaccctgtcctgcgtgatgggtctccctgcaacacacgaggagtccctatcccaggggccagaggggacgtcccgcagagaccgtcctgaccccagccctctgcattgcaccaggtggacaccacagaagctctagcctgaggcaccgagccgtcaatcttccatcaatcgatgaagctctcacctataacggacatcctttcgccaccacacagcatttaccaagctttccagggtgccctgatggacatgctcacaatgcctcggggatttcctctgaagatgtggatgcagaatgaacaccatgaaaacacagctcccactccgggtacatcccaaagtcgcacgtcaggccctccgtgccgccgtcacagctgctctctccccagccaccactgcctttgctggggatgccttgcctgaagatgcaggggctaccctccctgggcctccactggccagtgcaggttgtgaccacccaccccccgggctccatcagggatggctgtgggtgcaggttgtggccacccatgccccgggctccatcagggatggctgtgggtgcaggttgtgaccacccacgccctgggctccgtcagggatggctgtgggtgcaggttgtgaccacccacaccccgggctccgtcagggatggctgtgggtgcaggttgtgaccacccaccccccgggctccatcagggatggctgtgggtgcaggttgtgaccacccacgccccgggctccgtcagggatggctgtgggtgcaggttgtgaccacccacgccccgggctccgtcagggatggctgtgggtgcaggttgtggccacccacgccctgggctccgtcagggatggctgtgggtgcaggttgtgaccacccatgccctgggctctgtcagggatggctgtgggtgcaggttgtgaccacccatgccacaggcttcatcagggacagctgtgtgctgctcttcatttcccaaacgcagtgggatcaggcctggctggatgtctgaactgcgactctgccccaactgctgccctcattgccgtaccccaagagcctccatccatcttgcaatggagctgccactcagcttgtccaccacagtccctcctgaagacacatctctgcgaagctccccccatcacccaggccaaagctagcctaccacgtcacacagtggccatctgcccgggcatgtttcacctcggctgtgcagaccctctgaagacgagacattctccatatgtttcttggctccaggcagctcatcgacagataacatcctgctagatcagcagagacgacgcctgcacgttgggcagcctgcacagccagggagggcggggtgggaaacgcagcgggagacagtgaggtgggggtctggaagtcctgcctcgagcctcgtcagcaggcaggcgtttcagtgttccccagaactacacctcagtatgccctcgcagaaaggagcacttcacacaacatctttagagaccagccacctccaaagcctctgttcctcctgcattgcctcccaaatgatctcccagcctgggaatgtcagattctcagattccatggggtattcttttctgtggctgttactcatgtaatctaaggaagtgttgaagttctgagttaccctgtagcaaaggcatatcttgttccttccacaatctggtcgaagaaaacagcagctttgatctcagatactcttaactactcagtaccaagggaagttgtgggctttgagccaaccacacctaatgtcaatgctcactccctccccattcagctgcgtgaattcgggtaagtttcttacatgagctgagccttgtttttcctttctgtaaattggggatttaaaatgcccacctcactgggtcatggtaagaacctgcaatgggagggtacctgcatttaatctgtgctgttttcgttctcctgatacagaactgtgtcagaatcctgctttctgcggctggactatttgtcaactgcctgttagagcacctggggagcggctggggctttctctggggtcagaccatggcactgaggacttcttgtagcattcaggtggctattgaaatcatacaaaaacaattaataggcaaccattagaaattaggcaataaagttttttcagttagttggtcaactgtgtacacaacacaaagcagaatacagagtgtgtatatgtcctcaaccatgattgtttttacataaagtgtttaaaaaaaaagactggaaggaaacacagtaaatcttaatatagcggctatacttgattatatttgggattttttctttcattttctataaaatgtctaagttttccatccagtttatttttaaaatctgcaaaagtacttcaaaaatgagtaatctaaaagtctggttccatactagataagatgaagaaaaataaaatttcagttcacatccaaaaggttgggaccttactaaccagaaccccacacataaccacacaaaacactcaaaacaaccacacaaagcaaccacaactccagcccataccttccatttagttttgttgtggatgttggcgatgcaatgccccaaatctcattaagcccatcaattaaaattcaaaaatataaaacatgaaaactaaaataaagaaggtctgaaatgccctttaaattttgctgaaaatcatcacctcctcctctgggtccagacagggctagacagaggcttgcctaatgaaagtgattgtcttagatttgaaactttgcctggtttcataaacttgatgatgttttcaagaaaataaacaataagaagttaagtaagtgctgccctgccttgtctattgtgcaccaggcacacatgaagacacaagggccttcccagcccactataacccagatgggactcaggaagaccccacaagggcctttccagcccgccattgacaagatgagactcaggaagacacaagggccttcccagcccaccatcaacaagacgggactcaggaagacacaaggaccctcccagcccaccatcaccgagacgggactcaggaaaacacaagggccttcccaggcagccatcaccaggatgtgactcaggaagacacaagggccttcccagcccaccattgacaaaacaagactcaggaagacacaagggccttcccagcccaccattgacgagatgagactcaggaagacacaagggccttcccagtccaccatcgacaagacgagactcaggaagacacaatgaccttcccagcctgccatcactgagacaagactcaggaagacacaagggccttcccagcccaccatcaataagacgggactcaggaaaacaactgagcaaacatctgtcagtaggacacgggtggagacagactgtgccccggactgaatgtgtgagtcctcccaaaactcctacgtgatggtgttaggagggccctctgggacatgactgggccatcagggtggagcctcaggatgggattagtgcccttataggaagagactcaggagcccaccctctgctcgcccctgtgaggtcccagtgagaagacaggcctctgcaaaccagaagcaggcgctcccagacaccaagtctgctggcaccttgaccccacacttccagcctccagaaatgtgaaaaataaacatccattgtttaagcccgaggctgcagcatatttgttatagcatcctgagcggactatgatgaatagcatagccaaattaggataactggagagggatggcttacaagggcaagggtcaggcataaggaaccacaggaagaggctctctagttcagcagtaatgtcgtcgttagcacccaaggcccaaacgaggaagcagagtcatgcatgagagtcaactgtcaggaaacagtgagctgcagcccaaggacaggccagcgggggctgtcgccagggaggaagtgcagtccacatgccgtctctatccaagctccagctccctctgccattctcctgcctcagaacagggaaaaggtgctctgaagctgcgctcccttccactcagccagagaagaccagcagaccaggggccagaggcaggtgagtcaggacagaggtcaaaggacccacagacctgtgggacacagagcaggacgtggagggtgggcaccccgcagagcacccggcctcatctgccagcccagcaacgagcctggactgtgctgcaaactcgattccttgcatataaatgtgaacattaggctaaatgacccttacattaccagtttatctcaccagcgctttcagcctatttcttatttaggtctctgataaatgacttcatctttatttatgaatgttcctttccctgtaatatttgctagcttcaccttgacctcataaatgtaatttgttgtttcaaattctagtagcagaactgcattttaaaatgctgaaaagccatcactttagagctggtgagagaaaacattactttttttcattactcatttcttctagatttggaagcaaaatctggctttccaagcacggaaggagtagaccaccacagggacagagggtccccctgtggagctctcttccggacgctggcggaaaagagcacagctcgtgcacctttagaatcagtgcccctttttaggggccccctgtaagtggctttgtttctggaaaatgtggggacacttttcatactcgacgtagcccacagccaggtctgtgcaccgcatctcggaaagtgtttcgagacctgctcgtccggtgactggcgcacgctgcgctccctcacaaacactaaccccagtggttctcctcccagcactgcccctcacccctgcgcggcgtgtccctctgggaatccactcgcaggcgacctccagcgtgtgtctacttgctgcttctgtccctgttaccaccaaggctatggctgcaagtttccaaggaaaaagcgcagcctccgtgggtcgtgatttctgtggcttctataatgcgtgtgtgcctctcccagccgtcacacatggcgtctcaagtgccccagcccacccatgggacctgcagagacgcatcccagcgccctaggcactgagaataggtgggcgctcacctgacagtggcctcccatcctccactgccttgagccctttcccatgcactgcactacggacaccccagccactacctcatcccaaaagcaggcggcaccacggggcgggaagaggaactcaggtccgtgaacacctgcctcgtgcagggccctgactccagtgattctcgcagcctcgtaaccccaacaacaggccccggagctcagctttttattcccacttcacagatgagggaacgaagacacgacccacccaaactcacaggtgggcagggggtggtctgactcccagcccagtcccaggacctgctggaagtgaggcagcacgaaccccccagggctcagctctccaaatccaaaatggaggggtttcccttcacccctcagcgctctggagggaacgacaactgcagattccaaggtgtttcagggaaaagccatgccccccgtgtcagccagcacagcctgcaacgaccacactggtaacaaacaagtaactgtcccattttccctgaactatgtcttcaatttcatctaaaaatggaactatgaattccaatgagtcagagaatcttttaaaatgtatatttaaatgcactaagatattgagttgctatatatcacattcaccctctaggcacctgaagacacaagtgacagcaatattggctgtgtgcatttcattaaataggtttacccccaaaactgtccacttgccttttaaacatccttagggttgctgccttcaaaaacaagccttttgtttccacagagaaatgcatgcaagtggctcctccctgcaaatcagaacatctgaccctggcccagcaccggactcctgtcctggatgtggtctcaacagcacagccttggagcaaacccagggagctcgaatgagtgacggtcctggtgtgggttcagccataacctccaggacagatgagagcaggcacttctaaagggtggcccttccgagagggaaaggcctggagccttacgctggagcatgctcactctgggggtctagcgccgagtcccgggtcctgagggacacactgtgagcctggagttggtgacggctggggacatactgtgagcctggagctgatgacagctggaaccggacggtgcactgtgagcctggagctggtgacggctggggacatactgtgagcctggagctggtggctgctggagacatactgtgagcctggagctggtgacggctggaaccagacattgcactgtgagcctgcagctggtgacagctggggacatactgtgagcctggacctggtgacggctggaaccggacggtgcactgtgaacctggagctgatgacagctggggacatactgtgagcctggagctggtgacggctggggacatacggtgagcctggagctgggactggctgggacaggctggtgctgtgtggtctggtcagtgtccccacgtggctgctgcagcgggtgcctgagtggcctttgcagtcacacacaggcagggaccgggtcccatgccctggctagccaagggcctcactctgcatttcctcatggttcttgtctctgcagccgggggctcccaggagcctcgggcccaccaaggcatcaccctccctttttactccaagcgtattagggtctcctgcccagaagtcactgtcaatgcccttaacaaaaagggctgtcagcccctccctcgggccagaggagccctggagagctaaggttcctggggctgcacaagctcagcccccagcctctggggctccatggctgggcccagctagagagtctataaatgtggaggtgacgtgctgggtctcggggggcaatgaggagcccaggctgggccccccacctgtgctccatgggaggaaagcacatggccaagggggggtttctttggaggtggctctgctcccacccatgcccccaacacgcgtaccctccaaagggacagcagagcgtcaccaccccacatccagacgagaccacaagggaccctggggcttcgggcaggggtggggtcgccccagggcccaccgtgtgtgtctgcatggaggaagctctaacacctcccaccgccaaggtctcttctgcccttaaaattccatgagcttttccttcagtgtggaagaaccaacaagttctcggggcctccatcgacctgtggggttagcacttcggtttggctttctccattaggtcaccaaggccaatgtgccccagtggctggtaacaacgtgtgccacgtgtccagtatttaccgagcgccaagcacacaggtgctgcccacaagttaccttctttaatccctactaccacctgcaggataggaatccacttttttgcagacgggcagctgaggctcggagaggttaagtgagctgctcagggctgcacaggtgctaattggcaatgctgggatttgaatccaggtctattctgaagcctatggcctttctatttgccacaaatcatctaagtattcataaacactagtgtgcctggcacctcataaatcggtgcttctcatgtttgtcttgaagacatagggtaaattttttgctgtaaatttcaaagggacattcaaattctttggtttctctagggctttgatcatcagcacgtgcttggaactgtcactcagaactctgggctgtggtggcatttagtgcactgagttttgacctgtcctgagccctacaaacctaacttgttgttttctaaaattaaggccaaaatgccagcaaagcaagcattattccacccggttacctgcccacatctgcaccagacactgccaccgagggtccactggctccgtcctctccctcgtctgtggacctgaaacaaacatcacttccaccctgggcaaggtgtggctcacacagaacatcttcatagtaggaaagctggcttcggttctcagcagtgaatattcagattccacagccatctggctgtcatttcacaagctctttgcaaaatctggctataattctaccaaggtacgaacgttagttaatctgttgaagacttagctaagtgaactaaagaaaattaaaacacttgcttaaagcttgccgcagctcagaacccaaaagggctgcggacgcataaaaggggaagtatcagaggagaaggggccaaggccgctggggaagctgagagactgcagagcaccacgcatgcgcatcacacctgcttccaattcagggagctcagaactggctagcatgaggcttgttaagtctgttcatgaagtaaactggcctagctcacttcagaaaacagcaaggctttattacaaccatgaattaacagactgccaattgatatgctaattactaacatttctatatatttgtcaaataagatccctaaggaagaagagacaatgtgactatctggcttgagttacagtctttaacaaaataaaaccatgagttttctagatttttcattaattcaaaccagccccttctttttttgttgttgttgttttgtgttttttgtttgagatggagtcttgctctgtcacccagcctggagtgcagtggtgcaatctcggctcactgcaacttccgcctcccaggttcaagcaattcccctgcctcagcctcctgagtacatgggattacaggcgcacgccaccatgcccagctaatttttttgtatttttagtagagttggggtttcaccatgttggccaggctggtctcgaacttctaacctcaggcaatccgcccacctcggcctcccaaagtgatgggattacgggcgtgagccacggtgcctggcctttttaaattgatttcctactcttactgggacataagaaagctatgcaaaattcttcagtgcatcagttatgggaaagaaggaaccaaagcgcagaagggatgtgcccagcgccatttttaaatgtagctgaagaggctgcagcagcgtccatccctctcccagcggagcaacgctcaacccaagcaagtgagctccctctctgtcaaaaactctgcaagcaattttttcctctccttctaatattaaattgtttctgagtttgtcaaatactcacaagggaagttttctacgacattgatgtgggtcaacagcaagtccatgtccctgggttctgtttgcagaggaggattcctttcccatctgtcagggcaatgctgtggaattccaaagcccactgtctacggaacagccagcccattactggacatcaaaatgcctggacttctgagctccaaagggcatcaggagatgggggagccgcagagaccacaaagccccagctctcagctcccacgtcctcaccgcaccccaaagacagggaatgtcatgcgccgggttgggtcagaataaggaaaggttagaaactcttattttcaaaatagtctagccacagttttcttaatgaatgcctttatcagatttcatttgaagaaaaggtcttctgctttaaaaaggctgctcttgttcagtccattcgcttttcaaacaacaaaactgaggcccaaagaaatgaggatgtggctgcagacagcacccccgagcacggagctcaccttagtgggttcaatacgccagacacacctgcctccaaccctccccaccccgaggctctgaaggtgggtgggaagaaggaaggcccggagggaagccgccatcagctcagccacccacaacggccgccccgccggctgttcccagcagggctgtgcccctctagtccttggatggattttgcagagccttctaggaggcctgtctgccacacacgtagctcaattcagttttgcactttgttttccttcttgtggtaactaaaaacactctggcatgtaattcaaaaacagcattgagggtaactgcataatgtaaaaaaactgttaccaagatggcagaacatttgaaattatatttgcactttgggacatacagataaaaatgtgatcttatgttaagtgctgcattttccaaaaccacgttaaatttatgtgtgaggcctcgttgaacatgtagtaagtggatgttcttaaaattggctaattccatgtcaaggtttcatcagacatttcatctaccctctaaaattagtttgtcaaaatacacacacagttgagtcaatctctttcctcacaaaaatctactgagaccggatcttgtctgggtctcggagcccaggacaaggaaaggggtcagcctcccggctaagctgcctctgcaccaggctgcccctgcccacaaggcaaccctcaagaagcagctccgcactgtgggtggactgagccactgggcattcctccctccaaagggtccaaaaaccagggcagccccaactggccgggaaagctcctctgggctctgcccctctgcacggcaccagagttgtgcaaggaagcagaggaggcggtgagtgccccacgctcaggagtgcacccggtggagggggatatgtacacccgcctgggaggggccagaacccagtccacactctgcccgcatgatctgcctctccccaaaacagactatcattacccggtgtgactgggccaatgaacccaaaaacaggaacggcaacgttgactctaaagcaagcgtatccagcccacaggccacggcccacgagatggctctgaatgtggcccaacacaaattcataaactttcttaaaacattatgagattttttggccgggtgcggtggctcatgcctgtaatcccagcactttgggaggccaaggcggatggatcacttgaggtcaggagtttgagaccagcctggccaacatagtgaaaccctgtctctaataaaaatacaaaaaaattagcctggtgtggtggcacatgcctgtaatcacagctacttgggatgctgaagcaggagaatcacttgaacctgggacgtggaggttgcagtgagccaagatcgcaccattgtactccagcctgggcaacaagaaccaaactctgtctcaaaaaaaaaaaaaattatgagatttttttgcaattttttaaagctcataagctatcactgtgtgagtgtattttacgtgtggtccaagataattcttattccagtgtaacccggggataccaaaagattgggtgcccctgctctagagtgaacacagaagcactgtctggggcacctgttgtcctggggttcaaagccgctgccaccttcttcccttgcagttttctgctaacacttacacctgcccacactggtgctcacactcacgtgatcacacccactctttcttcttgtggaaagccccacgtggagcagaggggcatctggagctcctgcccagaaatgggaaggtgatctgcatcctcccaggccccctctggaagctccaggtccttcctgactccagcccagccccacccacggcgaggaaggcacctgctcggacacacctgggagctggctctcacttccagcctcaacatccaccgggtttttctggacttagctggctttcactgattttttcttttttgctaaaaggaactagaagatataaaacctcagagcctctatccacccagtcttcatctgagaaaagcacaaataacagattctttcagtttgcctgtgtctctcaccactaagctgtaagaagctccctccaaatgagaacgtcacacatgcagggaccagtcctgtgctgcagaccgacgcagtgggaggccacatgcgttcctcagcagctgcaaatacctgtttcttattcctgttaccattttctcgtattctcaagtagaactgtccctacatttcctttccttttctgcacccttccaggatggatgtgggtcacttttccaccctgagcagccgtctgcgggcctcagggtttgcgctattctggaatatcgttggtggggctgttcacaccccgctccgtgtggctgatgaggagctgagggccactagtcttgtcttggtgaaatcacagagcaagtgaccagcacattctctgaggctctggagttgctgtcacccccagcaatcctgtccctgtttccttcaaaatttcaaatcttgccaggcccagtggctcacacctgtaatcccagcattttgggagactgaggtgggcggatcacctgaggtcaggagttcaagaccggtctggccaacacggcaaaaccctgtctctactcaaaatacaaaaattagctgggtgcggtggcacgcgcctgtagtcccagctactcaggaggctgaagcaagaggatcgcttgaacctgggagacagaggttgcagtgagccgaaattacgccactgcattccagcctgggtgtctcaaaaaaaagaaagaaagaaagaaaaattcaaatcttaattacaggactttcaaaattccaggaggtaatttacctccagcaagggctggagaccaaaaaaactgggccaacggcccacaaacacgtgagccaggtgaagggtcatgcagaaaagcaggactgggtgtgagcatgaggacaggaagggggaaggggctggacacggcctgtctcctccctgagaggaaccatcagggagcctcggtatcagcatcacactcctggtgacagggacagagacggctccttccactggatgtacagagcgcttccagcagcttgagcttcacgcctgcccggagacggggtccgcgaggtgccagctttgcactgtcaaagggaatccctcccaggggaggacggactgagctctcagagtcctttgggcaccacagcccggaatggtgctggaatcacagccgccgggttaaggggctcatggcggaggcaagccccagtgtcccaggcgccatgatgtctaagtgactatagggccatgaagaaggggcctcctgataatccctaccagcagccaggaagcaccctgggaagcccatcgcctgttgccctcccaggccacaccttgacgtgggaggccacgggacagacgccacctctcccgagtagcaggtgggtgactacagaggtgctctgagggtcttaggcagagctggccatgcttgccttggtgaagaccccagccaccagcctgggaggcccggtcaccccacggccagcgcctgccaagttcttgtgagttgagcacgtctcacgtatgcaccaacatgcagatgcacacacagggcatgggcactccagaggggctcagcttatggttaacgctggggctgccttcatctcacgcatgctgggcagcctgggcacctggggcagggctgggggacagcccagccatcttcagggccccaggtgaggccacagccagcccatgcagagctcagagctcacggcagagcggcacagaaagaagctcagacccaggccctcctgccaggcaaggcccccggactcactcaccccacaccaccgatgtcaggggttctgtgcaggcaaagtggccttctctttgtattgattttgggggctttgttttttttaactaaacttttttttaactgtggtaagatgcacataacataaataaaatttactatcttatcagttttaatatacaattctgtggcattcattacattcactactatacaaccaccactgccatctgtctctcaaactcctttcattttgcaaaattgaacttcattccctgtaaatgctgactccccagcccctggcacccccaatcctatgctgactccccagcccctggcacccccaatcctacgttgactccccagcccccggcaacaccaatcctactttctgtcgctgactctgacaacactaggggctgctataagtaggatctcacagtgcttgtccttccgtgtctggcttattccattccatataatgttctcaaggcgcacccatgctgtcgcagaggtcagggctctttgcgtctatttttaaataaaacaccagctctggcttcaagggaaaggggcctgttggaggacggaagaggcagggaccctgctggtggagactggagccctgggaggcactcctgggtcttccagtgggtccagcagaggctgattcatgctagaaacaagggactttccatgcagggtccaggaatgcctcatcagccccccaccgtaccccctgtccacctggcctttgaggctgaaacactgcactcaagagcactactctgtcccaatatcaaggcaacgcttctcaaggacatgggctggcccgagtatcagtttgcagcaaaaactgtgaagattaatcaaaagccacctcccccagggaagctgtgactcccaggcacgaccttgcccatgggggtcacccactccgacccacaggggtggccgaggacctggatcccggggctgtgccatccctgcctccaggccagacatccagcaggtttcccaggaatctgcacacaagatgcagcaccctcggctcagactcaaagcggccagcaggagcaggcgacatccactctgcattgtccatgctctcctcatgtggatgaggagcaggaccagcactggaggagatcaggatcctgtcacaatgtaaggtcatctgtgcctagtggatcagacgctgtgaagaggagtgtgtgcaaacctcactgctctgaacggccctgatccaagagcagccggccccgattgtctttggttaccaggaaatgttagcagatgcagtccatgcactgccaccgaggtcactggtgttccttttctctttcaaggcattggtcaaactgagtgccttccagcatcttccccagagagcaccacccacaagggtgcacatgggctctgccatgctcccgttcctacctgccactccaccgagctccgcccgctcttggtgacccctcagcgatgaccagggggctcttcctacaccaaagcctctggctgcaagcacatttcttcatgactttctctttcttaaaaatgagtgtaaattttgcactcttctttgtaacatatgcctgtgtgccttttatgataaaggtgttttcttccttttcatcagatacactggatgctccaagaacaacacgggttctccgtgtgacttcacactcccccagcatgactctaagcccagtgtgggaccagcgtgaacccaggcggcctctagaggggaggcaggagccgccctgaccaccaaagccagcgcaggagggggctctacaggatgatgtgttgagtgggcacaactccacaaaggagaggaaccgcagtccgtgccaacagcctttcccaggaaagaccttccgggacctgccacccatctcctccttggcaagaccaccccagcccaggcacggccaacgcccggcccccgcttgagttggccttgagctccctccaaagaggagatgcagacagcagtgccaccccaggggggccgagggagcaggactgagaagctggttttccacaggttcttgtcatccaaggcgagcacaagcgggaaagaatggggctggaatgttgggagagaagggagtgtgtgatcagcattgtctgcataaatgattcaggctttttttaatgaaagaatcttatttttgaaactgaagttgacataaaagctcccgaagtgaatcagacggtggtggcttctccccaccatccactcggcaggggacagggtctccacggggagctggtcaccccacgtggacgccgtgccctgcctcctctggcgagctttgtgttcaccgggcggattctggcagacaccggtcccccagttgttgcagcgagactcagacccaacccctgaaccccagggatggcgcctcactgagtccattggatccgcgaagggcaaaggggcagccgtgaataggtaaaattcccgtaagctacggaggttctgctggctttgtcttctcctttgcaaaagcaaagtcctgcggaggctgggcttcgcctgagcgctcgctagggtggaggaagcagctgtgggcctgcagccagggctcgctccaaacgctggaagctccgcctcccagaggagatcagcccaggagtgggagtgaagaacttcgctccatcacaaagctctgaaatacagatggcttcggaaaaccccgtgagaacaccgattcactcctcctgtgagatgggactgcgtgtccccagagggctggcaactggcctccaagttttcctcttcctctttcttcctcccaagagcccaattaagaacttccagagtttagaaatgacttgggttgattatgtgtgcatgacgtgacctcactagacccagcacgaaagggaagcaggcctgggagccctcccccttgccctcgtcctggggtctgtgccgcgcctcgccgtcctcccctggaactcggggctgggagaggtcggcgtcaggaaggacctcatggggctttcacacgagagcacacatcctcagagccccccagcctcgttctgaaaatgaaagacggagatagcctgtgctctgagggctgcgcaccaggcgtcggggtggagattgactcctcgagctcctcggagccccagcgggtgccactgcccgccggctgagcccacgtcccgataggaagcctggggcgctcgcaggaagggtcacggatgctgcccggctccccaccagcctgcccctcaggacatctcctgaggctgccactgggaaagaacaaacttgggaatccaagatggagggcagcaggacgctcccacatcccccactggtcacttttggaagccatgcactcggccccagggcactaggcctgagtgctttaacacccagttcaggtgcctcccctaagacagggctgaggtctgggcagggagaggggcttgcaggcccacaggcccactcatggctggcgtggccacccacggagtctaactgcaatgactgagaacacaggcctgcccgaggctccccgggactcagccaaaggctcccagacgcctcccaggtggtttgacttttgcatctctgggaattctttcagcctcttcgtttattcattttacttcccctttacttgaggtggctttgttttcttttcaatgtctaatctatttctctcataggcgtcgttaatgggctgggacctgacttcctactaagtgtaattacctcgtctttaagtgcccttttcagtttttaaatcctgctgctgaaatccaacactggggagatgtcgtgaagcttttttaactccatcaggcggccgtcgcgcttcccttcacgctttccttcacccctccacggacatctggccctcatcccatccatgagtgacccacacagcacatttccagaactggcatttgtgacaggacacagcagcaaggaggcctgtccaccagcagcgaccgtgagcacggggcccttggagaaggagggaggcatccgcaccagctgctgtggcagaacaccagggcagggcagctgcaacaaccgacactcgctttgcacagctctgagactggaggtccaagatcagggtgctggcacagctgggctctggtgagggccctattcccactgcggatggtcactgccttgctgtgtcctcccatggtgggaaggaggagggcagccggctccctcatgatgctgtctcatggtcttgcctcagagccactctcgtgacctcacccaaccctaatcacctctggaaggccccgcctcctaacccatcccatcagggtggggctctaacacatgcatttgggggccccagctcctaacccatcccatcaggggtggggttctcatgcatgcacttggggggccctgcctaacccattgcatctggagtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaatccattacattgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccatcacatcaggggtagggttctaatgcatgcatttggggggccctgcctcctaacccattgcatcaaggtgggtctctaatgcatgcatttgagcccccgccaccgcctcctaaccacaccccattggggtggggctccagtacatgcatttggggggccccagctcctaagtcagcctgagaagatcagtgagaaaggtgaccatacattctggcaatacatactgttttttaaaaaataatttttctctagagactaggtcttactctgtagcctaggctggagtgcgggctggagtgtaggctggagtgcactgatgcaatctcagctcactacaatctcttcctctctggttcaagcgatttttctgcctcagcctcctgagctaggattacaggcacccaccaccatgccctgctaatttttctattattggtagagatggggtttcaccatgttggccaggctggtctcaaactcctgacctcaagcaatctgcccacctcagcctcccaaagttctgggattacaggtgtgagacaccgtgcatggcccgatactttcataatcaaaaaagtgtctacatacactgacaacaaccagtaaagaccacacgttttgtgcacttgacatgtgcatccaagggctcctgacaccccagagaaaccctagagagtggacactatcctccgtgtctacacactcaggcttaggagtctgcaccagcctccctgtctacacaaacaggcttgggaatctacatcatctttcccatgtacacacacaggcttgagagtctacaccacccttcctgtctacacctgcaggtttgggagcctaggctaccttccctgtatatttccacagacttgggagtctacactaccttcctgcgtacacacacatgcttgggagtctacaccaccttccccatgtacacacacaggcttgggagtctataccacccttcctgtctacacacatacaggcttgggagtctacactaccttcccctatacatgaataggctttggagtctacaccacattccccatgcatatacacaggcttgggagtctacaccacactccctaagcacacaaaggcttgggagtctataccacactccctgtctacacctgtaggcttgggagtctacacgaccttccctgtgtatatgcacaggcttaggagtctacaccagcctccccttatacacacacaggcttgggagtctagaccaccctccttgtctacacacacacacaggcttgggagtctacaccacctttcctgtctacaccaccttaactgtgtacagacacaggcttgggggtctacatcgccttccctgtctacacatgcacaggcttgggaatttataccaccctccttgtctacacacagaggcttaggagtctacaccaccttccctgtctaaatacgcacaggcttaggagtctatatcacccttcctgtctacacgcagacaggcctgggagtctacgccaccttccctgtctaaatatgcagacttgggagtctataacacccttcctgtctatacacaggcttgggagtctacaccacccttcctgcatttgggggatcccagctcctaacacattgcatcgggggggctctaacacatgcatttggagggctccagctcctaacccagtgtacacaacttccccatgtacacacataggcttaggagtctacaccaccctccctgtctaaacacacacaggcttgggagtctataccacatttcctcatagacttgggggtctacaccaattttgctgtgtaaaggcacaggtttgggagtctacattgccttccctgtctacacacacacaggcttgggagtctacagaaccttccttatataccccatctcttctaaaaatacaaaaaattagccggatgtggtggcatgtgcctgtagtcccagctactcaggaggctgaggcatgagaattgcttgaacctgggaggcggagttgtagtgagctgagatcgcgccactgcactccagcctgggcgaaagagtgagactccgtctcaaacaacaacaacaagaaaaacagagaccgaaaccagagagggtccttgtgcaactttgttttctgtccttggtcctgaaaccaggagacaattggttggttgtttagggcactgatgattctttaccagtatggtaaagagggtaattgctctgggaggtgaaaagtgcgtaagaattttgatcagtatctgtctatctgccatctatcatctgtctcatattgctttatctgtgttctctctctctctctctcccattatttattttctgagggtagagccttgaatactgggttttaaagttcttgattgctctcagcttgttctgggcacagaggatttaaggaatatttgagatttgaacaaaactgaaaaaagaccaactctgctagtcgcggctctggcccccctttttggtggagggggagtgggatgtggggttcttcggcccatgcctgctgctggccaggcccttccaagacgcagtggcctgggactataggatgtggctcccccgatccagcgcaggagcacagcccctccatgggctgtgtctggaatgccgcacatagccatctctgccccaaacagcagccccctctatatgatggggttttcgctcctgccagcagcacagacagccgcctcacctccccagcatcctcccagggaggctgagcccatcctcacccacgacccggggacacgtttaatttatccggcccctcctcgactaccaactcccctcaccggagatgcctgcctgggccctgaattctgaggctgcccacagcaagcctgatacagagtcacacaccagatgcacattacaaagagcgtcacagtggaatgagaggaaagcctgtgagaacaaacggatctccggtgctcagcagactgatctactgcaaatcacccccgacgcaaccaccaactccgccagaggaaatcacaagttttccatcttcagcagctcttacgactgcaagatcccacagctgccttttgggggaggttggggcttatgccttagggcgccagtcaggtccttccaggagaaggcggcaccaagcccagcgtcgaacgaagcaggtccttctcccttcacaagcagcatccacggctcagtggtgcccctcgcccccaccgctctgccctgccttcctcgctgaaacctcccaacactgacgtcaccggggtggggcaggagcaggaagaggcccatgctgccatgtcccatcccaacacaggggcagtcctgctgccctttcgttctctcccattgtgcccttggcagaagaatatatttccactcaactggcatcttccagctgtcccccagacccagcctccctcagctcccatggcagggttaggggcacaagcaccgcccgtcaacccttcacagaagctggcaacagagtcaggaatctgaagggtaaagggagctcttccgccaacaggtggccggtgttgcttcccagcgggttccacccactgcctagcaggccatctacatggggcagaccacagagacaggctccagcaagctcaggatgatgaagacacatcctatcttcgaggacccagctcgcagagaacaaaatctgtgaacaataatcacaacatggcacacacaacacacgtcccaaaataaatcttcactaggtacagagttggcaccaaatggctttctcctacaaaatcaaaacagccttggaatgtccttctttactagatcaacagatggttgtcatagatagatagatagatacctaataggatagactagatgacagatatagatgattgataaatagctgatagacattgttagatgtgaaagactatgttctattgatagatgatgatagataatgatagaggatagatatagatgggtgattgataggtggatatagatgatggataggtagacgattgacaggtaaagatagattagatagatagatagagatgattgatacgtaaagacagattagatgggctgggcatggtggcttacacctgtaatcccagcattttgggaggccgaggcgggcagatcacctgaggtcaagagttcaagaccagtctgggcaacatagtgaaactacgtctctactaaaaatacaaaaattagccgggcatggtggcgcatgcctgtaatcccagctactcaggaggctgaggcaggagaatcacttgaactgggaggcggaagttgcagtgagccgagaccacaccactgcactccagcctgggcgacagagcaaaactctgtttcaaaaaaaaaaaaaaagatagattagaaagataagttatataaatagatgtttgataggtgaatggagatgattcaaaggtagataggtagaggatagacagaacaaaacctggtctcctcccctcagagaacactgcagctcccgcgcaggtcagacggctcccgggcaggtcaggcggctcccgggcaggtcaggcggctcccgagcaggttgctcccacgcaggtcgctcccacgcaggtcaggcggctcccgcgcaggtcgctcccacgcaggtcaggcagctcccgcgcaggtcagacagctcccgggcaggtcaggcggctcccgtgaaggtcagggggctcccgtgcaggtcgctcccacgcaggtcaggcggctcccgcgcaggtcactcccacgcaggtcaggtggctcccgcacaggtcaggcggctcccacgcaggtcgctcccacgcaggtcgctcccacgcaggtcagagggctcccgcgcaggtcactcccaggcaggtggctcccgcgcaggtcaggcggctcctgtgcaggtcgctcctgggcaggtcgctcccgcgcagggcaggcggctcccgggcagggcaggcggctcccacgcaggtcaggcggctcccgcgcaggtcaggcggctcccacgcaggtcgctcccacgcaggtcagagggctcccgtgcaggtcactcccaggcaggtggctcccgcgcaggtcaggcggctcctgtgcaggtcgctcctgggcaggtcgctcccgcgcagggcaggcggctcccgcgcaggtcagacggctcccacgcaggtcaggcggctcccacgcagtttaggcagctcccgcgcaggtcaggcagctcccgtgcaggttagacatcttttctgccatcatgggctctgattccccaacctggtgccatggtccactcagtcgcttcttggccctgcaggtacaagccagccagtccacaaaggtcacggccgccgctccgctcaacccgtggctggctgtgctcgggtgtgtttcctcacctctctctctgaagagctgagaacaggcccctcctggcctacgctttctcatcatgtagctgtatttctgggctcacacctttagaacccactgagatttctaaagctcctcctctagtgagcaacctgggatgtttgtgctcaaagaaaacagcgtttccagagcaccatggcgcctagaagtgggctggccaatgtggtcaggaaggaagggtgacttgggaccctcacactgactgtgcatggaaacccccgtggtccactctcctagtgaggcacctcgccctcttcccagcattcccagcagcactattgataaagctctcctggtaaggcacctcgccatcttcccagcagtagctattggttaacttcatagacccccttttaaataattctttgtatttttgtttttagagacagggtctcactctgttgcccaggctggagtgcagtggtatcatcattactcactgcagccttgaacttctgggcttgggggatcctcctgcctcagcctcccaaggagctgagaccacaggcaagagccaccacaccccactaaatttttcattgttctggagagacggggtcttgctatgttgcccagcctggtcttgaactcctggcctcaagcaatcctcccacctcagcctcccaaagtgctgggattacaggcctgagccactgcacccaggtcttttaaaataattcttacataacaggtaacttcagtccagacacaaatactaaattagtagactccaaatgtattgttggattgtctctagcctatggccatgttctcttctttagatcctgaggccgcagggtgcagctttccatttgtaaactgtccctggggtgctgccccagggggtgctgagcagtgaacactgcccagctaccagttggtcccagggacatgaaggcctggcacctgcagagcccagcggaggcagggtacctccagccaatatttccaggcacctagaggcaggtgtgtcctcacaaatggagcctgtgaaaaaacaggtgcagcaatgagggacccaaaggtgagcagggaaagagtctccataatttggcacagagaggagcaggattctcctcagtattcacgccaagccaggcaggtccttgcaccttctggatacatcagtgctagactaaaaaaaaaaaaaaaaaaaaaaaagcagtaatctggagtccttcctctggggtgccactcagcttctctggacaggaggctctcagactgcacaccaagagatgaggcccagaagacagagacctctcacctcttaacacctccccaggtctgaccaggggttaattatgactgtatgtcatgtttccaatgaggaggagctggatccccgaggtctgcaggcagcagggaggggccacactggggggtccagaggcccaggaagactctcaaacccagacccagtgaggccctgcctggccccagatcccgacagagcagaggccacaaagtgatggttctcccggagcccccagcaggaattcttccagtgcttggaggagattcttctctcatgttttctttgttcttcatcaccccatttaaaaaggaataataagaaaaatattttgtataaaaatgaatttctattgctctcattacacaatgttttcttaaagagaagcaaaaaagaagaaaataaaatgcattcaccacatcctactcatacttctcaacactgtaatattttaacgatccatatgaggtcataccatatgtacttttttgatacctgactttttctttctcagaatgacacacttccatctttccaggccaatacccagcctggcaggactccaccatgaggcacatccacttgttcacctgcctccctcttaccgaatattcgttcccaatgcaaataacgactgtcccatcgcagggtgcagaggagataggctgttcactcagcctgagcagttcctctttctgagatgtgaccacaggaggtgaccgcggggatacctcacccagccagcttttcagggccccctctgaggctgcaatcacccctgcatcaccttttggccccttccctgccactccctctcacagaagtgatgtcagtaaagaatggacacaggctgcctccctcatgactggggtccttggtcccagggaccctggaaggcctggagcaaagaaggtcatctgagaggtgaggcgatgtcaaagaacaaaatcctcccagctgttgtctccccacttacatatttttttattgtggtaaaaatagaataaaatgtaccatcttaatcatttctaaatcttcagttcactagtgttaactatgcacattgttctccaacagatccccagaattttctcaccttcccaaactgaaactctgtcccgattaaacactgactcccctttcccctgctccgttccactttctgttcctgtgaacttgatgattctaaccacctcgtatcaaacagcatttgtccttttaggaccggcttctttcactcagcataatgtattcaaaggccacccatggtgtagcacgctgaagactgggtaataagtccaccgtgtggatggatggaccacatcttgcttaccactcatccgtcagtggacacttgggtggcttctaaccttcggttattgtgaatagtgctgctatgagcatggatgtgccaatatctgtccaggtccctacttctgatggtttcaggtatgtatgtacccagaagtgggcgtgttttaacgcttacctcatatagtttctgatcatgtgcacgaacacttagagtaataggcaaatgttttggcctcgctaggggacaaatggggggtttgcttattttacatgaattgctggactgctaggtgaaagtggaactgatattctttgagaccctactaagtgtcaacatgcagagaacacaacgtgtaagaacggtgaccacttgcgctccgcgcgcaggactgtgctgggaccgtgtggcggttcctcactgtgtccccaggcagtctcacaaggcaggtgtggccatcgcctcaccttcagcagaaacccaccatgagcaggggcacatgggcggcacttttcatgaagccctttgagaacagacatcaaccatgtgaatgttactccttaagttagagccaaagatatttggtttgccaaaaacacatgactagaacactgcatcttgaacagctttaaaagaaggcagctgtcctaacctgcatcctcccagcagggtacaggttaaaaaacctaaagcaacgcagccttgcatcgaagagaaatcttgtccatatgttgttccttcacgtgtgactgggcatcggttgattaatctgatttttgtagtccatgcatgtcaataaggcccattcacatgtcagaatgtgcacagggttattctgttagtgtggcaagaagggcagggcctgggaatcgggagccctgtttctaattttagtgaagtcttccacccttgatcttgatgaatacttgatcaagtcaataaatatcaaagattaagaaagattacgtagatcgggacattagattacttaattctcatagttccttgaagtcagaatttccaatgattctagaagtaataaccccagtaattctcattactacttcaaggtatttttgaaaattacaattctgtaacacccgttgccttagaagtctccccaggtctaagagataaacccctgcctgagaaaatccccctgacagctcttcgggggtgtggggctccttctgtaaagaggaaaatgccgcttctgcaggacatgggtgaccttgagcaactgcatgttttctcaccaaatacaaggaattttttaaagaaaagaccaaatggtgttacacaccagaaggtttgggtgatatttcaattttttttattttaaagcaagtataaactttttctgataattcattggcttctgcactgactcagaccttgatgctctaattgtggcctcaagactggcagctttggcctccccagggctggtcagaaatgcagaatattgggtctaacatacctcagaaaatgcactttgacatttaacaatcctgaatgactcaaaagcatagcacaggtctgtgcacagtccctgtgcaagacaagacacttccgacaggggagatggcccgggccaacaccaggaccaaactctcactaggggggaccgtgccaccccccacagtagcagcagctctccctacctcccatccccactgcccgtggccctggaacaccacaatttgggtgaagcattgcagcccagcaagcgtggtccccaagaagaggaacactgagaggaagctcactgagggctgagacactgagctgcagacctgcctctctctcgtgcgaagagattcacaaaggggccaatgaacacatgtcttttgagatctcatgacctccaagagaagtctctctgtcaggaaatgtcttagctggaactgtaacagaatgccacaggtcgggtggcctggaaacaacagaccttgatttctcacagctctgaaggctgtgaagtcggagagcagggcaccaggagactcggcatcccaaggtcctgcttcctggatcatagatgacgccttctcgccatggtctcactccatgaagggggcgaggaagctctctggagctgccttattagtgactgatgagctcgaatcccatcaggagcatccacctttgagaccttgtcacctcccaaagcccccatctcctaacaccagcatgtcaggagctaggtttcaacacatgcacttgcggggacaaacacccagaccagaacaggaagagggcaaatagccttactcctccatctgccctttacatgaaaaatataatcgtggaatcaactgcggcaacagcagcagaggaaatgcaaatcaatgcagcgaaacccagggcctgtcagcattaagacacccattccacctcccacaaacaaacccagtgttatgttaaagtttcctattattaatagtccatttagcacttgaaagccacaaggctgattgtgcatgaagccctgtgtgcttgcttgggagcctgaaggagagtgtgttgagtgataatggcgtgaaggcaaagctcttggaagaccgctggcctgaatcatacgtgaagccttgccacgtcaggatcaatgacgctcccaggggcacatacctcaacagaatgggacacagctcaacaatcccatgtatggacaatgtgaattaactaaacaacaaagccttcatcatgctgagtgcaggccctttaaagaccagaatgtgtccccatccgttccagcattagtgcatggcagaggccgagagcggagtgtttcccacagcaaatgtttcctggcccaggaaaacctacattgagggggcagggtgtggtcctcctggtttcagagaaatcaaccacggccacagcctcgtccacatagagcctctcgaagccttgcacggacaaagaaggtatctgctggtgcagtgccaccgaagaagagaggtcctacctgaaacctcacagggaaatttgtgccttctcccaaggcaggaccacaagtttgcagctcgagaccttgtccagggtcctaaaatggcttcttggaaaatatgaaattgctgaccgatccccagcatcaacttcgccaatagccttgtgcttctcgttcaaagcaagaagtacccaagtggaacgcagatacggcacgtcagtgagaacaaaagcatcacaaaatgcaagtcttattactgcagcagtttgcaagttggccgtgatgtctcataatatgaagtttgggtgaggcggtgccaaaacccagctggtgcaagctaaaaaaatgaccaagatataaggccgtggaaatgcaacttgattacaacaaacacttagtggagctaatcacacagcattcagatgctcccagcccaccccgatgggagtgttggatgaagaatcctgcagctctcgccggggacatctgaacatccttgttagctcagggcacaccctctgcagagactcacaggcatgtggcgtggcagtacatgagcactgatgtgtgaggggagaagagaggggccttccatctaggggcacagtctccctcccttccccttatccctcagattgtgaagaaacaagtgaggtctttgattagatgcctattttttagggaatggtcttttctgtttataggatctatgcatagcatatatttctaagattggggtcattccttacacctggatttgttctccagtaagtggttagaacttgggctctgatgccacagtgcctgggatgtctacgaaacacacatcatgacagctcctgcatcagggggctgctgggatgattaaacaaaattatacaaagatgatacaaagaaagggctagggcagcacttgcggggggcacagccagctctggatctgagttaactgttgccatacgtcttgttaatcacaggtctagggactgtcccgtacctccacacaaagacctacctcattctttccaacagctgcaggatattctgtggtgtgaatatgatatatttaactaacctcttgcttatgaaaaatcaagttgtttcaaatgagtattatgacaaaaaaaaaggcagcaatgaacacgcttatgcaaacatctttgcacatgtgtgcaagtaagtttgtaaggaaaattcctagaagtgggatttgggggtaatagaattgtacattttgtgatggatacagccaatcgacctgtgagcagctgagctgactcccacctccatcaccaggacgtgaggctgccaggcaccacccccatcaccaacaccagcaaggccagctgtgcggctgccatcccagtgctcctgaagcatggaaccaacacgaagcagcacggggctaggcagttgccagggagccaggagacgggtgcatgccaggccctggccccagcccccaagccccctgcccacccttcatgccccaggaatacctggcttgactcctcaccttccactgcaccctccagctccatctagaccctttccctcagcatggcagcttcacccacacatgtttatttaaagcacaggcaaagaatgccagtggtaaggccagagggcgggcagctcagcacggcagaccacagatcccttctcagcccaggaaatggctctgtggcccatatcagccaggaaaatgaagggtcacagacgccctgctgggagctaaagagaaatgtgtgcaaatctaaggagaaatgtgcaaggctcgtgccttccctgtggtgtgtgcctgctctttaatgagagttgcattctcctgagggagaccctgcgcaggccctgccccacgtaacggctttacacaaactctaaaaagtcatcccagccatgcatggacccagggatgctgacaccattcagaaaattgtattgtggaggaaggcaaggatgaaacaaacaaggcatggaggcttctgctctataaaactatgaggttcccaggaacatgacacagtccgtgctacatcagatctgagtatcaggatccagccgtatttgacttttagagctgcaatctatacaggcatatttgtggctacataaacatagattatcagaatggaactaaatatgcagcttttaaatacaaccacaccaaagggaactttgcaaattaccgggaactttgcaaattcccaggaactttgcaaattacctctcatcctgagaggtgagacagagccagctctgggctgtggctggtcatctcaaccccaggtgccacaggccatctggacaccacctctgctgagcacaaaggtggacgtgtccccaaaatagcagctttgctcagaattccaaacagggcctcagctcaatggtgagaaatcttaactcggacggcaaacttcccgtctgggatctgcaggcttcaacaactgtcaaagcacgggaaaatccccaggaagaaagtaagcaaaggcacggtagacgccaagggtccaggagtcgccctctgttacttcatgactccaacttactttctacacacaagacatagaaaccatctcatgcaagccccccaggaaccctggaggcaggcactgttcccgtagttacccgcacgtctagagactgtcccacatctccaaacacagatctgcctattgtctctgccagatgcaggatattctgatgaggaaaccgaggcatggagcttcttaggaactttccacaggtcacctgacactaagcccacaacactgtcctctaaatatttaggacacctatattttcctttgtgtcagccatttctctccctttaaaaatctctccctgagattatggataattttgataactttgagaatcaataaaattactctttttatccactgacatcagaagtggccaagcttggccgggcgcagtggctaacacctataatcccagcactttgggaggccaaggtgggtggatcacctgaggttaggagttcaagaccagcctcaccaacatggtgaagccctgtctttactaaaaatacaaaaaattaactgggcgtggtggcgggcacctgttatcccaggcactcaggagactgaggcaggagaattgcttgaacccaggaggaggaaattgcagtgagccaagatcgcaccattgcactccagcctgggtgacaagagcaaaactgtctcaaaaaaaaaaaaagaagtggccaagctttagctcctgagcaattccagaagagactcagccatcgagctgactgtagcctcccgaggacaagctttgggaaacaggccccatagcgggcacttggcagccccgggccaggcatcctgccacaagcaccgcacaaaaggtactctgcaggtgactgggcatttaaaggactagggagccctggacacttgaaactgaagtcctttctcaatttctgaattccctcctctaaaggtctccatcctggatcttgttagagatgctatttttgctgttggccacccttcgcggggtttggtaataaaagattgttaaagtggggttttttttgttttgttttgttttgtttgtttgagacagagtctcactctgtcacccaggctggagtgcagtggcacaatctctgctcactgcaacctctacctcctgagttcaagcaactctcctgcctcaatgtcccaagtagctgggattatagggagccgctaccacaccaagcaaatttttgtatttttagtagagatggtttcaccatattggccaggctggtctcaaactcctgacctcaagtgatccacccacctcagcctcccaaagtgctgagattataggcatgagccaccatgcccaaccaaaagattgttaaagtttaaaaaataaataaataaaagtctccaaaggagaaaggatttttcattttcttcttcattttttctgaaggggaggaaggtaaggagaacagctccctgtgcttctaatttaagtatctacattttcacaagtccccattaacatagccaatccttaacaaaggctagaatgtgggactgatcaaacattagagaaagccccattgccctcacgggccacctgcctggcacacacctgtgtgcacttcccacatatttatggtgtttatcccagcgtttgctgggctggagaactggccattctgtcactgtgacaaacaggcctgacgaggccagccgtgcctgcgattgcattttccactctccaaacagaatctattagacatgatgcaagcagagattatttttaggaaggcttttcattacagtgatgtgaaatgtcaaggctgagactcagcaggctctatgcagacctccggctcccactcattaagttcctgccacgtgctacgcccaggctgggccctggacaacacaagtaggtccccaattaacagccaagttaattaactgattggaaacacaggggaaagctgtcttgggcggggacatggccctcgaggagcaagcggactgaaggggtacgggcatcgtgccgaaaggggtagagacagcatggtcagggactctgcaaggggagagaacatcaagcccagtgaacactgggggctgcacccccccacacctgatgaggggcagagaaaaccaaatggtgaacccccatctcacctcatcccacccttccttgctgcccaggtgtgcaagatggggcacgggccatcccaactccaagtctggcctggacacagaaatgaccaacgtgctaacgacagtcagaagctgatgagactcttatctttcctttattaaaaactcttttgcccaggtgcagtggctcacatctgtaatcccaacactttgggaggctgatgcaggcagatcacttgaggtcacaagttcgagaccagcctggccaacatggtgaaacctcgtatctactaaaaatataaaaattagctgggtgtggtggtacatgcctgtagttccagctacttgggaggctgaggcaggagaatcgcttgagccctggaggcaaaggttgcagtgagccaagatcacaccactgcactccagcctgggcaagagtgagactctgtctaataataataataatgttttaaattttatacctgcaaacagtatctagctcaacttcctcatttcaagaatggggaaactgagatgcagagaaaggagatgaaccgcccaagctcacacacaatatagcgaagccaaacttttatatgtcactcccagaggcggtaggaacatcacatgcttccttttggagaccttggtttggagaagaaaaaaaaaaaacagcttttagagtagattttctttttttgaactactgaggaaatctgcaggaaaagagggtcttcaaatactggggtaaatcatatgactgacttgtattacacaaagctgagatttataacaaatactctaaacaactactcctggagcaaacagctttcacctatcacactttacagaaatattctttaaaatagtggtttctatttttttctatctttttaatttcacagactaataatcttttttaacaaactggggtaacctacatgtaaagttgccaaatctttatgtgtgtaactaaaaatgtttaaataaaaaaaaaaactttcctatcacacttcttttaaaaattactaacattaaaaaatattcctccaggcacaggattacacctgtaatcccaacacttcaggaggctaaggtgggaggaacactttagcccaggagtttgaggacagtctggtcaacatagtgagaccccatctctacaaaaaatacaaaaattaagcaggtgtgagggattaggcctgtggtccccgctcctggggaggctgagacaggagaatcactggagcccaaggcatgggaggctacagtgagctgtgactatttggctgcactccagcctgggcgacagagcaagaatgtgtttcaaaacacatataactaactgtacatgtatgtatgtgaaatctcaggaatttaggtattttaaggggaatacatctgacaataggaatgcagcgtttccacgggttgactggcgctggccgtgccctggaggctcctggcccagggaggccccgtgtccctgagcgaacgcaccggctttgggttgtaaaccagggagtttggacttaattcccagaactcaatcaccactgagcgacctcgaaaaagatcacgtgggcctcacaggacgagggccagacccagatgcgcccgcttgggcggacgagactccctgacaccctccccgggacgtcacagcggaggaaggctaggagctcgcgcacgccaggctgtggggccgaggggtccggctctcagggtcctgctctcagggtcctgctgggcccctcaccaggaagaggggacacggaggcagcagctcccagcggcctcgagggcgccactgacaggagcgcggggcacaaggctgcccaacaagaacgcggggcgcgaggccgcctaactgacaggaacgcggggcgcgaggccgcctgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgacaggaactcggggcgcgaggccgcctgacaggagcgcggggcggcgccctcccggcctccctcagccccgcgccctggccagcgggtgccgctcgcagacgggggagcccagagcccacgcgccaaggccgccaggcctttcctccctcgcgttccctcaggcgcgtcctccacccgtttcccccaggcagggggaagccccgagaagccgccgcgccgggctgagatcgggccccaggctctccgcggagccgtctccaacccctgcaggccgacctgggcagccaggcggggagcgcgcagccacagcccgcgtttccgggctccgtgtccttctggaggccgctccttggccatgggccctcggtcctcgccctgagcagcgcgccggggtataagggacgccctcagaggcctccaccccacactccaccgcgctctgccaaccgggacaaggtgttttgctgaataaataaattaatacataataaaggctgcgtccaaccagatgaggacagaaccgagcgccctccagcaccctctcccaccatccatcctcacagacggactctgcaccgtgagaaagcggcttcggcagctccgacccctcaactgacgcgtctccccgtggtgggtcccgatcccccggccggctctgccactgaagcctctccctgtgtcctccgtgccccccgagtggcctgctagcccgctctcccacacagtctccttgatgtgaagtgtcacccggcttgctgcggcgtgtctccgccgtaacacgtgtataccggctcagcacgcggctgggtacggtttgcaacgccgagagcccgcggagaagcttgagcctgtgagcccccgtctccgaccacggactcaccgggaagcaccaaggagaaccgcctcctcaggaaccctgtggagctcatggcttttgtgactgagactaaaagcatccataaaagcccgacattgtggaaagacacaaacgtgcatggacctggttacctctggccttcctctgctcagaagcccacccctgcagagcaaagcccgggtcccggatggcaaagccatacgcaggagccttcccagcagccgccgccatggctgacgcactggcaggagccgcaccggacactccacctagtccctcttcaggttttaatccattctgttttatttcatttgattttatttcattttatttccaagccctgtggcaaggcttggaatattttttgtttttgtttttgcttatttttttttaattatgccgtgtgttggcacacttcatgaaaagcacctatttctggccaggcacagtggctcacgcctgtaatcccagcactttgggaggccgaggtgggtggatcacctgaggtcaggagtttgagaccagtctgatgaaaccccatctctacttaaaaaatacaaaaattagccaagcatggtagtgggcgcctgtaatcccagctacttgggacgctgaggcaggagaatcacttgaacatgggaggcagaggttgcagtgagctgagattgcaccactgcactccagcctgggtaatagagtgagactccaactcaaaaaaaacaaaaacaaaaaaaaacaaaaaaaaacacacacctatttctttttttttttttttttttttcttttgagcaggagtgaaagtattaaaaagctttagagcaggaatgaaaggaaggaaagtacacttggaagagggtcaagcaggggacttgagggatcaaatgcgtggtttgaccttttgacttggggttttatatgttggcatacttctggggtcttgcgttacttctcccctgattcttcaaaaagcacctatttcttaaggatccaaaaaaataaaaaccaatttcattgctgctgtttccatttcttggcaaaaattaggaaacacaactaaataaatatccacggaataaaatggtgcatttattcaccaaagtcttatcacacgtggagatgaataagaacttcccgagccaagaacagtatatacaacatggaaaattctctagagttattaagtgaattaacctcatgaaattctactataagataagcactaggaatgcactggaaagagaaaggtgctagtgagcttctggaagcacagaaggttctgaaaggcagggaaggttctagaaggcagaaaaggttcaggagcttctggaaagcagggaaggttctggagggcagggactctgtcttgctcgtgtttgcaagtccaatgactagcacatagtaggtattcagtacaatgttctgaaaagaggtttctctgtctggctgtctagttgggtggaaaactgatcctcttcgttcacagtgagatagaggaacctgaaaaggataaacatatgaattcccctcaaaatgttgttttgtttggtactgggtagtgatgtgaacaactgtggggttaacttaaggctctagttatgctacctcctccagagaagatccactttgccccatctagcggctgaggattccagcagccctgacagccctgacccaccagggcactgagccagctctgtgcctacgaagacagctgtctgctgaaccctttctgggtgcagcctgctgggtcctaactcgagtctctgaggcataccagggacctctgcccaacagctctccgaggctcctgatcaggaccggctgacacctctggaaaacactgaccctaagtgccacatccctacccttctcctgggtctctgccctctgactcatcactgtgatccttcattatttcatacattttgtccagatctgtttttggtgccagggtcattgactcccttagtccaccactactggacacagcactcagagatctttgccacttaaattgctttacactttgttcttcagtaaaaaattattaagctgatataggaacagcagtttctaaataaagatgagactatagtacatattatcagcccactgattttgccagtatagtaagcttgcaagtatgagtttatactttctgaatgatttacattttattccaactaaataaataaatctcactccatgacattttctaagctgaggaatagttgttaattcattttgaaatgttcttagactaagaatctaaatttaaaagagtaattagcatgatgcatgatgaatggacaagagtcttctgaggcacacagtaatgtatttcttccctcattttacttttataaaaatacttaatgggaattaatgatcatcctctggtacagatgcctcatctgatcatcaacatttctttgtatgtcactaacactatacccagctaaacaattcaagatgttcagagaaatggaggggggatgggaaagggaatctgcttcctagaaatgcagaaaacatcaactttgggtgctgaggaggccagaatagatttttaaataaagtcaaacaattttcagaaaaagattatgttacttgtgaaaagtcattcgttggtatcaattttaaaaataaagagtcagcataggggtcttcaatccaatcctagagtagcagagctagaagcggtctggaggagtgaccacttctcctttctgactgccagtgctcaccacagcttcatgtctctggggttctttccttgaaaatcaaccaaccaagagctcgggtctctgtccaggaaggtcaacagcaagtcactccccatgcctgggtctgaatgtccttatgtggaagttacttatgaatcgatgaaactggaccagagactcttttccagctctgagagtctgtaattgatgtattcatttattcagcaaaaattactgaacatatatattgacatatgcccactcttagatgtcctaaaaattaagcttgatatatgggctaatgctggagccccacgagaccccacagcaaatggcctcttgggatctggtgccagaagagtgggcccccttgtgtcattctcaaactatgctgcaatttccatgggcctgtgaagagatttatggattaggtgacccattttaactatacgtaatccagagatttgaaaagattcttagaaaggaatcgtggattgttaataagacaaatacaagaaaatctgtacttccaatgggagctcttctttagacacattttgaagtggaaagcatcacagttagacccacaagaaggcaaccagaaagattaaaaatcatcgttcggactttctcaattatagatttatgcatattttcagtagtgatgagcactgttctcagcatatattgtgcatcgagacagcaaataaccatagattgaagctctccagattagacacttaaaaactaagtatctaaaatgttattaatcacattaataaaaattttagtgaatacaaagaagtttttgtatcttcagcaaaatattttaatcattagtgatgtttaatttctcattctcttaaatttgttttgaattttttattataaacatacaatgagttcagtagagcacatatataacttgtaaataagaatatgtatccggtaaataaatgcacatttctgttggtggcgccatcagacactgagacactgagaggaggggccacaagggggatgaggcagaagcctcctgccagtgagggcccaagagccctgtccagggcttgggcttccttcctaaggttagatgtggggcagctctggcagaagagtgataggatcagattttcagttgtggcagttactctagccagaactggaaggtggcatggaaggggccaatacttctttctttcttttaaagtttgttctgccataatttaggccaaattcttcctctgctacatgtgaggactgcatgcccggcagcttcctccacatgcatcaggctgctggacaggccttgctggcacactgggtgggtggctccgtggagtgtcctgcctactgcaggatgtcgaacaacgtccctgtccgccatccacctagtcccagcagcagaggtgagagccactgatttacacggcagaactggccaccaccagactactcaccctcttctccttcaggctgcaaattaaaacagacttccatcctttcttcaaaggacatatttttcttcccttttgtcatttattttacacaggaaagtagcatcttttaatagtctagaagaactatttcaacatttggaacatgctaacaatatacccacacatggtagaatctttcaaaatgaggctttgattttggagttcgtacttattttatctacaatctttgtcaaacatgttatcttatgtgaaatcacctgtaacaatctgggacattcttttttttcatagtgcttgacttaccctgaatatctgacgttctttcagagtgctatgaaaaatattaaatcattaaacaaatgttatatattatttaaaagtaccaataaaccaaacacgtcactttttaacatttgctattgactgatattgtcaataatgtagttggctagccccataagatgggttttactttttatcactgctcactgtagcctcaaactcctgggctcaagtgatcctcctgtctcagccttccaaataagtgagaccacaggtgtgtgccaccaggcccagctaattttttacattttttgtagagatagagtctcactgtgttgcccaggctggtctcaaactcttggcctcaatcagtcctcccacctcagcctcccaaagtgcttggattacaggcatgagccaatgtgcccggccaggttttacatctatatttcaacccctcagaacctgtggaggatacaagaggcataactacataagtatccaaatttttcacacagttgcatgtttttattttctcagaagggcactaaatcaacacatctcttgagaactacatcttacttcccaaagagacaaaatagttataaccaataataatttcagtattactagaaattataataaaaatttaaaaataagtagattgttttatagaaaactaaaccaagaatctaatctttatttttaaaaatattttccacttgaaaacatttcctttttcaagtgatcaaaatgcttccttcttgttaagctcacagcaatgaaaaactcatttaaaaaatgttctctgagtttgcaacatccccattccatatgctgtcaatactttccccgctggaagagcctgcctcttaccccaaataagcagcaagcaggaactcccaggcctgggtgaggtgtgtcccctggtgtggtcactcagacagagctgtgtgtctgcaaacacaccaagtcactcacagccaggcactgccagcccgggctgcctgcacagcaaccctgtcaggctcatgcagaagaagccgttttcagaccacactcgttttgcaagaacgaacatctctgtaaagttctgcttctgacgtcacagtttctctattccacacaactctgcctcaaagccttttttaagcacattccaggcacaagtgtgagccagaaaaagggctgaaaacatgaggggccctctcgggacaagccccggggcccacagcctgcaccaccagggacatgggggctgctaaggagcctcccaccagcacctctgcctgcctctcccgcagaggcctccggggagtaacatgctgctgatctgagtgaacataaggaacaggaacacaccacaaaggtcccacagaagcacagcatggggagccatggctgacagccagtggtcaagacagaggttctggagcaagatggaaatgcacagggcatctggctcccagtcctgcccgatgccacaaacaccatggggcctgcacaacactgagagctcccaaacaccacaaacagcatggggcctacacaacactgagggctccccaccctgcctgatgccacaaacaacatggggcctacacaacactgagggctgcccaccctgcctgatgccacagacagcatggggcctgcacaacactgagggctccccaccctgcctgatgccacaaacaacatggggcctacacaacactgagggctgcgcaccctgcctgatgccacagacagcatggggcctgcacaacactgagggctccccaccctgcctgatgccacaaacagcatggggcctacacaacactgagggctgcccaccctgcctgatgccacagacagcatggggcctacacaacactgagggctcccagccctcctgaatgccacagacagcatggggcctgcacaacactgagggctccccaccctgcctgatgccacagacagcatggggcctgcacaacactgagggctcccagccctcctgaatgccacagacagcatggggcctgcacaacactgagggctccccaccctgcctgatgccacagacagcatggggcctgcacaacactgagggctgcccaccctgcctgatgccacagacagcatggggcctgcacaacactgagggctccccaccctgcctgatgccacagacaacatggggcctacacaacactgagggctgcccaccctgcctgatgccacagacagcatggggcctgcacaacactgagggctccccaccctgcctgatgccacaaacagcatggggcctgcacaacactgagggctcccagccctcccgaatgccacagacagcatggggcctgcacaacactgtgggctcctaagaaagcccaaacagcaaagtgagcactcaccttgtcttcatttcctctaagaggaagactgttgtaacctgataaaacagacagataaaggataggatgtgaccacaggaatggggtccaccagagccaccgatccccaagtatgggatgtgatgacagggacagggcccatccagggcccacaggtctccccttggactctgacacaatcctaagtggatggagtaagggaaagggccctgtgcaaactctgaatagtgcactgggccctaacacagaccctgcactgcccggccacctccctctccccttgccatccccacaggccaggaagatgggcacagcaagactgcccacccttaccctgcaggccagagggcaaagcaagccagccagacactcacctcgcttcagaagagcaaagggaacaacacccacccggcaagctcgttgacaagaccaaaattcaggcacttaaaaacagtgcaacctagacatgccaagtatactaaaaaacgtgctctgaattttgcatttatcaaatattacataataaaacattttaaaagaaagtgtttagcatatctaaaaaaagtgtatgtactatctctttttattatactttctactcaaacttgtaagaaatttgtatgaatattatttaagtcacctttttttttttttgagattccagaggccaggcatggtggctcatgcctataatctcagcagtttgggaggacaaggaaggaggatcacttgagtccaggagttcaagccaggcatggtggcacatacctgtagtatcagctactcaggaggctgagtggggagaaacacttgagcccaggagttcagggctgcagtgaactatgactatgccactgcactccagtctgggctacagagccagaccctgtctctgtaaaaaaaaaaaaaatcatagattcaaagagtacatgtatacgcaggtttgttacgtgggtgtattgagtgatgccgactgttgggtttatgatgatcctgtcacccaaacgaggaacacagtacttgataagtagttttttgacccttggctccttcctccctcccttctttaggcattcccagtgtctattgttcccttaagtcctacttcttctctttttttttttgttgttgttgttgttgagacagagtctccctctgttgcccaggctgcagtgcactggcacaatctcatttcactgcatcctccatcttccaggttcaagtgattctcctgcctcagccccccaagtagctgggattacaggcacctgccactacaaccagctaatttttatatttttagtagagacggggtttcaccatgttggccaggctggtctcgaactcctgacctcagatgatctgcccacctcagcctcccgaagtgctgggattacaggcgtgagccactgcgcctggccaagtcccacttcttttattcaagggctttacagtcatcaaagggatgatgtgaaataaactccaaagggctgtcaccatcagttactctcatcatcacaacaaaaccaggcctcatccttattgatgtaacctgtttggatatgcctattaagaaatataaatgatattactctttaaaaggtaatggcaatgcttttgcaataatctctattgtcagttcatctgagacttggattttctaaagtaatattgtttctaacaataacaatattccatcctgtcagccaccacctccaacattaactgtagaaacctggagcatccaaaaataacaaccactatgacttatcagaaactctgtggttaccaaggactctcccacccatctcaggtaatcctctcaaaaacatgaagaaccaggtattttgctcaaggtgtaaatccagagagattataggtgaagtctttccatttctcttgacttctaatatgagtgcaagtgcaaactgtaaagattatctgattggaaagataaggtgacctctcaatctgtcaacacgctgcatggaagcagtactgtcatttaatttgtgctcttgaaacagccacatattccctattccctaccatatttgcagaaatcaccagcagtttctgactctgctagaatcctctttctatttcagtgaaaaagccccatttctgttaccttaactgatcataatttcatgttggctatttcatagaatcaaggaccataacagcataacaaagcaggcacatggatgccgcaagtcttctaccacaagaatgggtgccgctccataggaactgatggctgtgcttcccacagcagctctaaccacagctgtatctcagtgcagaacactcaaatcagatggaagtccagtggtctcaaccttggcctgttttcaggaaaagcagagaaagagattcaagaactcttagtaaaagagatgtgagggacaaaatggacttgaggtgggaagtcatcagacagcagctcctgccactgctttacctatgttccatcccctgcctccggctaagaaatggagcttgcgctggtgtgcacagttgagtcctctagaagagcggctatttcagagaatgtacacattgtggggtcagcctcaaattgtaccacagattaactgctgctttgagctggattaaaatcacagcctctgactgccaattttattagcggctccatccatttacaagttgaatgtatttcacatttggaaccagaattcacttgcatgattaatatgaagtcctttcctttcagaaaccaggtcagccttccttctgaaaattccttccgccaaacaaaccatttctaaacatgccctttgtgctgtatacagaacactgcatcagaagccttttcaaaatgacctttcagaaccacgtggtgacggagcacccacatcacatgatagaaaattctacactttccttccaccagcatagttcagaaaagagtagggagtccctgaaccaaccccctgcctgcttgccactctaaacatcaaacctaaacagaacctactcttaaataaatgttcttaggaaagtaatccctctctcatcccttattctgaagtgggtttttgttatgacaagtctgagatgagagctcacttctttggtgtttgtgtcaccacgtttttaaaaacctgacggaagcccagaaagcattcggaacataaaatttttatggacacatcgagtagtgaatcctaagggtggcattttcattccctgccattatgggaaggacaaaagtctccaaaaataagtcgcccatttccaaacatcaaaattccctcagaaggcacaccaaatatttgaatctgacacccaaaacaaaacccaactcagaaaatcaatcccctgctggtgccaaagagcactttaaaatctccgtggcctgaggttgagaagcttctaagagaaaggcagtttgacaagtgaaatggtccccactcctgtaagaacgagacagacgtccttgttctgtgcaaccagagagacatgttctgacagcgtgtagaatcctcggcccatcctgggatgaccactgggagagaaaggaggctccagagacctaggaccccatcccaggactacccaccaggtgtcctgtggtacattccttaaccactccaagactcagtctttctatctgtaaattgaagatagaaatacctatgcgggttattctggggaatacatgtcagtgaacatggaaggctcaggggttcaagatttgggggtacccagaggtacagggatgggagaggctgtcactgtgaagggagcacactgggaagttttgggggtgatggaatgatccgtacactgacagaggaggtggccacctgaatctatatgtaacacagtacaccaaaaaagaaaagtccattttactttatgataatttaaaattaaattttaaaaagaaagctccagaatcggttttgtaactattagttcatcccctgtcacctgccatggccttgaatcaccctcacaagacacagtcctagtcctggcactacccagggaatgcccttggttttctgaatcccagttaggactattagagggaacagacaaaaacaaaggaagtgaaatgccctcttaccacttccagagatgagagttaacactgagtaactgtcaccaaacactcatcatctctcgtttctttgtgttacacacacagaagccgttcaagacaaatgcagctcggtagtccgaggtccagttttccagctgcctgcaaaagccacccacttaccagcctcgtgatgtagagtgacaaacaaaaaaggtatttaaaatgtgcagaagcaggtgtttccaagggagcctcacccatttttacttcctgttctaggtatttaaatagtggctgtggcagagttcttagagataacaggaattaaaagaaaaaaatgcccttccttcaacacactgtttccacactgtttccaagcagcagaaaagtggattaactgttttctgcttctcaggttttctggccttctatcaactaagattaaaaaataagtccagctgggtctacatttatgaaggtcaacttaaactaatgtggaaagagctgccaggtgcttttatgtggtgtggagggttatctgccatgaatttagctgtttgctttctctgagaagtggaacatcatgtcaggaaagataagagaggttctcagccgaggctcatctggccttcgtctcttgggattcggctggatgaaaaccctttctgccatttattaagctttttcttcaccgctccacgcacaaagaatccttaaacctggtcgggcacagtggctatgcacgtaatcccagcactttgagaggccaaggcaggaggatcacttgaggccaggagttcaagaccagcctgggcaacatagcaagaccgtcctctctcaaaaaaaaaaaaattcatttttaatattttttgttcattttttagttattatatttactcatgaacccaaactaagacaaaacttttttaaattagcctggtgcagaggcatgtgcctgtagtcccagctattcagaaggctaagatgggtggattgcttgagcccaggagctcgaggctgcaatgagccatgattgcgccattgtactccagcctgggtgacaaagcgagactccatctcaaaaaaaaaaaaaaaaaaaaaaaaagaatccttaaactagtaatatttacacatatccaggcatatcttagatatctgtcacccaatgccagggagctattattagtttgggtgatgtttggctgcaaacactttttcatgaggaatttgaaattctaaggtaaccctccaagaggcagtagtcatggctcacccgcaaagccagttgcattgagtggaactttcttaatgagaccatgtctgatgacagcttagctgaacccctatgtctccttgaggcttcactccccttcctagtcccatattcctcactttcaaaatctaaagaaaagtcgatgagtaactgcatccaaaaattaggtaatcccgcatgaacactaggacaaaacaaacccagaatgcagaaattattgtcacataaaatgatcagtgttaccacagagttcatcagaagatggggccttgggatgttgagccttggactgcacatcacaccagctaacctttgtcccgtgtaccctgtgtcgatagccctattcttcacaggaagctggagacccaacatgctgacatgtttcatagcacacagagattcccgctgtgcaccatgatggggcccaacaccatctcggagtaaagcagagagaggactatgacaaagtgattgcccacccccacctcccctccctggcaggcaccactgaccttgatcaccaggtacaaaaacaaatcagcttggaagaagagctgccagacgctaacacacagctaagctcagcactgagaagaagtcattttaaaagctcttccattccctgcccatcccttctgagcctgacaccctacatcctgcttcctgaatctagcttcatgagtgaacccattgtctggcacctccttcttccagaagcctagggttacaacacaccccattccttctgcccagaacatcagcccttaggctgatggagaccgagcaggagagacagggaacaacaggcagagaagctcacagatgtgcaaggagcaggctcttcttgggggaagggacaggttgctcattaccatccaaccaaacggaatcagaggctctggaccccaagaagtaaagatagatttgtgcttttgtggcagtaaggatcctttgatttaaaaataaacaatcacgccatctccttcacaaagccagcagagtcctgctccgatggctctgcctctcggctctgtgtgggctccctggtgaatgaaaagtctgtgtaggcaaatcggaaggccaaaacaaaggagcaaaatgaacaatctcctgtcttcacagccaggtgcacccactggttctgaatctggattctcgaagcaaaatctgcatgaaaggctgactctatcattggcaagtgaaagttgtgcttctttagcaaaaggaagggggggcctttataaaactgcccccctaaacataggggccacctgagcaggttcacaagtcagcctccatgtaagtgaagaacagcgtaaagcccttaacaaagggcttatgttcaagttaaacttaaggaaaaagcactgagacctgcacaaaggatgccctgaaatcacagagaaaggcgggccggtcgggaggaaaactcaaagactgaagcatatgaagaaaagaccatcaggctgtctgaacagccctgcataacacagcaatgttattttggctacaagcaaagctgaatcgtgtcactagaaaggatgccatgttcccctgtgttcagcttcgataatggtctcacagataattaattaatgccataagggagcccttccgaccagaaaggaacaggcagagtgggtgatgggagggcaggaaactaaataaatcaggggaaaagagaggaagcagtgagacttccactaccacagggtgctgccaacagctgttctggaaataagtcagcatcgtggagtgcggctcaaggccacgagaataaactcagagacagcagttatcgaccctgggtttcatcaagagctccttcactgtcaacatgagaaaggccccttgctcaagacaaggcatcctatataaaaagaattggtctttaggtcttgttaacatcaacctctagttctaacctacaaggctgtttgacgtaacagaggagcaaaaacttggatctccttgaaccacatgtgttctggaggcctcaacgtgaagttgaatgttaataggtaaataaataaatagattacaaatggcacagctgggccggatttaaggccgctctgtgcatctttaatcgagcctcattatttggaacaatgtagttggcgtgaccattgccaaacaagatccagacaggagagaaagaaaaatagcagcacctgcccggcacaggtaagaaagcttctccttgcattctccgtggattgtgttctgacaaaatggcagcaacactgagtgaggatggtacaaggtggaggggacataggtagctgacacatggccacattctgccccaaggtggctcctgcaatgggaagaccacatatacatctcactctttgtctataccactggggcagtttccaattacctgagaatgtaggtgatgcctttcacctggagtcctcgaaacaatttcaacgatgtctgcatccttaatgttttcccacaaaataagtgtgtccataagtctctttatgacacagccttctgttaccagtgacaccgtgatcagagccgagggaaacatggcaccagttttaattatatgagtcaactttgctggtagccaaaataacactgctgcattgggcattatcattcagtttagcagctttcctctcttcatgcacttccatctttgggttttcctttgctgcctctctcagctaccccccacctttctgactttctctgtgattttggaagaatgctgtgaactagccattgcaatggcaaggaaagcagtcaaggaccagcctccagctcacaccataatgacctaccttccctgggacactccacgcccatgtgtgcttcatgtgtaggtgaagggcggcacctggcctcagagcaaacaactctcccataaggtgactggccaggtcaagccagctggaggaaggaatacaaccccagcaagaggccactggtgcacagctgggccttctttcctgatagggggcaaggcaccaggaggaggcagagtgagcaaggcccccaagcctcccatgcaggactcccccgtgctccagcatggaagggtgagggcttcacctgggccctgggggcacagtgactgggctacatcccagaggtgcgggaccagcacagacactccctcccaggactccaaggcaggtgagcaaggacctcctttcccagcgcctgtgttccttctaacagagacaagcaggttagggagtgtgaggaaacctcaaggcaagggaggaattcaggggactctggcttgagggaggggagcgtcaactcaggagtccagggagactgtgtcaagactcctggttctctgcagtttttgtttgtttgggattttgacgataaagcactactggagaccagaagggcctagaggccgagaggaaggtgccggagcccagctgcactgaggtgggtgcaggcggcgctgggcaacggcgaaggacccccctccatccccgcctgcgtttgcttctgcaccccgtggacaccgattatcctaacctgtcatgtgtaattctggccccgaagccgcctggaaacattggctttatggtaaatcttcttaataaacaagattagcaggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtcctctgatttcggcggcgctgcccgcgggggggtgcgggggacgcaggtagaagcgggtgcagcgggacatccgaggcccggcccctcgcggcacacgcggcggaacacgagcggggggcgcacccacgccggaccagggccgcgcgctccagggccaggggagtgccgagtggcggggctcggggcgtgaggcccaggagccggggtagaggcaggaggcggcgccggggaggaaactgaggcaggggcgcgagacctgctccgagcccccagtgaggacagagaggcgcgcgacccgtggccgggggcttgagacccagagcctgggggtgtcgcgctggaaccccgagacccccggagcccccgacccgctcgccaaggcgcgctccccactcactcactgaggcacccctccccacccgccccgtcactcaccgagacgcccctcccctaaaccccccactcattcattgaggcgccccttcccccacgccccgcattcattgaggcgcccctccccccacgcccccctctcattcattgaggcgtccctcccccagaacctctcagaggcgcccctcccccaacgcccccactcatttattgaggcgccttccctgcatgccccctcactcagaggcgcccctccccgcaaccccctcactgaggcgccgcccctcccccccgaacccctcacagaggcgcctctccccccgacccctcagggtggcgcctctccccacccagaccccctcacggaggcgcccctctcacaacgcccccaactaattcattgaggcgcccctcccccggcgccccccactcacccagacgccccgggagctgccggccgcgggggacggacgaaggggcggcaggcaggacgcgtggcggcagcagcagcagtagcagcagcagcagcgggagcggcggccccatccccgcggcctggccggcggcgctcagtccatggccgcgcgggaggcggcgggaggcggccgagtccgggcccagggaggcgcgcgccgccggctcctcccgccgcgcctctcgcgctctt

SEQ ID NO: 2643 - DNA, 1048734 bp, Homo sapiens; identical to SEQ ID NO: 2642

SEQ ID NO: 2644 - DNA, 1048734 bp, Homo sapiens; identical to SEQ ID NO: 2642

SEQ ID NO: 2645 - DNA, 39649 bp, Homo sapiens
gtgttgctgtcctcttgggttccacttcggattttgaacccctgtattttcttttcaaaacccccttttccagtggaaatgctctgttgttaaaaaggaagaaactgtctttctgaaactgacatcacgatgctcccagattttatgctggttctcatcgtccttggcatcccttcctcaggtaagcacaagtcacagtaaattaaaactacagttgcagaattatttaagcagaggaggcaaaactatggtgttgataatgttagaattacaatatgtaatgcacaagatacatttaggataacctttaaaatgtggcccaaatgagtaattctgtgagatgtggggttttttttgctgaagaaatcatatctatgattttcataatgtttatgtttttgtcatttgctgcgtttctccttctgaatcactatgagcttggtaagaaaatacaaaagcaggaaaaacattattgaatgcactgagcattactcagagaattgttcaaatatttggcacagaaatttactatatcaacatttttctatcatatttaccaataatttctatatctgcatgtagatatttaattttgtccaatatgccctgtaggcctatatattttaataaatctgtgtatgtaggtagatttagcatgtttatatatcacaattaaacaccaatgtatcaaaactctatgtgttttatgtgactattatcaactgaaaatagaggaatttttgataaggataaaggacaaataaaaggaaaaagtgaaagatagagacagagatgcagagaaagaacaaaaagagaaaaagaaaggggaataaagtactgaaaggctttggggattggtcatttgcacctgccaatttcctgggtttgggaatcttttcactttttgtgtaacttgagaacagaaagttttcccccattgaatcagaaaccatctgaaaccgcagccagatggtgagaaaagtgtcagttcactagcaatttgtattaatttctcagtagtatttttgccacgtttgattattgtaattttcaaatggagaactggagacactaagggagatttgcccaaatccagaaataaattctacatttcaagttcccaaggctgcgaggcacctgaacattatcctgttgtcaaaaacgccttttctcagaccaaggactcaaagtcaaacaggaatttctaaatgcagaaagcctcaaactcactttcaaatatcatgaaatttggacttttcaaagtcttgaatgcagtttgccaatcacaaaaatgataagaaaattctgtgtgtttgagcttaccattaatgtacgtgtgtctgatgtttttctgtctttattattctatttattataagacaattgattcttaccactcttttcccaaggaatgatttctctcaatggttagcgagggtgtttagcataaactctcttggttcagctaagtctcgtcctctgtgtacaatcatgattacataagaaaactggaattgcttggcctctggcattggtctccattgtgtgggctggaagagtttgggaagattgtgtaatctttcacagatctataataaatctaataacctgtgataaatcttacatctgtatttctagatccatcagcatctgctcatatttttaaatctgtcccatatttccttacattttttaactttactattcattgtaaacaaaatagtttctttttgttatgcaaaactacttttttcaaattacaagaggcaaccccttcatttttatatttctggctttggtaaaaaggagccttgggtgtggccatgggttgtctctcatattgctatttcatattttgtgtgtgctatctgctctcaaaaagcaggaggtgtatcttatttatcttcccatctctcttacaacatgatgatatgataagacacaatgtgtttattcattcaataaatacttattgagcatctactgtatcctaggaatggttccagtgtctaggaatgcaagaggaaataaaaacaaagccattttctaataagctctcagctgggcatcatggctcacacctgtaatcccaacactttgggaggccaaggtaggcagatcacctgaggtcaggagtttgaggccagcctgaccaacatggtgaaactccgtttctactaaaaatacaaaaaattagccaggcgtggtggcacacgcctgtaatcccagctgctcgggagactgaggcagaagaatcgaatcgcttgaacctgggaggcagaggttgcagaaagccgagatcacaccactgcactccagcttgggcaacaagagcgaaactcggtctcaaaaaaagaagaaaaaggtctcatgctatcaagaatccattgaatatgcattctttgatttcaccatgagggctagctccatgggtgacggaagaggctgccatatttgtggtatgctttttttttttttttttttgacgaggcggcaatagtggaaggaagaaacaaaatataccaaaaggcatcaaagcaaaaaaatccacatttcacaatcgtctttgctgagatttggaattcttcaataatttcttttcttttttttttttgagatggagtctcgctctgtcgcccaggctggagtacagtggcgcgatctctgctcactgcaagctccgcctcccgggttcacgccattctcctacctcagcctccagaggagctgggactacaggtgcccaccaccacgcccagctaatattttttgtatttttagtagagatgcggtttcaccgtgttagccaggatggtctcaatctcctgacctcgtgatccacccacctcggcctcccaaagtgctgggattacaggtgtgagccactgcgcccggccttgttttttgttttttgtggtttttttgagacggaatctcgctctgtcacccaggctggagtgcagtggcaatcttggctcactgcaacctttgcctcctggattgaagggattctcctgcctcagcctcccgagtagctgagattacgggtgcccaccatcacacctaattcttttttatttttagtagagatgaggtttcaccatgttggccaggctggtctcaaactcctgaccttaggagatccacccgctccggcctcccaaagtgctgggattacaggcatgagccaccatgcccggcccaattatttcttttctgtcctggctgaggataaaaaaatggcattatcagtaaaaccataaataatcctgaagatttttatgaaatcctgttcataaaattatggacagatgttgatggatctagaaatacagatctgagatttataacaggttattggatttagtatagatctgtgagagagaaaagttttatctgttaagtcttatcagttgtttgtacctcagtgtgagtttgtcaaattttgctaaaagtggatgttgatatggaggtgggaagagagcaggggcgtctgagagactgaggaaacagaatcaagaataaagagactggtcgggtgtggggcttacgtctgtaatccagcactttgggaggctgaggcatgcagatcatgaagtcaggaggtggagaccatcctggccaacatggtgaaaccccgtctctactaaaaacacaaaaattagctgggcgtggtggcacatgcctgtaatcccagctacttgggaggctgaggcaggagaattgcttgaaccagggagtcggaggttgcagtgagccgagatcacgccactgcactccagcctggcgacagagcgagactctgtctcaaaaaaaaaaaaaaaaaaagaataaagagaccaaggatgctgcaatggttcacgtctgtaatccaacattttgggaggccaaagcaggaggattacttgagcccaggagctcaagaccagcctggacaacatagtgagagacatacgtctctacaaaaaatttaaaaattagccaggcatggtggcatgctcctgtagtcgcagctactcgggaggctgaggcaggacgatcacatgagcccaggaggttgaggctgcagtgacccatgatcatgccactgcaccccagctggcaacagagcaaggccctgtctctattaaaaaataaaaagaataaagagaccagaaggtcaggtcttcaattccaaaggaaaatttctttgtcttaaagtgttactagggaccttatcaatatctttcatgatttcattcagtgaggctgagagagccccaaccccctcacagaggtgtctctccaatcccctggtagctgtgttacttttacctgactgctctgttgagataaacagcagcttgagtgaagggctgctccccagtcatatgcacatcttaaactctgacagtcttttgtatcttgaaaacagcaaatatctggggttaataggccacagtttgtggatgtttcatagacacaaagaccctaaaagcctggaaggtgtgagctgctggaggcctcagccatcacccatttccttttcttattgggagatgttaactgcttggaatcaagaccagaacccatggtctctaaatcagagtccaatgcctctcattattaaataaatatttgttggattctcctcctaatgagtgatgacttcggaaagggaatcagccttctgagccagcagcagcacactctcccagagcctgtcccagcctgagctcagtgcacaggagatgaccagcatcaggccaagtgcacgccatccctgtctctgcctccgaactgaagccttcacattcgctctctgcctctccatcttccttcctctgcccatggagttgtctgtctggccctaaaggaaatatatatatatttatttaaaatagaaataaacatttatttatttatcagagcttctctgcaccacccaggctggtctcaaactcctggcctcaagcaatcctcctgcctcaggctcccaagtaactgggatttacaggtgtgaaccaccacacccagccccacaggaaatattttgacaaagaaaaatgagacaaagattaagcaaggaggccaggcacgatggctcacgcctgtaaacccagcactttgggaggccaaggtgggatcaccaggtccagagatcgagaccatcctggccaacatattgaaaccctgtctctactaaaaatacaaaaattagctgggcatggtggcacgtgcctgtaatcccagctacttgggaggctgaggaaggagaattgcttgaacccgggaagcagaggttgcagtgaaccaagattgcgccactgcactccagcctggcaacagagtgagactctgtctcaaaaaaaataaaaagaatataattcttccaggtagtagattgctctaaataacagtaaagcattctggaaaatacaatgctaacagcaaaacatcaaaaatagcaataacagcaaatatatgtatatcgaattgaatttttgcaataagggaagatggctggcctggccgccagaagaccacgcaggccaccatcagctggatggccctgggcaaggctcctctcgatgccccagtatcttcacctgtaaaacaaggggctgggatggtcctggaggtacttcttggctttattgtcttagcttcattatcagttcacttttccttcctctttcattgaggctgaaattgggtccaagcttctgtaagagattcatccatgtccgggagtggtggctcatgcctgtaatcccagcactttgggaggccaaggcgggcagatcacttgaggtcgggagttcaagaccagcctgaccaatgtagcgaaaccctgtctctactaaaaatacaaaaattagctgggcatgttggtgcacgcctgtaatcccagctactcaggaagctgaggcatgagaattgcttgaacccaggaggcagaggttgccgtgagccaagatcatgccactgcccttcagccggggtgacagagcaagacttcgtctaaaaaaaaaaaaaatatttatatatatatatatatatatgtatccacaatgggggacactcatcttctgagaaaaaattcttggtttttcaatggattactgagatggatcttagaatatagtgattaatttaaaatataagttattttgcaaattttggtctatgcacaactttccaggaatccttttattccataatacaaagaccacttgtcctggaaaccttgagcgcatctgtgattttacatcttcgggagcagtgagccatgctggctctacctcattcccctgggtcacagaaagccccgttatggccttttgttcatgtgttcatttgttcattcatcaaacatcatcaaatatttatggaggccctggtctcaaaggatcaactgtgagaagcacttggcctttctcataatgttctatttcacaagaaggacaaaccagaaacatttccaggcttgtcctctaagtctgctccaataatgccaatgacttcagcttctattttggaaaggttctggaaatttgaagatattaggcagaaatcatttaatctttggctttttttattagggggataaagtctgttttggtcagaacagatttgcattagtcaggctgccatcacaaaataccatagactgattaaaaacagacatttattttctcacagttctggaggctggaagtctgtgatcacgtgctagaaagtcagtttctggtgagggctctgttcctggcttacaaacagctgccttcttgctgtgtcctcacatggtgtgtcctctgcgcctcctccttataggctctgtttttaaatatagtcacgttgggggttagggcttaaacatttgatttttgagggatataaacattcagtccctaacagccagtatggttcatgctttttgttaattcagacggaaagtgcaccttctgacagtggtaacacaggtggagatgtatgctgtgcgtgaaagagcagagctgcttgctgcccctggatcttggtgaggagcaggattcctgtaccttcacagggagcacagctgcgtaagtgcaaacgctaagcatgtcaggtcagaattctagatttcccctcccaacgtgcaactccacctcctttcagaatgactggacagtttttcttttgggaaaggaagttcatggttacagtccctgctcatcttcaagaaccctctctcttatgtgtccaaaattctcccggctcacagttgtctgagctaataggtgtgtgtgtgtgtgtgtgtgcttgcatgtgttggttcaggcatcattcagttgttctcggcctccctggagtgcctccatccattgtgagatggtgtcttcagtaatttgtgctaatttggctgacctgggactcagggactctgtaagaacttcagcatctcagcagctagtcaggtggtgcaagcagccatcagggctgtgttcagatgcctgtcagtggctacagtggcttaaccaaataggagattgcttttctcacataccaagaaatttggagaccaatagtacagggctatcagaaacccaggttctgtgtgtctttccattctgccctcctatgtgtgtagctttcatcaggttttcaagacagataagtggccaaatctccagtttcagacaaaaagaaggaggcagacatgtcagatcaagtccatcctttttaacaacctttcctctaaccaccccaatcccaacagcttctgtttgtatctaactggctacatgtgccataggccattcccagatgcaagggagcccagagctgagctttttaagctggcaccatgcaaccctgaataaatttagcatctgttgccaaggaaaagggggaatgcctgttgggcagggaactggcagtgtctgccacagtgctgctgtggtttgaatgggttccccaaagttcaagtgctggaaatttgacccccaacgcagtagtgttgggaggtggggcctaatggtaggtgtttgggtcatgggggcaccaccctcatgaatggatttatgccattatcatgggaggggttggcaccctcttgtctctctcaccccctctttgcccttccatcatgtttgatgcagcaagaaggccctgaccagatgtcagtgatctcaccagatgctcatgatcttggacttcccagtctctagaaccataagccaataaatttctgttcattataaattcctcaggttgtggtatcctgttgtagcagcacaaaataagtgaagacaagtgcctttcaaacaatattctctgccttagaggagggggctgcctgacctggggatagatggaggaggacagctgtgtcctcactgcttccctcttctcttgagcaattcacctctggtcccaactctccagatgcccctcagtaaaacaaagtccacgaagctgactgcattgttgctcgagtggttgtccactcaatagccattagctcaacagctgctgggtgacagtcactgttctaggagccgggaatacaggagtgaggaagacaatccccaacttcctggagctggcatcatctagggaggggagacaacaataaacagataaatgtgatatgattaggttctctactggaagatgaagtaccctaagaggatagagaggagagggactttaaatagtgtaacctgaaatgacttactcaaggaaatgacatttgagcaaagactggacaagtgaagggatggctgtgggctctccgggtaagggtaagaactttccccaagcagatgcattctggcttgttctgggaatcgcagactggcccgagggctggggaggagaatgtgggcagtatggtgggggtggtgcacagttagggccatatggggtcagggagactgtggagggacttaggatgattctttctgagtgtgatgggaaaccatctggagcgcttagcagggaactgacataatcctctagctgctgtgtggggaatggactgcagaaaggtcaagagtgaaaacaattaggaagcagtgcaggagcccaagagagagagcatctgtgccctcagcgtggccccggtggagacagtggggaacaatcagggctgggatgtattctcaaggacattaagacccgacgtagggtgggagaaaaagagaggagtcaaggatgacttcaagaatgtccctctgagcaaatgccccctagagcctgtggggttccaggaaggtttcctggctctttacagactgacaccctggtggctgcccagctggctgctcccagtgctgctcttggtactaatagtaatcaacagatcagtttttgtttattaaaaaaaattttttttgagacagggtcttgctctgtcacctaggctggagtgcagtggtgctaccaccactcactgcagccttgacttccgggactcaagccatcctcctgccccagcctcccaagtagctgggactataggggtgtgccaccatgcccggctaatttttttatttttgtaatacagggtcttcctatgttgcctaggctggtctccaactcctgggctcaaaagatcctcccaccttagcctcccaaagtgctaggattacaggtgtgagccaccatgcctggcccacagtttttaagtaaataagcacaaatgtaaggttgcgtctctccctatcactcatttgcattttatgtggaggaaaatggggctgggaaccgtcagaggacacagcccacttcacccatgcctctgaggtgctgggacagaggcacctggaattgctcctctcttaggaaagtgcctacagaagcctcctgcacacagggggatggtgcactgttgtgcttttcttcctaaaagaatccctggattttgagtgggcaaacctggagggtatgtctctcatgagatcattacccagcatgtggatatctcagtgggaagaaaaaggttttctatggtcaggacatggtgcagaatgagttgctgtaggatattaatcgggtgctgaacagacaaggaggggcaggttaaaactcccatgctgatcagtaatgggactgcacctgtgaatggccactgcactctagcctgggcaacatagtgagaccctgtcttctttttttaaaagtaggggcttccttgttttaaatgtgatagcacggcattgtaaggaaatagaactctactttgggactggattcctaagccatttccccaactggagggttaaagcttaacactgggtgtttctgaggttctcacatagtgaggcactgggcagagtgtgacatcctggctgctgaccaaggaaggactttgtaaggaaagactcttccttgggaaaagacaagaggaccgtgaggggcacacggctggtgttcagtgaccatgtgccgactctgacatctactaacacacataaaatgaacacccactatgggccaggcactgttctaggtgctgggtaaacatgatcaaatataacgcccattgctcccatcgtcagggagctccagaggaagacaggtgtgacaaatgacaagagacttccaaagggagatgctggaggctcagggacggagaacagcttggggacagggcccatctctgtgaagagggagcgttgcagatgggaccagaggtaggggtcggggtggctgcagatggagcttttgggacctgggtgttgaccccatgatgggaaaatctcatgagagagtgcagctctgggtaaaatgtggattctgggccgggcgtggtggctcacgcctgtaatcccagcactttgggaggctgaggcggacagaccacgaggtcaggagatcgagaccatcctggctaacatgaggaaaccccttctctactaaaaatacaaaaaattagccgggtgtggtggcaggcacctgtagtcccaggtactcgagaggctgaggcaggagaatggcatgaaccctggaggcggagcttgcagtgagccgagatcgcgccaatgcactccagcctgagcaacagagtgagactctgtctcaaaaaaaatacacacacacacacacacacacaaacaaaatgtggattctgttttcagctgtgtgtgtttggagggaggtgggagtggacgtggagactcttgcatgctccaagttgcctttcaggaactgggctgtttagaaacagacacagcctatggtgcaggaggccaaggccacaggagccatgggacactcatccaggcatcgtgcccctcccattaacccaggtccacccatgattcttttacagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggtgagtaatccttggcacttggctaaaaagaacatgcattccttaacctgtttatgagtctaaaatatatatttttccctatgtctgccatttcaattttaaaaataatttactgtgagagaaaatctgcccccaagaagccactaaaatgacccaaggaaagaacgagaagttgtcacagggtaaattttcattgcagcactgttagtgtgggacgattcgctgcggggaggatgtggttgctaagatagtcattgctcctggccccggtttgctgaacacccagggaggagggctgggaactgcagagaagaggggctgagcctggggctgacgtgctgtgatcttcgatcctccctggctgtgccctgggctggtagggggctctgcagggagacagggtggtaacaacagtgcccagagcaaggcccattcctgctgtccctaggcagccccgtcacctcttctgaactcacccatgccttcacattctaattttccttttgagcttgcctttctgtcatgattgtgttcttagaagaaaccagtgaactttaactccctaaatgcaacaaaattgtccttctatgatccccaaagccccagaagaatcctcctatgttgtccatattctccaccctactacacacatgtgcgcacactcacctgcctggctggctcaataccccaggattccttctaggaagtcatgcaaagcccgtctccagtttagctattatttccctctactttgtaccttcattattattattgttgttgttgagacagagactctgtttcacacaggctggaatgcagaagggtgatcttggctcacttgcaacctccgtttcccaggttcaagtgaatctcctgcctcagcttcctgagtagctgggattacaggcatgtgccatgatgcccagctaatttttgtatttttagtagagacggggtttcgccatgttggacaggctggtctcgaactcctgacctcaggtgatccacccgcctcggcctcccaaagtactgggattataggtgtgagccactgcacccagcctactttgtacctttaaagtgccttctgggtcatccaattttatgtaaatatagccacaatgaactgctacttgtttcagttgtttttcattttaagcaaaatccgcatgccatttgactatttatatgccatttgactgtttacatgccatttgactattgtaaattgagaatcttttgcacttttaacacctcaaaggtaagattcagatagatttttctgatcgaaaccaaacaaaaaacaactgggtgtggtggcgtgcacttatagtcagctccttgggggctggggtgtgagaatggcttgagccccggaggttgagggtgcagtgagctatggtggcaccactgcactccagcctgggcaacatcttgagatcccatttctaaaacaacaacaaaaatcacaacttattttcacttcaacttacagtattttttaaattttcattttcttaggatgaaaagaatcagctgatgacaaccaatgtgtggctcaaacaggtaaatttcaatccaaggattgtgtctgctaacccagtcacttattttctatttataaaggctcctatctgaaaaacaattatttaagagggcatattgtgttcctcagggagatttgtgggaagggtctatggcttttattttctgttgtgagtgttggggagctgatcctggcaagcccctgggtacacactgttgtgcgtggttgctctcagcagtagagctgctcgtggagcaggcagaggtgactctactgccataaggcctggggatgggccctgggaccacttagaggaaacaacaaagagcctccaagatgcaccactttctcccaggtagggaactgcagctaggtaggaaaatcagggctacatcctccctagccttctctggtcctctgtgggtagaatctacctctaatacctcttgttgcttccaaggaagaactgagccctgaatggaggaataacggggctgcccattattaatttcagaacagagtgaagcccaaaacaaaatgatgaatacgtgttttcctgacatcactgaaaatgcattttgaatcgttttcagctttcttcttagataattgcttttagcttggctagagcttatttcctaaagtcaggggagtgtgcccaaaggagtttgttctaggattgtcagtaaataattaccattcaaatcccagtttcgcatatgttatctacaaagagaaaatattgacatttgatagcaggtaagaagtttggtttatcccagctattcgggaggctgaggcaggagaattgcttgaacccaggtggcagaggctgcagtgagccaagatcatgccactgcattccagcctgggtgacagagcaagagcctgtgtcaaaataaataaataaataaacttggtttaattgcttgtgtttttattttaccagtggttttttttttaatttagttttctcatattcatttacatatttatctgagacacagtctcattctgccgcccaggctggagtgcagtggcatgatctctgctcactgcaacctctgcctcccaggttcaagtgattcttgtgcctcagcctcctaagtagctgggattacaggtgcccgccaccacgcccagctgatttttgtacttttagtagaaacagggtttcaccatgttggccaggctggcctcaaactcctggcctcaagtgatccgcccaccccagcctcccaaagtgctgggattacagacttgagccactgtatgtatttatttattttttagattcaggagttacatgtgcaggtttgtttcatggatatattgtgtgatgctggggtttgggcttctagtgaacccatcacccaaatagtgaacatcatacccaataggtagtttttcaacttattcccctcccttcctccttccctcccttccccttcatctcttttggagtccccagtgtgttttgttcccatctttgtgtccatgggtaccagttgtttagctcccacttctaagcgagaacatgtaatatttgattttctaaagttttttgtttgtttgtttttctttttctttttttttgagaccgaatctcactctgtcacccaggctggagtgcaatggcgcaatctcggctcactgcaacctccgcctcccgggttcaagctatcctcttgcctcagcctcccgagtagcagggactacaggcacatgccaccacgcccggctaatttttgtatttttagtagagatggggtttcaccatgttggccaaattggtcttgaactcctggcctcaggtgatctgctcacctcggcctccaaaagtgctgggattacaggtgtgagccaccgcacccaccctaagtattttgtccagatattgcctaatttgccccattgttttaaaatattcctggtgggatatctttctgctaatgctttataaggagcaatggatacaagaaacagcaaggagcttcccccagcttcatttcatgtcatcaaatgtctcccacccaacaactttagtgagatttagagaactatcatgattttcagtgctttctacttatctgattctctaatcagtagaaacggtctgaatattgttttacttgcaaataaaaatacccaaaagaaaataataagcttggaatgtatatataaaaataccatttaaataaacatatcttgctatacacccatctcattccccagtgacttacccacttttgcaattcagaggcctgagaattgggaagtattttgagttgataaaggccaagaagaaatcctatattcaagtttgcaggggagaaaagaacccacactttcctcttaaggtgaaaacaggcttagaagttaacaaaaaatcaaacaaacacacaaacctttacttcctgcacacctccttcccccactgctctcttttttttttttttttttttgagtctgtgtctcactctgtcgcccaggctagagtacagtggctcaatctcagctcgctgcagcctctgcctcctgggttcaagagattcttctgcctcagcctcctgagtagctgggactacaggcacgtgccaccatacctggctaatttttgtatttttagtagagacggggtttcagcatgttggccaggctggtctcgaactcctgatgtcagcccaaagtgctgggattacaggcatgagccactttgcctggccgagattaagctctaatctctcacataaagcaggggtccagggactctgggccttcacatgggtatagtaggtcttttcacttttcttgtgcttttgaaaattaggagtcgttttggccaaagagaacagcattagacacaaaagagtgggcgccgaggaccctgagggcctcagctacagctttggaaaggacttcccacaaagtgtgccaccagaatcccagaagactggtgggtgtcttcaagccaaggtggaattaaatcctaaaagtcaattcaatacccaaaaccaagcaggagaaatccacaggcatggagcacactgacacttggaaaagtcagcccactgactgaagttcccatttaatagaagcaatgagaataatcgacttttttgggtataaatatgtaaggtacaagtgcagttttgttacacagatacatttgtagtggtgaagtctaggcttctagtgtatctaaatactgatgtacattgtaaccattaggtaatttctcatccctcatccacctcccaccctcccactcttccgagtctccaatatctattgagattaatatactttaattgtgtttaattcacaaatgcataaatgaggtttatctcatttaaacctctctaccacctgacttaggaaaagagacatcattacccctgttttatagagatagaagagtccagtcctcatccagcaggaatctgggtttcctaacccctggccaggatctttctggccatatgcagcctccttcctgaacactaagccctgcttctagatcacaggaggagccaaagcaggagaaacgaagcttcacattccagaaaactacagaggatatagtcattgcgacgtccatttgcacagattgagtttggagtgggaaatgttacagtggatattagttaatacgcgctgttatggcacagacaatgttggggcagaaaagaaaggtcatttttataacagtgggtggcaagaagggaaggctgcctgtaacaggaggcattgagctctgccatgatgttatttttatgctttttaaaaagagctttttggccgggcgtggtggctcacgcctgtaatcccagcactttgggaggctgaggcaggtggatcacaaggtcaggagattgagaccatcctggctaacacggtgaaaccccatctctactaaaaataaaaaataaaaaaaattagccaggcgtggtggtgggcacctgcagtcccagctactcgggaggctgaggcaggagaatcggttgtacctgggagccgagatcgtgttactgcactccagcctggacgacagagcaagactctgtctcaaaacaaaacaaaacaaaacaaaacaaaactttttaaagctatatggattaaagaaagctgaatgattaaaaaaaaaaccatgaaaagaaaaccaagataaaacagatatttataaaaagctatcattggttttacacagatcttagttccagagcagctaataataatatttaagatttactgagtacttattaagtgcccaggcactatgctaactgtgtaacgggaataatcccattgaattttcacaaccatcctataagggaggttctattataatcctaactttgcagatgaggaaacagaactggagagtggaagtgacttgcccagggttaagcactgttagggaagtcgacttatgtagagaaatctttcacttgccttagactggagggagagtttggagagtgtcctgttctcctgttagtcctgttgctgtataatttcctaaccctggtcttctaaggctttgattcctcagtctccggaacatctgatggagttggtctagaaagaattcaggagagaatgaagttaggatccactccatcttccatcccttcaccaggatttattgacatcctatgtgccaggcgccctgctagatcctggatgtataaagagcaacacacaccaccgcctgaaagaagaggacatagcgttagttactaaaaaataattaccatgataaatagcacaaagaaagtacatataaaccactgtggagcttaaaaaatgacaatgagacaggaagaaagtcagggaaagctcccaggaggaggggatatttaatttgagtcttacaggactaacagaagttctacaagccaaaaaggtggggaagttgtgaaccacctgaatagtgaatagtagtccaataacaccactatccaaaagctctcacatttgagcaaacccattggtaactctttgcaatcatctctgtgtccctcagtcaaaatgaaaacaaaaatgcccaattccccctctttcctcatttgcctcccagacactgaaaaatgttctctaattcatatccacatggagaagaaaattctacatacttggaacaaaagcatgttccatggtagcgcatgcaaatgagatacttgtggggttttttaagtcaattctcctgtcttatcctgtttccatagctctcctctggtatatttagacactcttcttctatcctctcaaccaaagaaagaactttataaagcacaaatctagtgacatccagaggaagtcttctacatggtgctatttttattttattgattttattttgcaaactagtttgtcttcctcctttgtacttccagacagtaatcaaaaccctataaactataaatatattgttaacattgactcactggaactatgtgagaaagtacttactgctccagtccctcagatcctgctccatcatatcaaggttaggaaaacgtggaaagcaccttagagacaatgaaaattaaactgaccttttttttttttttttttttgagatggagtcttgctctgtcacccaggctggagcgcagtggcatgatctcggctcagtgcaacctccgcttcctgggttcaagtaattctgcttcagcctcccgagtagctgggattaaaggcgccggccaccatgcccagctaatttttgtatttttcgtagagacgagggtttcatcatgttggccaggctggcctcgaactcctgacttcagattatccacccgccttggcctcccagagtgctgggattacaggcgtgagccactgtgctgggcgaaactgaccttttttgaaatgacacaagggttggccgttttgcctagatgttacaatagaaataatcactatgacaacaaatgccaaatttactcaatccgtatttcctgagagcctgctctgcactgtgtaagtgatgcagggcagatgaaccccaaaactggggcttagtctggcttcaccgaggaaagaactcaaggacagcggcagcagagatactgctccctacagaccatggctacccaccagcagtgcgcccaggctagggctgcaggcatatttatacccacctttaattatatgcaaattaagaggcagtttatgcagaaatgtctaggtgggtggtaacttccaggtcattgccatggaaaggggtggtaacttccgggtattgccatggcgatggtaaactgacatggtgccgtggtggccctgtcttatggaaagccgcctctgcccgaccctgtttagctagttctcaatctggtccggtacccgagtccccgcctccagagtcagtttcaccttctgcctcataaggccctgagctgggcgctgttgcatataaaaataaggcaatgagaggactaaatgacccggcttcactgtagctgagacagtttgttctcctctccccatgacaatcctgaggaaaataaaactgctggaatatctgcccaggccaacatcttaaagtagcagtgtctttccaacagctgatgtctgttttagatcaacaaaaagttcagcaaacatgaaggtcttattggatagacccctggagctgatttcccaggaaaaataagaagcagactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaatacaaaaaaaattagccgggcgtggtggcgggaacctgtagtcccagctactcaggaggctgaggcaggagaatggcgtgaacctgggaggcagagcttgcagtgagccgagatcacaccactgcactccagcctgggcaacagagcgagactctgtctcaaaaacataaataaataaataaatatcatgccattttgttatacttcagattctagctttttaaaggcccatacatcttaaactttgttttttggggatcaagtctcaaaaatgttgtctaagatagacaatgtttcctctggggtgtggagttccatcatttgtcaggcatcatgcatatttcagtattttaccatctagtgacatcatccatctgctgactcctgatgttttaatgacaaagttggcatcactgggctccgggaagcgtcatgctgggcatgcccttctaactctctgaactcccgcatccttactcacctatccacacgaggggctgtagaatagaaaattttaattttcaggtcagatttcctatgattctggaccctaaaatctttgtaatagagtccactctgctgtgattgggtcatccatacatcatcctcttgaccttcacagtctgatcaattcatggtcaggtttatttatctggattcatcagcccctgtaaaacatgccatgtgatttcatccttatgaagaaaaatgtgtaagcgcctggaggctaacgatattaggaatgcaatttaaaattataattgggagctccaaaaataaattcagattaaaacttaaaagaaaatgctgggaaaacatttttttattggatacaagttctaatgtgatcaagaagaattcatggaaaatggatgtctcatattaacatagcaggtggatgttcatctaagcctcttgagtggtgtttaaaatcacttgtaccagttagcatgtgatttaagtatcactggacccaccctcctagaataaactgaattagacacatcattgcttttcttttgtttgtttgttaagagaaaataggatgaaaagatagatcatgaattagtggcgtttgttgtagagcctcttcatggtgaggcagatacagtaattttggaaatatgtaacatgcaaagtgtgtgggcctgggtgagatcagaggccaggctggctcaaggtgaatcctgtactgagtccccagtagggtcacgcagtccaaccgggacaatttccttttcttaataaaacagtggcttggtaaagctaacagaaacttgaagatttcaagatctaatacattgaactttcggaataaaatcacagtgtactaatttcatgcaggaatggacagaccacaagttacgctggaatcctgatgattatggtgggatccattccattaaagttccatcagaatctctgtggcttcctgacatagttctctttgaaaagtaagtatcacattgtttcttacttatggggaaaaaaataaattttttaaaaagtgaaaaaaaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaataaataaataaataaataaataaataaataaaaaataaaaagtgaaaaaaaggaaagtaagtatcacagaagaaaactattttggtcagattaacactaggaatagaaaattctgattcaggcaaaatacttaaaagaaatattcaattttaaataaaaaaattgtttattaaaacagttacctggcgttgtggtagaaaagtcctaaaatagggcagggtgtggtggctcatgcctgtaatcccagcactttgggaggccgaggcgggcaattcatgaggtcaggagttcgggaccagcctggccaacatggcgaaaccctgtctctactaaaaatacaaaaacttagctgcgcatggtggccggtgcctgtaatcccagctactcaggaggctgaagcaggcaaattgcttgaacccgggaggcggaggttgcagtgagccgagatggcgccaccgcactccagcccgggcgatagagtgagactccatctcaaaaaagaaaagaaaagaaaagtcataaaacagaaatagtcaatgctgggaaaaagaacaaaaactagcaggtgctccaccgactgctaaggtgaaactgctttgattgcagtgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtgagtaaactggtattcctgataatgctgccgtaaaggtaggccaaagacaaatattttgacatctgtttacaataaaatattgtcatggtttaaatgtgacgttatataagacatgctttttatacatataacatttaaagcaagccctgacataacatagcgacattagtatgaatttttaggaagtagttcacaaaaacataaggagcaaaagtgaagcaactgttgattaagcaactgttgattaagcattgtttcttataattctatattaaataattcaattacacattttaagttggttagcctggtttctggtaatttatctttcatttttcattggatgataaatatgttcaaccacagtatttagaaataaaagatcagaaagaatgagatttttaaattaatataaaatgtagtgttacaacagatattttggtgaggaaagaggatgtggttatttagtttacagattttttttttttaagtgtgagccaggcacagtggctcatacctgtaatcccagcactttgggaggccaaagcgggtgtatcacttgagtgcaggagatcgagaccagcctggacaacatagtgagaccctgtctctacaaaaaatttaaaaattaactgggtgtgggtgggcgtgcttgtcctagcactttgggaggctgaggcaggaggatgacttgaggccagaattgagaccagcctgggcaataaagcaagaccctcatctcagaaaaaagaaaaagaagataaaagagaaggagaaagaaaagaagtagcgtgggaagagtgtgaatttcagactgaaaacagtcctgggttcagatcataatctgaatgacttaagacaagttacttaacctgagcctcagttttctgaatcctaccttgaaaagtttgtgtgaggattaaatgacataaaatacaaacatgcacagtgtacccagcacacaggggctcagctccgttgtataagcagtcaacaagtgtgaattctcgcctttctaattatcatcctcatccttcttctttttttttttttttttttttgagaggagtcttgctgtcacccaggttggagtgcggtggtgtgatctcagcttactgcaacctccgcctgctgggttcaagcgattctgctgtctcagcctcccaagtagctgggactacaggtacacaccaccacacctggctaatttttcttgaattttcattagagatggggttttgccatgttggccagaatggtctcgaactcctgacctcgggtgatccactgcctcagcctcccaaagtgctgggattacaggcatgagccaccgtgaccagcccattcttctaaacagtccttccccagtggaatgaaaatattatttgacgtgcagatattaagcgtaaaaagtgatctgttgggccaggcacggtggctcatgcctgtaatcccagcactttgggaggccaaggtgagtggatcacgaggtcaacagatcaagaccatcctggccaacgtggtgaaacctgatctctactaaaaatacaaaaattagccaggcgtggtggtgggagcctgtagtcccagctacttgggaggctgaggcaggagaatcacttaaacctgggaggcagaggttgcagtgagctgagagtgcaccactgcactccactccagcctggcgacagagcgagactccatctcaaaaaaaaaaaaaaaaaaaaaaaagtgatctgttgcctaaagcaagttacatattttcaatttatatgagaacttcaatttatagggttcaaatattttactctaaaattgatgaaaattagtgccaagagcctgatcccgtaaacaaactgatgaaagaatttttttttttttttttgagatggagtctcgctctgtcaccgaggctgtagtgcaatagctcgatctcagctcactgcaagctccaccttccgggttcgtgccattctctagcctcagcctcccgagtagctgggactacaggcacccgccaccacgcctggccaattttttgtgtttttagtagagacagggtttcactgtgttaaccaggatggtgtcgatttcctgacctcgtgatccgcccacctcggcctcccaaagtgctgggattacaggcctgagccactgcacctggccaagaattttttttagaaatatccttctacattttctcttgcgttcacagacactgcctcatatgtcctctctcttaacaatctgtcatgtttttcatccacttaaaattgtttttaaaagcactagaaaagtgactgctgctagacaagaaacattcagctgtcaagttgggagaatttttttgtttgtttcttaacatcttttaaaaacactaatacagggccaggcgcggtagctcacgcctgtaatcccagcactttgggaggccgaggcgggcggatcacgaggtcaggagacggagaccatcctggctaacagggtgaaaccctgtctctacaaaaaatacaaaaaattagccgggcgtggtggccggcgcctgtagtcccagctactcgggaggctgaggcaggagaatggtgtgaacccgggagacggagcttgcagtgagccaagatcatgccactgcactccagcctgggcgacagagcaagactccgtctcaaaaaacaaacaaacaaacaaaaaaacactaatacaggccgggtgtggtggctcacgcctgtaatcctagaactttgggaggccgaggcgggtggatcacctgaggtcagcagctcgagaccagcctggctaacacgttgaaaccctgtctctactaaaaatacaaaaattagctgggcatggtgacgagtgcctgtaatcccagttactcgggaggctgaggcaggagaaccacttaaacccaggaggtggaggttgcagtgagccaagattgcaccactgcagcctgggtggcagagtgagactatgtctcaaaaaagcaaaacaaaacaaaacaaaacaaaaacctaatacaaagatttcttttttttccccaagacggaggacatttatttactctagagggatgaggactccccttcctttcagacttccccagccagtcgtgccttgactttgtgtttatggacctgttgcccactctctgcacctccccttcctaataaaggggactcagtttcttgtctccttcatgaattcctgtcttgtcctggtcggttcttctccttggcagcacccttccttctggagctgcagcacaggtggagtggaagaaaagaaagcctgtgacatttggccacaaaaactcttaaattataaacttgtgattcttttcatacgtgtatcaggaagcaccctagtaagatatactggcttcctaagatatgctctgtctcctgggttcaagcaattctcctgcctcagcctcccaagtagctgagattacaggtgcccgccaccatgcccagctaatttttgtatttttagtagagagggagtttcaccatgttggccagctcgtctcgaactcctgacctcaggtgatccccccacccccaggcctcccaaagtgctgggattacaggcgtgagccaccgcacctggcctatagtggctctttattcatgtaaaaatcagacttttcctattctgatcaggaatgttgacatatgcatacagaattctattgtttctattttccttcttcagtgctgatgagagtgttccaagctgcttcttttgggcacaattagcgaagtccctgaaagaacctgagcctgtagtgtggttgggacattagatgcattttgaaaacttaagtaaatgctataaatctgaatgttactcttttttaatcccttgagatgaatacagaacagttgctcagtgtcttgagtgaaaggcatctttttctcttttgcaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtg

SEQ ID NO: 2646 - DNA, 10270 bp, Homo sapiens
aggaaccggagcctgagagccgggcgccgtgcgctcctccccgcgctgtctcggcggcccagggtgagtcggccgcggccgcggggcggggactgggaggggcgcggtcctccgagcccggcctggtggaggctgtagcccccgcagtgggcgcgcggagctcggcagggagcggacccgcagccgtcactgtcgcctccgctcgccttgggttccgaacccttatcggggcgaagggccctgcgccccggtccatgctggctgtggtcgggggcgtgcggccgggcccccgagacccgctccgccgagccggacggttgcgcagagatgaggctgcaggcggggaggcctggcgaggtggggctgctccggggaggaccaggctctgcccctcgcttccgtccgatggcgggctcttcccggcagcctcgctccccggcggacgccgtttcccgcagcgttcatttaccctgcgcagttttgccccctccccgggttggggcatttattggaccaacagtcatttcgtaaatagctgttgggtatttaactgtgagcgttccggtgctggggaccccgcagtgagcgaacagcccgcctcgcctccaggagcatgaattgtaatagaggtgaggcgttagtgtaacaggcaataacgcagcaaaataacttctggttttgacaagggcctcgcacagaataaaccaaggaaataaaattgtgagagttagggggttagggtagccttggcggtcaggggaggctctgtaaggagttaacatttggccgtgcgcaatggctcacgcctgtaatcccagcactttgggaggccgaggcgggcggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactggtctccaggctgggcaacagagggagactctgtcgcaaacaacagcaacaacaaaaaagagttaacatttgaactgaaacctgctggaggagagaagcagccacagatccctgaggagaaactcccaggcgggggaacagagagaaggctggcatggctgcggcgtagtgagccgggtgccccaggtccccgaggaacagggcttattctgcgtatggaaggaggtgacccctcctagtcttccagaccccagttaaatgagttcccccagtaacatttcttggtggtccttcatctaaaattagcaccctcctccccttgacattttctgtctcagcaacagcttgatctgttgtcatcatatcactgctccattatttttagctcagtgctgtttaatctgattgaaggtttacttcctaattccgaagatagaactaaaagcaggtttttttcccctctaaccaggtagcccctccctgaggacatgcactccctagacatgagcaaacacaaagcagcagtaacttaccgctcctagtccaagtcctaccctagtcctgggttgcagttcttaccagagtggagggtggtatgtgttgaggggtcggggatcaagtcttctggcagcctcataccctgagatactctggttgccttgttggggtgaggacaacacgtgtggccatcgcagtggcccaggtgggtcctgccacagactgccctggacagacagtgagtgggggctgggtgggggtggtgtggccctgctcttccatgcgtttgcagtctgtgccctctgtgcaggggtgattcacgaatctgtctgatccacccccatcgcccttcgtaccctaacatgtcaaaagggctctgctgccaaatgtcacttcatagcattgtgaccaagcagccctcctgcctctaaacgcactctttatttttatttgagagagaacctcactctgtcgcccaggctggagtgcagcggggcacacttggctcactgcaacctctgtctactcaagcagttctcctgcctcagcctcccaagtagctgggattacaggtgcgtaccagcacactcggctaatttttgtatttttcgtagagaagggtttcaccatgttggccaggctggtcacgaactcctgacttcaaatgatccgccctcatcggcctcctaaagtgctggaattacaggcatgagtcactgtgcctggcctctaaacacatgctttttgttaactgatgcctaaagggaaacatctctttacaaagtggcagctacttagacggctccagctctacagaaatggatagccccggagaccttcacccaaacacaagagctcaagtgtctgttgaagggaagagtgaggagaacagggcctcatgcctactctgtatacgtctgcttagagcaaaattattgttttgttttgtttgagacagagtctcactctgtcgcccaggctggagttggtggcatgatctcggttcactgcaacctctgcctcctgggcttaagggatcctcccaggatgaccaaggttgcaccattgcactcccgcctgggcaacaagagcgagttgtcggagtctcactctgtcacccaggctggagtgcggtggcgcgatctcagctcactgcaagctccgcctcccaggttcacgccattctcctgcctcagcctccctagtagctgagactacaggtgcctgccaccatgcccggctaattttttgtatttttagtggagatggggtttcaccgtgttagccaggatggtctctgtctccaccgcacctggccaaaaaagtgttaaattagaaaaatagaaagaggccgggtgtggtggctcacacctgtaatcccagcactttgggagaccgaggcaagagatcacttgggtccaggagttcaagaccagcctgggcaacatagtaagacctcatcaataataaaaacttttaaaaattagctgggtgtggtggcatgcgcctgtagttccagctactcgggaggctgaggtgggaggattgcttgagcccaggaagttgaggctgcagtgagctgagatcacaccactgcgctccagcctgggtcacgcattgagaccctgtctcaaaaaaaggaaagaaaaataggagaaaaagaggaaccactcataattctatgacgcagagagagctagagttttatgctaccagctttatttttctgcttacagtctgcttgtttcatgtagtaaaatgcaagaatgttttctgatgttcccacaacatggttttattggttgcagagtcacccattgttcatttcataatgagcaatgttgcccaggccggagtgcaatggtgcaaccttggccatcctgggaggaaatcttaagcccaggaggcagaggttgcagtgaaccaagatcacaccaccaactccagcctgggcgacagagcgaaaccccgtctcaaacaaaacaaaacaataattttgctctaaccagtcacgctttgttcatttcataaatcctttctgagcacatgctgtgtgccaagcccttcctcaggccctaggggtacagaccagaggccttgtctaattggggaaggcagataaggagcaaggaagttaacttgtcttatgtcagatggcatagtgctatggagaaaaataaagcaaggagcgaggataaggaattcccaggcaggaggggaggtggcagtttaaaaaatggtggtcacagaaggcctcccagcaaggtgagagccaaaaaacattggaaggagtgggtgttcccatggagaagcttggatacacctccttgggacgtgaaggaggcggctgatgtgattgccctagcactttaccctctcctgctcccttctggatctggaggggccttctggggggctggagggccttaggcctgggctctttccactcatggctctatgttccctcagaattcactgtctgtagcatctgctcctccacagagggaccctggaatggcgatggcactcccgatgcctggacctcaggtgagcaccccctgagcccgtccattgccccaggagactgcttcgcccctagcctcagcttttcagccctgagaaccttacagcttgcctcacacccacccacatcacaggatggagtctgcaagccgaggacagcctcctcgctctatggccaggcctcacacatggctctgccaaatccttccagcctttgggcagaagtgggcttcctgcggcctcctctggcccctgagcttctatggtcagccattgagggcagggtccctgtccttccccagtgcctgcctccttcctggtgtgaatggtcagcccatcctccctctcctgatgctgactcactgctggtgttagaaattgagacccagagggtggggatgctccccacagtgcaggtgctccttccccaaatccctgatagcctgtggagagggcgaggccaaggttgggacccccttcctggtaaatctctctccctcccccaagttcagtttttccctcttcctctctggggcttctgctgagaatgaggccgctcactcggggggtgttgggctgccctttctctgctgggccctgtggatgcagcagtgggcagcaaggagagaggcctctagcagatcatgcaaatgtttctcatctgctgggttctcaccgagcccttgactgcctggatagcagagtatgtggttgcaggaggcggttgtgttcgaggatgtggctgtgtacttcacaaggatagagtggagttgcctggcccccgaccagcaggcactctacagggacgtgatgctggagaactatgggaacctggcctcactaggtgagggcttctgcctttggtcctggggccgggaggtgcgtctgtgttagcttcaaaggaagttggttccattgcagattcaaggtctgacacatttttgaggggaagctggaggctccccaaggagcccctctctgcttcctgttgggcacccactgccagcgtcagcctgcctgaggcttctctcctggggcaggccccccatctccccctggccacctagctgcccccttctgggatagtgaatgttcctgacccactccaagcactctgtgccctgatggcctccagccaggcacctgggcgtcccttctccctcctgtactgatacgtgctgctttccttctctgagcttaggctttcttgttgccaaaccagcactgatctccctattggagcaaggagaggagccgggggccttgattctgcaggtggctgaacagagcgtggccaaagccagcctgtgcacaggtgagtacaaagcacccacagggcgtgtcctgtgctgccaatgtggcctggcctccgggcagctctgcaggtcccttcttctacagtgggaggtgtgtatgtttagctcctcacagcagggccagatttcctactaactgccttgcttgtaggtctaaggtcaaaactaacttatgcaggaagacccaagtgcgagagttttccattttggtgtccccaaggtgtcaggggccgggtctgtgctcacagtgccattacccttgggttgtgtagggaccagccctacagggtctgtgggtttttctcctcatgtgcagagacgagagatcatagaaataaagacacaagacaaagagatagaagaaaagacagctgggcctgggggaccactgccaccaagacatggagactggtagtggtcctgaatgcctggctgcgctgttatttattggatacaaggcgaaaggggcagggtaaagagtgtgagtcatttccaatgattgataaggtcatgtgagtcacatgttcaccggacagggggtccttccctgtttgacagccgaggcggagagagagacaggacagcttacgccattatttcttctatgcattttaatgacttttagtactttcactaattctgttactgctgtctagaaggcagagccaggtgtacagggtggaacatgaaagtgaaacaggagcatgaccactgaaacacagcatcacagggagacggtcaggcctcagcatggctgtgggcgagtttgactgatgtcaggccttccacaagaggtggtggagcagagtcttctctaactaccctggggaaaggaagactccctttccaggtctgctatgtaactagtgccttcccaggcactggggttactgctagaccaaggtcaactaagtaacgggcgtcttcccaggcactggcgttaccgctagaccaaggagccctctagtggccctgtccgggcgtgacagaggctcacactcttgtcttctggtcacttctcactgtgtcccttcagctcctatctctgtatggcctggtttttcctaggttataattgtagaacagagattattattattattatttttgagatggagtctcgctctgtcgcccaggctggagagcagtggcgcgatctcagctcactgcaagctccgcctcccgggttcacgccattctcctgcctcagcctcccaagtagctgggactacaggcgcccgccaccatgcccggctaattttttgtatttttagtagagacgaggtttcaccgtgtgagccaggatggtctcgatctcctgaccttgtgatccaccgcctcggcctcccagagtgctgggattacaggcgtgagccaccgcgcctggccattatttttttttttgagacggagtctcgcactttggcccaggctggcgcgttctcggctcactgcaagctccacctcccgggttcacgccattcttctgcctcagcctcccgagtagctgggactacagacgcccaccaccacgcccagccaatttttttttttgtatttttaatagagacgaggtttcaccatgttagcgaggatggtctcgatctcctgaccttgtgatccgccgcctcggcctcccagagtgctgggattacaggcgtgagccaccacgcctggccagaacagagattattataatattagaataaagagtaatgctacaagctgatgactaatactattcatatatcatcatatctataatctctttctagtataactattcttattttatatattttctttattacactggaacagcttgtgccctcggtctcttgccttggcacttgggaggcttgcttgcccacaggttgctttggtttcctggttccctatggcccatgtgccagggactgagctcagggcagtggaggctgcagaaagaaccttgagctggggaggaggcccccagtcccagaggtctgcgcaggcacctgctctacgcacctgcccagacatgtttgctgagtgcaggaactgtgggtgaactctgaaggagagaggagtaaagaacatggctgtggggtgaggtacaacttgcacctcatgcctggcctgtcttccctgccagaccttgggcctctcctatgggctccccttgagctagcctcccacagtgctggagccattattagcctttttgttcccttctcacccgaaccctgattttattttatttttatttttattatttttttgagacaagagttttgcttttgtcgcccaggctggagtgcagtggtgcggtcttggctcactgcaacctccgcttcttgggttcaagcgattctcctgcctcagcctcctgagtagctgggactacaggcgctcgccaccgcacacagataatttttgtatttttagtagagatggggtttcaccgtgttggccaagctggttttgaactcctgacctcaggtgatcggcccacctcggcctcccaaagtgctgagattagaggcgtgagccactggacctggcctgaaaccctgattttaaaacctctggcaataatttctcaaacctccctacacgtctaacaaagactctgtcttcacttgattgtggtatcatttcacagtgtagatgtttattgaatcatgttgtacaccaaaaatatatacaagttttgttttaagacagtctcactctttcgcccaggctggagtgcaatggctcgatctcggctcactacaacctctgtctctgggttcaagcaattctcctgcctcagcctcctgtatacaagttttatttgtcatttatacctcagtaaagctgggtgttgggggaagacttgggaataaaaaggttatgtcttcaaacaagaagttcgtttgtgagtgtagaggctggatcatccttccgttttctgttccttctctcagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggtgaagcaaagtctaaagaaagggccagctcccatcaggagctcggcttcttgctccagccgggcactggggagggaaagggcaccaggcagcccgtggtgtggcctcaggaaccactatcagccaccatttcctggggccttccggaaatgtccaggagcgggcagaagggagagagggaggggcagctatgctcagtccccaaagagcagggcacagggggcgccacagacgcatatgcagctgagctccccacaggccggcccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttgagaccagcttgggcaacatggtgaaacttctctacaaaaaatttaaaaataagtcaggtatcgtggtctgtgcctgtacgctgtagtcccagctactcaggaggctgaggtgggaggatgggttgagcctgggaagtcaaggctgcagtgagctatgatagcaccacggcactccaacctggttgacagagtgacaccctgttt

SEQ ID NO: 2647 - DNA, 877 bp, Homo sapiens; identical to SEQ ID NO: 1079

SEQ ID NO: 2648 - DNA, 112 bp, Homo sapiens
tcttttgctgtcagtttttctgttgcttgtcttggttttatgccttttatatcaaggcacataaaaggcataaaaccaagacaagcaacaaaaaaaggattgatcacagaag

SEQ ID NO: 2649 - DNA, 80 bp, Homo sapiens
tttctgttgcttgtcttggttttatgccttttatatcaaggcacataaaaggcataaaaccaagacaagcaacaaaaaaa

SEQ ID NO: 2650 - DNA, 1776226 bp, Homo sapiens; identical to SEQ ID NO: 1447

SEQ ID NO: 2651 - DNA, 1745693 bp, Homo sapiens; identical to SEQ ID NO: 1448

SEQ ID NO: 2652 - DNA, 774609 bp, Homo sapiens
tgttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggttagccagacaggacccttaatcaaagagtcggtcttttctgtcagcagtgccttttaaatagcaatgatgaaggctggctgtcagggtaggacttgatgagcgagatgattgatctgcataaatcattttcttttaacattgtcagtgaagagtaaattggtgggacattttgggtattagctgtgttgaaattaatatgcagtatcctaggtgtgtcctcgatcacatagtcctcataaaagaaggtagaaattaaaaggaggcttttaggcatgcattgttctaacaagaaagttgcaccattcttactgctgtggtcatcatcttgcatgctaaattcggaagttgagtgtgtagcacattttacaagctccaaaaggaatctagttaatttgggaattagctagagtcagtagcatttaacaaccagtaaatctgtaaagacttactgctcagaggcaaaaaaaaaaaaaaaaaaagtctgagaatggtttctggttttataggatagggtatctactacctagcatgctgttgtagaaatagactcagctttagatgaggcttaggcttgaatccacgtgccatccctccaaagtgagtctccttgaccatgatgtaagtattaacctttttgagtctgtttctttgtctctaaaaatgggatttcattagttaccttgggtggatttgcttttggtattaaacagagcaatctaggtgaaagcgccaggcacattacctgggacatggtgagcaagtgctcaataaatgttcatctcctccctttctttcaatcaagcgaaatgccccaaaccagccaagatgtcaagattaaggatatgccctcatggtcaaaataaataatacattgcctggtttgggtcattctgtatttactggaatatcttatggccatttttatgtcaaaaacatatttcagcaaggcagaagcaatacctaattgccgaatactgaaaatagggaatgaggtggaaggaatgggagagaaatatggccagggacacttggtttttcttaccattacactctagattatgtgtctgggttcatatgattaaactctgaacaagtgaaaccaatgcaatatagtgttgggattaaaagtaggactggtggagccagatggctcaattcagatcccagatcttccgcttaatggctatgtgactgcaggtaagagagctaattgcctccctgagcttgtttcctcacctataaaatggggatagtaatagggttatcttacagtgttgttaggatgattgaattagtatatacaaaacaaaacatgtaaaagagtacctggtatgtacatgttaaccatgattactatgaatggttagttggttaagaaaggtagataatgctggccgggtgcggtggctcacgcctgtaattgcagcactttgggaggctgaggcgggaggatcacgaggtcaggagattgagatcatcctggctaacacggtgaaaccctgtctctactaaaaatacaaaaaattagccgggcttggtggtgggtgcctgtagtcccagctacttggaaggctgaggcaggagaatggcgtgaacccgggaggcggagcttgcagtgagtgagcagagattgcgccactgcactacagcctggcgacagagcgagactccatctcagaaaaaaaaaaaaaaagaaacaaaggtagataatgctgaaattcaagtgggtcaacagtctcaaaggaagaaacatatttagatatagaaatgcatgataatggtatactggagtgaaatacttgtttcattttggagaaacttgcctactggaggaattttgagctaggctgattccaaaaacatccatattgaagcaaataggttttgtagggtcttcgggtaaatagcctttacttgctgtgttgaatgtgaaggttaaaggaacacagtcttctctagccagattctccatgcgccttctgtaatggtaaagtccacgtcaatcgctgcttgtgggcgtgtggcatggacgcgcaggagcctctgtaacatgcatgtggcatgcagctgcgtggattcctggagattattggagatttgccttctcttcattcttagagatgtgcatttgttttcctcaacttgcttttagctcagctgattggttgtatgtgagctttgtgctcctctcctttcctgtcttctgaatttatgctattttgaacttttggtctgcttctgcataatgagagaagttggcagaagacaattccagataaaccttcaccaaaactaatggttctgtggaagtccttgaacgggtgtggaggagcaaagctctcccagttcccaggtgagcccagggtggagatgtaagaccacaccgaacactgagcatggtcaccaggctgcttttgagaagcgactgtgaagctgtcctcctgcaggggcatgatggctatatttgagaatttctggaaaacattctctgcctctctggcttgcaatgctcttgggctgcaggagtggtaaaattgtgctgttagattcgttcctgattccatccttattagataaagcgtggcctgtgttatctaactgactacttaatggagtccacattgggtgtgatattctgctcaagattaatttcgggtaatgaagatctgaaacaaggtatttaagagccccactaatgtttcatttatagcaatctatcaaaacgatagatatttagcctctttactggatatgaaacattaacttaaagccagtgctgctttctgtgttaaataccagtacccctgccttcgattttatcaaacattgtgaaaaatctgccaccacctcccggagaacacatatcatggacttagccttaagttatgattctctggcaccttggacaactgaccaaccctagcttgggccctgcttgggccttttcacataatgagtagaattcacaaacaaatatttatcgggcacatgctgtgttcaaggcccactagacattgtgagggggacacaaagtggactcaatttcactgcatgcgatatgctggaaaagagatatcttagcccaaggggcaggctcattactcctaagttggttattacattgttcagttatgagcagatgaggcctagaaaaatctgggtcgcttctcctcataacaacttcccatttggggcggtatgaaaagtgtgggtttccatcaattctgatgagtaggtggagtccattcctcagcctttaggtgctccccattgtccaggagccaacagttgggtatttggggctccagaacaagtatccaggcacctaaatggtatctagctaatatttattgatgcatttttctaaggaaaaatgagcaatttccacttttcattttcaagcttaatactcatgactgtccagtattatccttacccctctctagttttcttctctttactgtttttattgttcattggaaatatgttggtttagtaccaattgtgtgctgttttcctatatggaatatattctttctgatttttttctgattcaaatggtatctattcttcagggcctttctgaagacccgtgtcttcctgaccatattctctgtgcagtttttcttctttccaggaagaattttgtttttcttctctgaattcataaacatcaaggtttgaatatgcatccaatgcttgaacatagatgatggttctctagatatttttttctatgtgtaattcattttccttttaggttacagcatctttaagaatagggacctatgcttaatatctcttccatagcacacacactacttttgggcacacaagttgtactaaaagcctagtgacttgacctggtccacaaggatgaatcctaaatggacttggcagtaattttgtgtaagaaaaggcagaggtatcacacaattgattttacagtgtgtcactctcagtgtagtgcttatgaccaccttggggaatgtgaatgaagcccccactagatttgtctgtgctgtcgccaaggacttaaccaccaggttgctgtttgcagctgtctctgatagtacattggggtctatagacttgagtgtctctatcttttctggctcttccgcatgcttggtggtggttcgatattctgttttgtacttctttgataccgtctctggggtccccttaattgggacaccttaatcggggagcccctgctgcctgggcagggggctgaagtcctgctgctttccctccacattgtcaggattcctgggtgtttcctgggttggagacgtcagcctggcggcatagcctgtgctttccccattacctgatcacgtttcatcagtgaaacgggatgtttcactgaaggcttatctcaggaggcgcctgaatcttatttgaccagaaatctttttggcagttggtgaacttggttggattccagtctgtccctttcattgtcaggacatacccacagtgaggatttgtgtgccaggcgtgtcatttctctgtctcctccagaccccccgccctcatgatactgttgccaaaatcaagggcccaaccccttaccccttaaacatctttgccttttaaattttgtaaacaatgctggaataaaacatttttattataacagatacaagtaatagagatgttgtagcaaagtctgaaggtctctgttttaagtagtgtgtaatagaaaaccaaaataaggggtgggcgaggtggcttgcgcctgtaatcccagcattttgggaggctgaagagggcggatcatgaggtcaaaagattgagaccatcctggctaacacggtgaaactccgtttctactaaaaatacaaaaaattagctgggcatggtggtgggcacctgtagtcccagctacttgggaggctgaggcaggagaatggcgtgaacccaggaggaggagcttgcagtgagctgagatcacgccactgcactccagcctgggcgacagagtgagactccgtctcaaaaacaaaaacaaaaacaaaaattagctggacgtggtggtgggtgcatgtaatcctagctacttgggaggctgaggcaggagaattacttgaacccaggaggcggaggttgcagtgagctgagattgtgccaccgcactgcagcctggcaacagagcgagactctgtctcagaaacaagaaaatcaaaataacagtggcttaaaatgggagttttagtttcttttacaaaaaggaacagattcagcctcttgtgttagcttcctgaggtcaacagagacaaggcttctcctgtctttctgtatcaacatctttagctgtggctttcattttctaagacacttcatgatataaggctggagttccagtcatatcatccaagttttaagcaggaaggaagaagaaggggagaggaaaagaaaaagcacatgctagctagttgtccgtcccatttttatgcagggacttatttgtttacattgctcagcactagccagtcatgtgctaaagccagctcaccctaggttatgaatgccaattgttacatttgccagagtttttgcaagccgattgtcttgagtttggtagcttgaaattggccatagtttttacacaagagaaaatggtgtaagagagagctgtttgttaaccatttacgagacacagctgttcctggctgtaggacaggcgaggaaatgtaatttttaacttggtgcattgccacacagaataaaatcacagtccttttactaaagaagaagggaaagtgataatgaataagaaaacactctttgctacattctccccactttgtattccacagactggatctgcttcccctgtttaggttgttaactcttgtctccttttcaagttatgcaacagtcaacatagttttacatttgtgtttctgcacatgaaccagcatttgtggacaatagcttctttgaggtagatttgctaggtcaaagggtatgtgccctctgcttaactctttataaagaacactcaccagatgtctggtctgtttcctcctaatgtagtgtagtggtgatgagcatggattttggaatcacacatacagggtgtgaacactcattcagacacttctagctgtgtgactttggccagcttacttaacctctgtaagtgtcaatgtttttttccatgtaaaatgggagtgggggataccatctgaccctgcagggttttgtgacgatgaaatgagattgtgactacatagcacttacagcagagcctggcaggttgtaaacccacagtaaatagttagcaggggcttctgctcatggaaagatacacatgtgtgcaacatacagtgagaagaatgaaaacatgaaactgggccttgaacattacatgtagggtcgatatgagttgtagagatgaccagattcagataggaaagcaatggatgtttaatgttcaaactggaaaattattcatttcactgcccctaggggtaggtgtgtaagctaattgatggttagaaaaatcccagagtaaaccaggaatgtctctaattcataagtgtatattataaatatatttaaaatcatctttatgacaattcagttatgtttctttagcatatcagatcctttagttgtggaacttgacagaaatcaacataaatgttctttttctctcccaactatattgaacattgcacagatgtgtagttatttatcatgaacatgcaaatattgatgtccccaaggcccattctttgaatttcaaactgctgttgctatatttggatgttgattaatacgagtctttgctctgacacatagcatgtctgatttcaggacctctgaaagcagcatagagaagaaaagagaagctgaggcttgatattcatagggatggacaataattgaagacgtgaattgctttgggaaaatggcagcaggcaaccaaatatacgagatggttaaggatatgcctagcacagaactttgagcaggtagattttcagtatatctttgctcacttaaagagacagaagctatggagaagaaacaatcacaatgaaagaattattttaacactagtctagaacaagatttcttaatcttggccctattgacatttttggctggataattctgtgttgtgggggccgtcctgtgcattgtagggtattgagccacatccttggctacccactagatgccagttgcatggccttcctcaagttatgatcacaaaaaatgtctccagaccttgctaaatgtctctgggtggagggcagattcactcccagttgagaactactgatctagaagaaaggaaaattagatgatataaagtaaacaacaattatatgctagacatttaacccattgagtccttgcaacaagcctgaattgcagatgttgctaaaattatttttgtggaaagagaggtgggattccaagaagctaagaacatgaccccaggtgggacagatgggatctgagtccaaatgtgatgttcttttccttgtattcctctccttcctaactgtatgacataaacgtaaagtatcacaagagcttatgctgctcctcttcttggtaccaagctcggccttcactttcttatgaaaaccaaaagcagttttcaaagaatcatgcacaacttatatttgggtgattgatctgatttggcatacattttgtggagaacgtgaaccagtctattccccagtggagggctgttgataaacaaagagatatgtagtctttttagcatttcaagggctgtgagtctcctgagaaaactcaaaccaggtccaagaggagttactttgagacaagctatctaagaactgcaatatcctctgtggggaaggtggctttcgttgtaatggttcttgcaaatatttcttaaaccaaatagggttttcttctggggaacactgagatcaactatttgcctatttgatcctcttgcagttaatgtaacaggtttaaaactctggtctcagcagaaggggcttcattccgagctatgggggctaattctgtgcagtgcagtgtggggacagagcatcccactttccacagtttggtgaggcactggcccttagaggagagtttttgggtatacagctaattgttctaattatgtagtagtaaaaatcataccgtcctgtagccgcatatgaatagtgcactagagtgctttcttaaaagagttgggatggggttgggagggtcaggaaatgaagggataaaattattgttaattccacccccttgttataccatcaagagaatagaaaccaataaaagaactaaatgttggcaatccataaaattccataagcagtaataaacaaaagctgaaactgtattgatatacaaccaaacaaggaaattatcattattttttaataaagccatttatcatcaataaataccaaggggaataggaaaaattacaagcacaatgccatcttccataattatacctattaacaatttaaagcataattatgtgagggagaaaaacttttaggaaagctttgtgctgttttctccacagaaaagtcaaattctcacactcccagatattcaggattttctaaacatttcagaatgattggttatgcttgtcccaacttacagtagcttattttctaaggatctttctaataattcaggcccttccggcctctccattaccaggtttgtcatcagccctggagaaagggctgggattcaggaaaaaggtatatatggtaatgatctgaccgcttgctaaatgtcactggtcaagaggactttgtttagtgacaagttgattttgggattccaggatctttttttttttttttttttttgagatggagtctcactctgttgcccaggctggagtgcagtggtgctatctcggctcactgcaagctctgcctcccaggttcacgccattctcctgcctcagcctcttgagtagctgggactgcaggtgcccgccaccacgcccggctaattttttgtatttttagtagagatggggtttcactgtgttagtcaggatggtctccatctcctgacctcgtgatcccccgcctcggcctctcaaagtgctgcgggcgtgagccaccttgcccggccccaggatcttacttattttatctgaactaaccccagctgagcagctgctattgcctaaatgactatgttccaggccttggggttacagaaataaatgaggtactggtgtttgtttgtttgtttgtttgtttgagatggagtctcactctgtcacccaggctggagtgcagtggtgcaatcttggctaactgcaacctccgcctcccgggttcaagtgattcccctgcctcagcctcctgagtagctgggattacaggtgcgtcccaccatgcctggctaatttttgtatttttagtagagatggggtttcaccatgatgtccaggctggtctcgatctgctgacctcatgatccacccatcttggcctcccaaagtgctgggattacaggtgtgagccaccgtgcctggctggtgtatttttttaaccattgaacaccttacattcccaaagggaaacagacctgtatgcctgcagtggcgaacagcagggtgatttaagagtatgcctcagagcccaccagccagcctggggtcatagccctgctctgaagcttatcacttatgggaacttgtacaaattaattaatgttcatatgcctctgtgtccttatccacaaaagaaaaaatagtaataatatctgcttgtaggttgttatgaggactaaatgagttgatatatgaaaagtgcttaaaaaactgcctggcacctggtgagtgctatgtaagttggcagtcatttaacctgacagggtgaagtcctgtgacttggtactttggttctggtatgatagcagtggttggggtattttgatagtttgggtctggtgcaatagcaagctcgtggtcacggaaggctctgtgtacaagagaatgactgtcctgagtcttaaagggtgagaataataggagagagtattccacacagggaaaaccacaggagcaaagggatagcatacagaaacagtatgatgtgcctggctctttataagctatactccatcttcttagagcctgacacaattgagctggtggcagagagagagaggaggctgcagtagctggcagagtctggtcacagaggcttgagtttttcttgaggacaggagggccctgttgaaggatattcactgtgaaggtgatggttagtcagatttccagtctagatccattaggaaagcagtgtactgggttgctctaacaagtgagaggggagccgaagggaagggttaggggcaacttttggaatttttatgattcagacttctacccagtaggacaatatttcagcagggttatgcatgtttgttggaaatgaacacctggactgattgattctcagtttaattgtggtagtcattagtgctgtttggcaaatatcccagttctccactttcaggcacatgtataaacaaatggtaggattgtattttctggtccccttgtgtgaatggggtcacatgaatagttcaggtccaggagttgtaagaaaagtgatatgttactttgtaatcatatcactgagttgttgctgaaagatctttcagagcttgctcttttccctctgtcacagtgactagcatcgttccagatagagttggctccatcagctgggtcctgcagtacagatgacatggagcagaactcccagctgactcttgattaacatggagcaggagtgagaaataaaccgttatggtttttaagccaggggtcagcacactttttctataaagggccagatagaaaatattttaggcttttagtttatggaccatgcagtctctgtcacaactcctcaactctgtccccatagtgggaaaacggccataggaaatatgtgcacacatgggcatggctatgttccaatcaacttttgtttacacaaacaggcagcaggctgcagttgaccagcaggctgactcctacttaaggcactatggtttgggggctatttgttaccaccacataatcaagctattcctgactgatactttgcccaactagcttttctttttaaatacaggtaaaatttacatagagtgaaatgcacagatcttatgtgtgttattcaatgatgtttataaatgatgctatgtgatgtttaataaatatatacatattaagtatatgctttattatgtatcataaaactatcccattttatgaatatagaattcattttcttgttgatggaaatttggactatttatagcttttggtcattatggataaagctatgagcattcatgtgaaaatctgtgtagatctagatttttatttctcttggataaatagctaggagtataactgccagatcctggagggggtgggtagatgtaggtttaaatttatgaaaactggccaacagtttttcactgtgattgtgccatttatacttccaccaggaatgtttgagagttctacctactctacatcctctccaacagttagtgtcgtcagtcttttgactatatttattctattaggtatgaaatggtatctcactgtagttttactctgtgtcttcctgatcactaatgatgctgaatgtattttcatgagtttactgccatttgtatatcaacttttgtaaacagactgttcaagtattttgaccatttaaaaaattgatttctggtcctaagtcctttgtcagatatctatatatctacatcctatgtctatatttatttatttcaaatttttcttccagtttttgagttgccctttcacttcttaaatggtgccttttgataagcagaaggttttattttgataaatacctatttatcattttttttttttgttaatgctttctgtatcctaagaaacctttgccttccttggggttgtgagatattctctatttctttttattaccttgagttttggcttttatgtttaggtctttgatccatgttgaattaattctcgtgtaggagagttaagaattgggattctggctgggcacagtggctcacacctgtaatcccagcactttgggaggctgaggcaggtggatcacgaggtcaggagttcgagaccagcctgaccaacatggtgaaaccctgtctctactaaaaatacaaaaattagctgggtatggtggtgcatgcctgtaatctcagttatgcagaaggctgaggcagaagaattgcttgaacctgggaggtggagttgcagtgagccgagattgcaccactgcactccagcatgggcgacagagcaagactctgtctcaaaaataaataaataaaataaaataaaagaagaaaaagaaaaagaattgagagtctgtgtgtatatctagttgtttcagccccatttattattttcaactacactcccccattcaattattttggaaactttatcaaaaatcagttggccatgaatgtgtgggtctattattgtgttatctgctctgttccattgacctatttttctacctttatgcaattaccacactgtcttgactactgtagctttatagtaaggatttaaattaaggagtatgagtcctccaaatttgtatttcttttgaagcatctttcacctgttctttgggtttccatataaactgaggtcctttgggtttccatataaattgagaaccaccctgtcaattaaaaaagcctgtggggttttgattgggattttattgactctatgaatttgtggaatgttgatatcttaagtttttcaatccataaatgtattacatctttccatgtattcaggtgttttgtgtttttttagtggaggtcttgtacaactttagttacttttattattactttgtttctgatgctattataaattgaattaaaaaaatcattttccagttctttgcttctagtacatagcaatattgatttttgtatattaactttgtatctagcaaccttgctaaagtcacttactacttctagtatttggtttttaaattcatcaggaggttttatgtaagctattacattgtctagaaataaaaagttacttcttcccaattttatgtatttttttcttgttcttgtcttattgccctggccagaggttccagtacaatgatgaacagaagaggtgagaacagacatctttgcctcattcttagtattagaaggaaagtttttattattttatcatatgtattatctttgatgtagaagttcttacatgccttttatcaacttgaggaagttcccttatattcctagtttatcatgaatgggtattgactttttctgatgcttttcagcctctattgattatatgggttttctcctttgttctgttattaataatatggtaaaagcaatttgttgattttcaaatgttaaactcaccttgcagtactcagatgagcatcacttggtcatcatgtgttatcctttttgtatatttctggatacaatttgataattgttattattttttgagatagagtttcacttttgtctcccaggctggagtgcagtggtgtgaactcggctcactgcaacctctgcctcccgggttcaagcgattctcctgcctcagcctcccagttagctgagattacaagtgcctgccaccacgcctggctaattatagtatttttagtagagatggggtttcgccatgttggccaggcttctgttgacctcaggtgatccacccgccttggcctcccaaagtgctgggattacaggcatgagccactgtgcccagtcaatttgataatattttgttaaggattttttagtctatgttcatgataaaaaattgtggtaattttcttttcttgtaatatttttgtaagatttagggataagggttatctactggcctcaagatgaattggaaagtgttccttcctcctctgtgctctgaaagagtttgtgtaattttgggttttttttcttaagtttttgatagaattcaccaatgaaaccctttgggcctgtcagttttctttgtagaaggttttaaaaattattataactttaatttaataaatatagggtgactgaaattttctatttcttcttgtgtcagttttgttaagttaatttttcaaggaatttgtttacctaaatttttgaatttattcgcatagaattatttatagtgttaccatattatctttttaatatctgtaggctctgccattataccatttttcatttctgaattgttattttagaatttttctcttaactaatcttgctagggggttgacaatatttttagcagctttatttgaggtacaatttgcattacataaaattattttaagcatgttcttcagtgatttttttaaaataaaatcatatagttatataaccattaccacaatccaatattagaagatttctgtcacccttaaaatcccttatgtccatttgccgtcactctctattcctacccccaactctagataaccaaaacaagttactgttacaattgatttgctttttctagacattccatacaaatgaaataatacaatatgtggtgttgtgtgtctggcttctttcgtttagcataatggttttgagattcattcgttttgtggcatgtatcagtattctgttcgcttttattgctccatagtgttttattgcatggatatagcacatttagtttgttcatttgtcagttgatgatgaacaatgctgccataaatattcacatataagtcttgtgttgacatatatttcacttcatttggatacatacctttgagtcaaattgctgctagactgaattctaaaatgactgcatcttacatttatgccatcagtatatgaagattccaatttctctacatccccccaacatttgttagtgagtatatatttttattttagccattctagtgcatgtgacagtgtatttcattgtagttttaatttgcatttttctaatgactaataatatagaacatttccatgtgctaattggctactcatatatctttttttcaaaaaacattcaaatcctttgccccttttaaaaattgaattctgtttttattactgagttacaagtgttccttgcatttttgtggatataattcctttataaagtacagtatataatttgtaaatattttctcccagcctgtgggttatcttttcatttttttatggtatgttttgatgtgcaaaagtttttaatattggcaaagtccaacttaaccactttttgcttttatagataatgcttttggtgttacatataagaaatccctgccgaggtcatgaagatttctctcctaagtttatcaatattattaatatttcaaaagaaccagcttttgcctttgttaattttctctattgttagtccaatttttatttcattgatttttcttctttttacttactttgctatttttctagcttgttaatatggaaacttgtgattttaagcttttcatgttttctaatataagcatttaaagctataattttttctcttaactataatttgcgctgcatccatggattatgctatgttgtgtttttattaatgtaacattaaaaatgttttaaacattttcttgtgatttctttttacatccctgatgttttagaagtgtatagtttaattttcaattatatgtgttttctagatatcttttttgtcaagttctgactttattctattgttgaccctgatctgatcactatatacattacatgttttgaagcatcactatgtgctccatgaatatgtaaaatggttgtcaattaaaaaaacttaaaaagaatttaatttagatatttattaggacttattttaattatcattatggcatatggtctatgttcatgaatacatcttgtgtacttgaaaatgtgcattgtgcaatttttggatatagtgttctaaaaatatcaattagattaatttattcagtagtgtgtccacatctacagtatctgtactggattttgttttattaagagtttctgtgagttctgagagaggcatgtttattctttatccacaggcatgtttattctttaaccacaattgtggatttatcaattttttcttttacctctgtctagtttttgtgtcatctgttttcaaactttgtatttaagtgcacacatatttatgattcgtatgtcttcctgattatcatcatgaaacaccatgtttaaacctctgatcatagtctctgcctcgaagcttactttgtccaatatcagtgtagccataccacttttttatgtgtactttttttgcagcctatatatgttttttatcctattactttcaacctaatttggtatttatattttaaatgcatccttgttgattgcatttagttggatcttggtgttttattcagtctgataatctttttctttttttttttcttttgaaatggagtcttgctctgtcacccaggctggagtgcagtggtgcaatctcggctcactgcaacctccgcctcccgggttcaagtgattctcctgcctcagcctcccaagtagctgagatcacaggtgtgtgttactattcctagctttgtgtgtgtgtgtgtgtgtgtgtgtgtgtgtgtgtgtgtgtgtttagtagagacggggtttcagcatgttgaccaggctagtcttgaactcctggcctcaagtgatccgctcaccttgatggagtttatgaaaactttttgatcagcatgttgtttttttcccaaattgaagggaatttttgtccgttatttgttcaaatactgtttttgccttattattctcaccccgattacacataaattagatcacttgatatgtttgcacatttgactgtaattctgttattttgttttaatcttttttctcctctcatttcttcagattggataaatattttgacttcttttcaagtattattgatctttcttcaagttgagtggtccttttttcccccttgacatttccatttgctgttaagaccatttatcaatttcttcttttacctctgtctagtttttgtgtcatctgttttcaaactttgtatttaagtgcacacatatttatgatttgtatgtcttcctgattatcatcatgaaacaccatgtttaaacctctgatcatagtctctgccttgaagcttactttgtccaatatcagttgtagccataccacttttttatgtgtactttttttgcagcatatatatatattttatcctattactttcaacctaatttggtatttatattttaaatgcatccttgttgattgcatttagttggatcttggtgttttattcagtctgataatctttttcttttttttttttcttttgaaatggagtcttgctctgtcacccaggctggagtgcagtggtgcaatctcggctcactcaaacctccgcctcccgcgttcaagtgattcttcaagtgaatttttcatttcaaatattttacctttcaattacagaattttgtttgatgcttttttgtagtttcaaattttctgctgatattcccctattatgactctctttccttgaggttcttgaaaatatttattataacttttttaaagttcttgattcctcattcaaacatttgggttatctcaaaatctgtttctgttgcctgatttttcttttgactgtgagtcacatttttatgtttctttgtatatgtagcattttccattgcgttaatatgttgcaaggattctgaattctgttatctccccctgaaaagttaagacttctgttctagattaatttttgcacctactggctgactaccttgaacttgggaaagtttgtttgtacactttgttagggaagctctgtttcaattttgcaattgatcttagtgtaaatttgtaatcctaaggcatacctgcactttaaggtgtcttccttcaggagttttcatgcaaagcttaaaatatttaccaagcgccttcaccatgtcagaattaaaactccagaccctgactttttaatgatggacagcttatgaaatatttggtagctttttcagcctttcacctgtttgtttctgccagactacttggacttccctcaagcatctactgttcagggataagcccaggatttgtgaggagatgtatgcagatttcctccctctgtcacctgttctgttctggtatttcccttcacaatctccaaccgctttggcatccctgacatctggcttttcaaggcagtgagactgaagctttttcttgagttctggctgctgtgtccagtgcagactctggagtggcctcaaggggaaaagccatttaaacatagatatcacccaatatggttctcttctttcaaggccattggattgtcttctgtttctgtctgcttttggtagctttccagtgccttctattagttgtttatatttttccaagagtttataatttttaactctttatgcatctgcctcctacatgagggtctagggaagagatctccaggtggaggaaagagcaaatgagaagccctgagcaggactgagatgaatgagctggggtggaagctggaggcccatgggctggaatgaagtttacatccagggatccctctaagccattgaacttcggcatttgctctgagtgagagataaggagctgtcgaatggcttccttagagaaaaaatgttatctaattttttgccttgtactctaggaaggcaagagaagaagcaggtagaccagttaggaggcagttatgactggtaagagatgatgatgattgatctgggtcaaacaaaatgatttgttgagagcttcgtatgtgctgtgtatgatgctacccacctaagctaagcagctgtgttcccaatctccttcttgccttggcaggggacacagcttgaggactctcttgctacatagaaaaacacatgaggctgagcatggtggctcatgcctgtaatcccaacacaggcatgctgaggcaggaggacttcttgagctcagaagttcaagatcagcctgggcaacacagggagaccccatttctacaaaaaatttaaaaaattagccacatatggtggcgtgtacctgcgatcctagctactgaggagcctgaggtgggaggataacttgaacctgggaggtttaagctgcattgagctgtaattgtgccactgtacttcattctgggcaacagagagagaccctatctctaaacacacacacacgcgcacacacacacacacacacacacacacacacaatagggaaggaaacttgattaaggaaggccggtctagcataaagctttgggtgaaggatttacttgtgtgtgcatatagccacatacctagctgtgtaagtcattacaaatgtcacctggctaatgttcattaatgattagctaattataaagctgccgttctgtccttggactgatagctggtttgttttacagaaggcagtatctttggtagagttgctttatcatatcaaaaagggtagtgttgttttttttttcttagcaatagcttcaagaacgaagaagattaaacaaacactatcgaatgaaagaaccaagcccagtacctggcacataataagtgcgtagaaagcattacttgaaattagatttactgcttttttgattaaaaaatactcttccaatttaatgtcttaagggttctctataaagagtacaaattataagttaaataaacactatattggaccaaaatcagaagtagaaacttgcataccttctcttgatttgttaattactgagaagttatttgtggtcttgacctgatgcatgcattaatacattatgtgtgtgtgtgtgtgtgtgtgtatatatatatatatatatttttttttttttcttagctccctttacttctaccttctctctttcactctctccttcctcccattcctcctatcatttattgaggactaaccaaatgttctagtcactgttctggcacttgacgtgcagagcctcctggtagccttcagtttagtgcagtgattgagagcacagcctgagagctggacccatttgcattccagcccagcctcagccccacaagctgtgtgatcagaggcattttaccaaacctttccaaggcttggtttacttatctgtcaaatgaagatggtggtgcagttttcaggctgcaagtgagtgtgtaaggtcacttagctcataatatggtgacacatttcacaggtctcatgatcagatgaggaagcacatagtatcattcggccttttatacaggtccactggttacctgttcttggtaacagggtgaaggctggggtaacaagtcctgccgggagactgtaagaggttgcatggcactgtgggtcagagtagcatggatccagaccgcctgcatgtacattctggctctgccacttattagctgtgtgccattgggcaaattatttaacctctctgtgtttcagtttcctcacctgtgagatgggttagtaatgctacctattgcatagaactgcagtgaggatgaaatgagttgacccatgcagagtccttagagcagtgactggcacttagtaagctgcatagaagtattgtctattaatacttgcattgattgtgaaacataatttagcattgctaagaggctgtcttttcaggagcatggagtccaagtgcccatttcctgtacatttggctcagatacccacccctaaccactgcacgcagtctcttttctgtctgagtgggacacatctctttcccctgcagcacaatcactctgcctcccgctccgtcctggtctgccatctgctgacccattcgctgctcctgtcacgtcaaagatagcgtggcctttgtggagtgcccaggcagcgtgtcatgtcccagcgctgttgtacatcttgtttcagagatattttgctgtaatgttctgtgaccttttccattgagtgaggtagttggaaaggcactcagtaagggaaaattgagctgttttattcctccccaaggaggctcctgtttcctttccaccattcatttgaaagctatcattttcttgattttatagctgaaaaacaccattgattcactgggtgttagatgctaagagttctcctattgacatgcctattgacagttttcagtatattctgcatctaattatcactcttggctaaatgatacaccttgtggacttgagcgatggagtcgatagctctcaccacattgttctagtgctgcctattgagcctggtgtcacggcgatgtgatttatgtgatcagaaagaaaattcctgttggtgtgctgcataattaaagcaagcgcagagtgactggtgacaaaaaatcaggcctgccgatgtcaccccaaatgaggagagatttctagagtaagcagctgtgacagtgaagaatctctcttggcatcttctgctttgcaattttcaagggttcgattttcctcctggccctggctgagggctcctcttctctcccttcctgctgcattgtggtcagagcttcagtacctgtgtgctgccattccgaggcctgggccgtggggcttgctctgggaggggctcattgttgcagacaggggctgttcatagaatttgggctggcagcagcccacatttgcaggtagggaagatagatggctctaaaatggcttgtcctttgtataagctgttttgagtttctgaggttgagattaaatgttgggaaggccattttccctgtgcatgagaggagtggtccctgcgttgacatggcgggttctgagaggagttgatggtggtgatgctggccagccttaggcaggactgaagtgcaggtggctgacaggtggcaaagactgggcatgtagtaagcaaacaaccctggtgtgagacagtgttccctgtgaatcccaccttctgcctcaactactcctttaccaacactcttcccagagggtcttcagaagatccgcgcagtcaaggaccttgccttcttcaatgctggtgtggcgatgattttctgtgaggccagagtcaagtgatctagcctccatagactagtgtgttctccatatctgaagtgaacggggttccttttagccctaaagtactgtggcttagtgagttggggcttggaataagggttggagaaagtaatggtgttcatctgagaggtcccctgaaggaattcaaaggccaagctgccactgcctgagaggagtgcttcgtgtgtgctgctgatctaagatgtggagcctctggcttcgtatggcactgaaggaaccttggaggttagaatatgttagcgagatatttaatgagacatatgaacagaacatctgaatcaagccaacagagtagacatttccaggcacctgagttgggcaatgaatttggcctggtggctagcaaaagtcatgagtagaatggggattgggtgttggtgggtggtttgggccatgcaaaggagtcaggattctgagattttgggtagctgagattgtgacaagagggacttttgaggtcagtgattctagatgggttactttcctggaagccatatgccttgtgtgggcactattactatcaatttctacttaatgaacctctgtatgtggcacttttggggttcagtttttccccatgcacaaggccagagagattttgtgacttgagttcccgttttcatcattgggattttttaatataaaagttttgagactactcagtgttgtatttttgaggatatactgatactttataattaggggttgtgttaggccattcttgccttgctctagagaaatacctgagactgggtaacataagaaaagaggtttaattggctcatggttctgcaggctgtacaagcatgacatctgacatctgcttggcttctagcgaggcctcagggagcttttactcatggcaggaggcgaagtgggagcagcgatgtcccatggcaaaagcagggaaagacagagaggcaggggggtaccacacacttaaaccacctgatctcatgataactcttactcacttttgagaggacagaactaagctgtgagggatccacgcctatgacccaaacacctcccaccaggccccacctccaacactggggattgtaattcaacatgagatttggatggggacaaatatccaaactatatcaagggcccatagtgctttgtcttcgacactgagtgaaccatggaatgcgtcagcattcttgagaattcatatctcttgtactttgctttagttgttcatgtttatttatctggactagttctgaaattgtcaatgattctgggtaaggagagatattcctctgtaactgtgaaggacctttgaacattctgataggattaatgattttcttccagtgtgtctgtaataatcactaaacatgtctctgtgaagactccttagtacattaaagtattgttaatgcaacagtaccaccagaagactctgggtgattgatcgggataaagttgatcatctgtctgttaaagttcttttttttttttttccattcttgacaagtggttcaacttagaaatcccgagtaccccttacaaattgcaggctacctcaatcacctgtgattacagaacatggttggtttgctgtgtgctaggacccccatgtcttaaccacagttgatttattttaaacactggaaattgcaaaaaaaaaaaaaaaaaaccacacacaaaaaaacctaccttgggagttctttgaccccacagttcttcctattctatgtcttaggctcttaaagtgcttctcctttctgcatctgtctttccccaattcagaaggtacttcccgctggcagaggcatcactcagtaaatttcagggtagcataagaattgctctggttacgttgatatataatttaattttccccagactgcctctggcctctgcctgtttaagctctggaatccctgtggggggtgagtgtgcagaatatgttctcacctctcaattcattgtgactttagctggaggtcggtcctgttgctgttgttgctctgcatcccagcaagtagaagcagcatgtgagatggagtgagcagtaggcatatggccagggtttgtgtgtacagagggatgcagcacagggagggaaagcagcattttccctatgggactgtcaagagaagtcgagcccttccatggagcacagaggcacagagaatcagacagggcatgggcctgggcagcctgaggcctgcctggtgagcgatggggcaggatggctcacatcgcctagccgttggcaaagggtctaaaattcagtgcttcccccaagcagcctagctccttcaaatggcaaattattatttttctgttcttttctgtcttcgggattgtatttgcatctcaaatgtgtgtaaagggaattttgcacattcgacaaacttttactttaaaggcagcaggttggagaaaggagctccatcacattaaatgctggctattgtgcttttcattcagcttgacgaacagtggccgaaaatggcaggggattaaactgatgtaatgacaagaattcatataagaggctgtgggaatggggcagaagaatgctgaggctttgcagtattatggtgttctttgatctgccgtagatggaaaacataatgtacctgtatttatgttgattctaaatagggagtgtgtaaacagaggcatgtcattttccctgcagccttcaagttgaaattacacagctaccatttctgagcaatggacatatttctgagtaatgagttaaatgcagtttttgaatatttggatcttattgtacatcacaataagagcatttttgttgctcaattgggttcctgttacagaggcacacagtatgtgggcatttgtggattattcatttgctaaagggcattcttcttatttttaggaaaattcacctttgtcttggggaatttaagcaaaaacaactgcaatcccgaatagaatgaacacctccttttttcagcctcattctttagtgtgggagagccgcagatgagatgtccctgccttctggagaaatacatatgtgtctttcatctgggaaatgtctttctgggacagcaccagctggaagatgtcacctgggatgaccaaagacttgatcaattgacaaggggagcatcaaaagtggctgagaaccatttatgtttactgtgtttgaaagcactttggagggcagggcgtgcgtctcgtgcatctgtataatatgaaagcatgttttgtgaggcacatcttaacatatggttccagaaaaaggaaggtggtgccctgcactcaaactttttcttttctatacatagctagaaagtcatctttctataatcatttgaataatgatgttcacactttttttgttgttgttgagatggagtctcactccgttgccaggctggagtgcagtggcgtgatctcagttcactgtaacttccgactccttggttcaagtaattctcctccctcagcctcctgagtagctgggattataggcatgcaccaccatgcgcagctaatttttatatttttggtagagacagggtttcaccatgttggccaggatggtcttgatctcctgacctcatgatccgcccacctcggcctcccaaagtgctgggattacaggcatgagccactatgcctggcctgatggtcatactttttaaaggcttcatgaggaatttccctaatttcttagaatactgctttggtcatctccacaattatggtaggaaaatgtggactcaaggccatccacagttttgactgactctgctctgcacagaagcccctgggccagaatgtctcacctgccattagttcccatcccagcctcacatttgtgcctctatggaggctgtgccttctactagaggggcccacccttgctggcttctgcccactagctgctgcccatcctctgggggtcagcttgttccagctcccccaccaccttccctgcaggcttcatagccacctccccagagctgagtgtgtcctgtcagtagcactcggggaggatcagccaccttgctgccaggtggcctctgcatctcacctgttgcactcttagcgtcagtgatggagggtaataacactaatgataatggtaataataaaatcatttattcagcctgcttttactgattgcctgttgtttgctacgggtgaggatggagtggtcatcaaaaagcagacatgggccaggtgcagtggctcatgcctgtaatcccagcactttgtgaggctgaggcaggcagatcacctgaggtcaggagttcgagaccagctgatcaacatagtgaaaccctgtctctactaaaagtacaaaaattagccaggcgtggtggtgtgcacctgtaatcccagctactcgggaggctgaggcaggagaatcgccttgaacccaggaggtggaggttgcagtgagcctaggttgtgccactgcactccagcctgggtgacagaatgagactctgtttcaaaaacaaaaacaaaaaaagacagacatggaccctggattcatggcacttcatgttccagtgggaaggatagaccaaccagtagtcactcacgtcagtggaaggatgttgactgacaggtggtgcgtgacactgtgagggcttgcaaaggggcatgtgaaccattcaggaggtcagcgaaggctttcctgaggacagaaccagctacataattttcagagtccaatgctaaatgaaaatgcagaggtccttgtttaaaagttattgagaattttatggtgagtggtggcagcagggtattaaatcaactgtggggtccttctgtgcagggggccttgtgtggctatgctggttgcattctcatgaagcgggccctgcctgaggagtgacatttgagctgagatgtgaggggagaagagggtaggaagatggctccaggtggacgaaacagcatgagcagagtctctggcaggaaggaggttggcacattcagaaatgatgaaggggccagcgtagctggagttcagagagcaggtggggcatgacgaggccagggcagtagagttggtgatagggaaggcaaagcagaaccctacacagctacttaagtgtcctgagcagggagctaaagacactgggtttggattttgcagtcacactggctgcagtgtgcagggcagactgggtaggtagcaggagcgaaagcagggctgttcggaggatgtcagagctgtccagttgagggagggcaggggctagtccagagtggtgccagtggagggagaaggtgtgcaggaatattgaggacacccaatattgggcatagtggagctgaaggaacaaaagacgccaaagatgacatctagattctggctttgaacccctgagttgaacctcatgaaatcaccaacattctgccacttttgatctgcagaaataccaatttcacacaacttgttctgatagatgggtggttggtgggacatccctttacacgggaatgcttagaggatcagaggggtttgctttgtttttgctttggtggtggcagctatgagagacaattacaaactgggttctagacacagtgagcttgaggtgcctttgcaacctctaagtgagggtaaggaaagaggtggactatatgcatctggagcttagaggaggtgcctgagcaggagatacagttgttggagcagatgctgtatagacaccttatcagggttaccctgtttaaaacttgcaaacatcctgtaaagaatgtactattgtattcagtttccagatgagaataatatggctaagagaggttaattaacttgcccaaggtcacacagccaccaagtggaggagctgggtccagggcccaagctcctaattactgtgcctactgccttctcagtggtttcctcacatcaggatgcacagctctttgtactgagtagatccttaggaattccttattggataaatacatttaaaatatttggtggaaataatgatatcttcccttcttaataggagattcttgaaagaggtcccaaggccccaaagtgtcagcaaccatagatggaatttacatggttgcctgtctggttattctcatcacactttcctctccttcatgggcaagctccacccccaccccttgctgaggtctgaactttgtagagagcctcagttgtggtcatagcaacatcttgcagatgaatccattaatgataagttaggctcctcctctagtattcttggggtgaattttataggattttgacattttagggctaacagctgcctcaggtgctgctgcgctccctcgggaacccctagggcacattactaaatcttgctgggcctaggcacggactcaggatccttctcaacatggtactcatctcattttaggactgagggcactgagatccagagagatgttacttcaacaatcagttaatgctagaataaatctgtttgcttattaaatcaaataaagtagattctagttcagtccttttacaggtaaggatgctgagggcccgagaggcagtgacttgctcatttctggtggagatggagctcatgctcccattcctacctcccatctagtcagtggtccctccttgggcctggaacacacggcaaatccacttgctgtgttggctcattcagcaaaacggagcacatcttgttgtggacatgcatttttcatcagctgttcctctggaacttccctcatcatgcttgtggacagtgaattgaatgatgtgaattatactttattaggattgccttttgatacaagtatttcttttaggctgctttgtgcccgctgtgatgcccaccctggattttcttccctttgcccttgacgttgaagtgaaacatattgtttccctttagaatgccattaaaagtcgatgatgacctttacagtgactaatagtttctaaggggctttaattgtgattttttttttttttttttttttttttttttagcagagcggcattagtttgcttcatatgtcttttgtatcagggaatcaataaaaactcctgccttttgttgatgctataggatattttatgccgatgacaagggatttgatttaatattctctttaaataagatcaacactgctgcagttataaactcttcgaaaaactgtcaagcccgtcaatgtagcatgaaacaaaaagttagcagcctggtataaattagcacgtacaatgtgtctttgggaagggtggtacatatttacgattgtgtgttaaaatatatatatttagagatttctttctgctctttcgaccataagtgggaaatgcagagaggaacatttcattaccaccaccttccaaaccgcaaactttctttgccagttaatgattttctggggcaattctgaacgtggtgacatgatataaacaggtatttatgatctgtgatacaattcttcgtgagtatggatttatagttaaatggtgcagtgggaatccagccagagattattgacagagcttctagaatccatattttgtctgtttccattattcacatacattttcttttgagttctgattatctgtgtagtctgtgtttcctggtttacttgagaggtgagcataagactttgaaattcaagggcatgtgttctatatgcttgggggccatatgttctgtacatcttgaccctgcacctcttccccaatatcttgccattttcattcaacagcgattaggttatgtgattagatcattccatctctctttggctttgtcccagatgaaccaaagtaggagcagagctgatggacaagaaatgtttggggtgagcacatgggtacagtcgtggcagtgtcagagacctgggagagtccagagcttcctagatgagagttacacggctcctgggacaaagtgaggctttttcagaacagcagcagacaagtgagggatcactcacgggcaatgtggatcatgttagcaggataggaatggataggcaagagtctgaggggcggcaaatctgagatcaggtgatccagagagaaggtctgccttgcacactgggaagattgcagtggagctgctggtggcatcaggagagccctgggaggtcactgcttccatgactggaggaggtccactcagagttgcttccagtgccgacccacggggagaaactaccagaccagagtttcttgaagtatcttccctggagggtctacatcttaatcacttgggatttccatcagaatctgttgtgaggaagctgagaatctgtattttataaagctccccagctgatttccatgcaaaccaataaagctttgaaccatcgcttcacacttaaggagtctttccaagttagaacaaacttaggtctcctttcattttttccgaaagagtttgggtttatatctggagagagagtgatgctctttggacgacgtgggacagatacgcgttactccacaggtccatttgagaaagtgatatttgccagaaaatatacaatatatgttttgtttaggttatatttgttgtattatagatacaactttacatgcagtttcagatatccaaattccctgatcgtgaactccctgttgaaagctcttggttggaagacagggttatattaattcttgctacctttcactgattaccctatgcttgctctaaccatttgtgttgaagacaggatcaagatatgacctctagttactgtcctagaaaaatctctgctgggtcaaaatgctgaatcttcattatgctaataaacaccttgatgaaaatcgaagcatgtggtccccattccagccaataaatccatttgtcactattggaaagcattgtaattcttgaattcccatttctgctttcatttgaatgtttgccattcttccttttgccttagtcctacatatgtgaaccatttaggaatatgatttatgcaggaggaagagtgaagaggttccttctggacactgggcccttgaacttgaagatcctgcttttctgtctggaagacatggccctaatatgcagtggctcaccaaagcaggtattgatcttgttttcttgagaattcttcataggcatgagtcactagccagaccacacatcagctgtcatctgcccaacatttttgtcattttggaggagatgagtgcaaactgagaaagtctctctgcttgtttccctgggtggtacttatgctgtctgaatgttcctttctggaatttattagttagtgattttcttttcaataaacacttgtagcatacatactagtgtgctctcctaaagggggaaataatttggcagccttatcagcatgttattggactttcgttttgtttgtaatcttaagacacctttttcccactcagccattcagcaacattttcccttccccagccttggccccgccacctgaaacattcatgttcttcctctaagacagaataccaaccaagtgcaggcagccggttgacacaaccagatcaaaaggctttgaattctgaaaatgattcccctcttggtatcaagcccagtgataaaagcaaagcagttgtcatcttgaaaacagagctgtatacacagcagagcctttccaattagcacacttaagatgcgtgttagaaatgatgggaagtgggatgttacagagtgaaatgcaggtaatagggctttaaattttcatgtttcagttgatttttttctattgcagttttaagaaaatcgttgcacattattgaaactcctaagtgcatcttaccattgctcttctgtttacaataatatcttccaaaacaacagaaatgttggtcacaaaaaagcttgtacccattggttttccaagtagaggaagaataatctattattcaaaatttccctaccatggatgaacaaatcagtttaggtggcttttctgcctgctaccagccaactacttcaatggaatccctgaactgaacaacctggcatttttcatgttcactagactcaggcttagaaatggagcctcctcacaggatccacacaggcatatggagaaattaaagccaaatgtccagcaaaaaccaatgggtgtgttacataaagataccagagttatttaaatatgtaacttactcaccagtatgtaggctgctagaagtcaggggaaacctattaattttgaatctctggtgtctagcatggggcagcatagagtaataattacagttgtggtggatgtgattagtactcaccaatatttccagttcccctctccttttgtgtacatgggagaattatgctttcctttcctcttgaagtgagatgtgccttgctttggtcaaatcagtgggagcagaagtgatttgtgtcacttctaggtataagcatttaagacctagtaaatggcccttctgttatggtaaaccctaaagccttttattgagaaaggagcattataaaatgttggagactctgttagtttaggtcagtgaataactacagtcaccagagcccctttccaccagccaacccacactggacatgtagaatgagagagaattaaccttttgttagtttaagccactgagatttgggacttgttattgcagccaaaataatctaacatattttggctgatatactaatgaacatttattcagtgctgtgtgcttcaagtatttttatgtattaattcacttaatcatctctataatcctgtgaaaaagatactgctgttatcaccattttgcaggagaagtcacatgggtgatgagatgtttagtcacttgcccaagattgtatctctagtaaggagcagaactgaaatttgaacctaggcagtctggtaaataataaatggtgaatgagaaagtcaagatcagagagtgctttgtgatttgctgcagctatgatctttcatgtgacatcattggaggaggtaccggtcagtgtcatctatcccagatctctctgctacctgtcatttttccattatggtttcttacttttaggtcttgaaagttttcggctttctatctgcctatataattcacatagtgctatggtggacaacactctgtaatggtttttggaaagctaggtactccacaagagtgcatgaagcgtcagagaggaggtctagaactctgggagagctaaggagcaatcaaggactagagctgccctttggctgagggttccttcattaagactagtgactgccatgttgtgctgtgagcccagagaagacgagcatcctgtgggagttcccacctgtggagttcatccagcctttccaagcagtagtgggagataggatgactgtgggtatgctcaactgtttgttgcttccaaaagaagatgagggccaatttcccaaaagggtaaaaggaaagaagttgtggcatagtctgagaggctcaagaggtttgattttgctcctttgttctaatatggtttggtcaaggtggtttggtgaagctttagggaacttcttattgtaagtaacagaagcccattcaatgttgtttaagcaaaaagcaggatttgttaaaacaatgtaaaatatagggtcctcttatggatccccaatcctggatgtatagcgagtcctcatggaggactggaacaagaaattgggaagctctctggaggcacagctccctcttcaacttttggaggttatgcaaaacttctctcaattttctcagtacatttcagctcttctacctggttagtattctctgctgtcataggttcaagggcaaacatggccatgatatagtacctgagcttatggatcttcagttcaaataaccatgaaaaagtgattagaaactttaacttccaattcaacaaactgggaacagaaaatttgatccacgttgcatggtctactcctggcctcatcatcggtagtggtgggatcatatctgacatttgttcagcagcatatgttgattgcctaggatgtgacaatcactgggttatgtgctgaggatgtggaatatgaataaggcagtgcctctgtcttttagattctcctgctgcggaggggcatgtgaggccagaactcaacccaagggatccaattggacccatgcctaacagttagaaggagccacattttgttttaatataaggaggttttaatagctactattgtgagatggtgaactcaccgatgctgaaattatttcatctgagataggatgatcatctctgtaacaggatgttatctgaataattctctcctcttccagcagattagaccacatgacccttgttctttccaactctgtgattttaaaataaaccatgtgatacagtctgtagaaatgaagggggaaaatatgtgctagaagtggtcagaaaagtctctttagagtaatgaaaacttgaatttatccctgaagaaagagaaggcacatagacacaggagaaacaatatattcccagttggcatagtgaaatatgtaaagacacaaagacaatggatgtggtatgtataaaagagaagacacacatctactttgtgtctttaagaagctaaaggaaaataagcgtttgggagggtattggaatgatacaattaggaaagtggacctatagctatagtatcggagaaccagagggaacttgttttaggtagaatattatttgctgtaagagaacacccaagagaaagtgacttaagcagggaggatatttcattatctcacgtaagagtaagactgagttaaagaattaagggattgctccagcagatgacatcagggaccaagactctttccatcttttttctctgcccattttaccatcttggcttggtgcttacacttgtttcctcatagtcacagcctgagcatgatggttccatgaattgcaggtggacacaacaagatctggagaagtgagagggatgtgtctttctgtgcatccctttttatttgagatatcctttttcaaatgtcctccagaaaatgtctgtttgtgccccattggccatggttagtcacatacccacaccttagagttaggggagttagagaggaaggcaggctttgctagtaatgagggggtttgtggggtaagagttgtggggtcagccactagtggtattgctcccagccagctcttgcaggtcatcttgccccatcacttagtttcactgataaagataaatcataactgtcatatgtcaagtatctgttatacactgggaactctgcagtattttgtttttactcttggcagcaacttttccaggtagatcatgtcattctcacttactgatgaggagactgagtggtgtgtaggtgactcagatacttagtgcctagagagatgagatcttatttgaattttagaatcacagagtctcagttttgaaaaacgttttagcccagaactgccttcttctccagaggtgcccagccctaccttcaacatccctgcccagtggcaatggagccagcttttcaatatttgcagagacgaaagttttctgaccactggtccagtgttctttccaaaccggatcactggcagagcacagacctgtcatgggatagaggataactgctggttttcttctgtggttccacctccccacccctgggagggatcttttaagatactggctgctggcactagtgatgtcatggcaactgttattgcagggcacgttgaaatccattagcaggcattcaaggctcctcatgagtaaagtaggggcaatgtaaaaaagttagtttggcttccccaacttccttaatcccaagaccccgtgccaggtacttgtattttctatttgctaaatgttagttgaaacaaagggctgttttgttgggtttgtgtttccctgtggaaaagattactctaggcaaattttagaaaatgcttttaaaaagaatcttgtgtaagttgaaaacagagggaaagaaagtaaatgtcttgatggctttttattacaataaaaattgtagtgagagctctttcaattccctccctcctcccatctactaaacaaacctttgtctgtgggaggaggattatgtttaaacaagagagcaaggtgggaaagtggcattatttgagaagtcctagtgctgataagtttgtgatcagtgacttcttgagtacttgtcaagattaaagaggtgctttaaaagtaagaatttgctattggtggttgtgggaagggattacctatagatccaataggaaaccattttgagtctgtaatgtgaaatttggggagtagaggagggtaaaggaaacaaaattcaagcaatgaaaatatttctttttggtaggggaaatgcttctagagttcaattgctctcctcagatacctttaaaattgccttacctttttttgactatgataaaaggacctcttaggcatatgtgccaattatcagagattttccctgataatatgataaattttcatactccagtgaaatttggtgattggcaggtcattgggttggcagttgtggttctggtgatgtcctagatatgttggaacttgggataggtctctggaggacatgatgcaggtagccttctggtagtcaggaggaccccagctgtttctccacatggctcctaaaacaggcaagaaaatggtggatctagacctgtactgtcaaatatggtaactgctagtagccatatgtgactattgagcacttgaaaatatggcaaattgagatgtgccataagtgtaaaatacacaccaaagacgtagtagaaaaaaggatgtaaaatatctcatcagtaatcttttattttgacaagaggatgtaacaattctaaatatacatgcaccaaatactagagtgcccagaatcataaataatattagacctacaaaaagatgtagaaccaatacagtaataagggggacatcagtaatctactgacaacattagacagatcatcgaggcagaaaaacaacaaaccctggacttaaattggactttagaccaaatggacctaatggacatttacagacattctgccttacaaccacagaatctacattcttttcatctgctcatggtgcagtctcaaaaattgaccatatgctaggccacaaggcaagcctcaatacattttaaaaaattgaaataatgtcaagtaccgtctcagactagagtgaaatagaactagagatcaacaccaaaggaaccctcaaaactctacaaacatatggaaattaaataatctgatcatatgtgattgttgggtcaatgatgaaattaagtggaaaaaaacccaattttctgaaacacatgaaaatagagacataacataccaaaacctctgggatacagcaacggcagtgccaagaggcaagtttttaaaggattaaatgcctgcataaaaacatagaaagatctcaaattaacaacctaaccttatacctagaaaaacaagaacaaactagaaaaacaagaacaaaccacacccagagctagcagaagaaaagaaataacaaagatcagagcagaacaaaatgaaattaagaccaaaaaagccactcaaaggatcaatgtaatgaaaagttggttctttgaaaacataaataaaattaatagaccactaactaaattagcaaagaaaaaagaagagtcacataaacacaatcagaaaagttaaaggtgtcattacaaatggtataaccaaaatacaaaagatcaccagagactattgtgaccatctgtttatgtacaaactagaaaatctaaaggaaataaattactgaaaacatacaacctcccaaggttgaaccaggaagaaatagaaatcctgaacagaccaataatgagtagtgaaattaaataagtaataaaaaaccctctaacaacatcaaaaaaattccaggaccagatgggttcatagccgaattttaccagacatacaaggaagaactaataccaatctttactaaaactgttccaaaaattgaggaggagggaatccttccttactcattctatgaagccagcatcaccctgatactaaagccaggcaagcatacaacaaaaagagaaaactacagatcaatatcccagaagaacacagatgcaaaaatcctcaacagaacactagcaaactgaatccaatagcacataaaaaagatagtatactgtgatcaggtgggttttattccagggatgcaagattggttcaacacacacaaatcaatcattgtgattcactgcatgaacagaattgaaaacaaaaatcatatgatcatatcaatagatgcagaaaaagcattagataacatccagcatctcttcatgataaaacccttactggctgggcgtggtggctcacgcctgtaatcccagcactttgggaggctgagatgggtggatcacgaggtcaggagattgagaccatcctggctaacatggtgaaaccctatctgtactaaaaatacaaaaaattagctggacgtggtggtgggtgcctgtagtcccagctactcaggaggctgaggcaggagaatggtgggaacctgggaggcggagcttgcagtgagccgagatcacgccactgcactccagcctgggcgacagagagagactccatctcaaaaaacaaacaaacaaacaaacaaacaaaaaaaacccttaccaaactaggtatagaagggacatacctcaaaataataaaaaccatgtatgacaaacccagagccaacatgatactgaatggggaaaagttgaaagcattccttctaagaactggaacaagacaaggatgcccactgtcaccactctgattcaactggaagtcctagctacagcactcagtcaagagaaagaaataaaagtcatcttaattgggaaagtggaagtcaaattatctctgttcactgatgatataatattatacctagaaaaccataaaccctcctagaaaagactcctagacttcagtaaagttccaggatgcaaaatcaatgtacaaaaaccagtagcatttctgtacactggtaatgattaagctgagaagcaaatcaaagactgaatcccatttacagtggctaccaaaaaaacactgaagaatgcatctaatcaaggaggtgaaatatctccacaaagagaagtacaaaacactgaagaaagaaatcatagatgacacaaacaaatagaaaaacatcttgtgctcctggaatggaagaatcaatataattaaaattaccatactgcccaaagcaatctatagattcaacccaattcctgtcgaactaccaatgtcactattcgcagaatttaaaaaaaaacttaaaattaatatggaaccaaaaaaagcctgaatagccaaagcaactctaagcaaaaatataacaaagctagtggtaccatattttttacttcaaattatactacaaggctatagtaaccaaaacagcatggtactggtataaaaattatacttggaaaaatagaactgaatagagaacccagaaatattacttacctataaacaactgatctttgacaaagttgaaaaaaatatactctgggggaaaggacaccttattcagtataattttttttttcagagacagggtcttactctttcacccaaagctggagtgcactggtgagagctcaatgtagcctcaaattcctgggctcaaacagttctccagcctcagactcccaagtagttgaaactacaggcatgcaccaccatcctggctgataccctatccaataaataatgctggcataattggagagccatatgcagaagaatgaaactggacttctatctcttaccatatataaaaatgagctcaagatggattaaagacctcaaactacaaaaatcctaaaacctaggagaaactgttctggacattgatctaggcaaagaatttatggctaagttctccaaaggaaatacaacaaaagcaaaagtagacaaataagacttaattaaaccaaaaagcttatgcacagcaaaagaaacaatcaacacagtaaaaggacaacctacagaatgggagaaaatatttgcagacaatgcatctgacaaaaggctaatatccaccatctacaaggaactcaacaaaacaaacaaaccaaataacccattaaaaagtgggcaaaggacacgaacagacatttttcaatagaagacatacaagcagctaacaaacatgaaaaactgttccctatcactaatcatcagagaaatgcaaattaaaaacacaatgagataccatcttccaacagtcagaatggccattattaaaaagtcaaaaaacaacagatggtagtgaggatatgcagtaatatgcagtaaagggaattcccactcatacaccgttggtgggaatgtaaataagtataacctctatggaaaacagtatggacatttctcaaagaattaaaaatagaactaccctttgatcttgcaatcccactactgggtatctacccgaaagctatacaatcaacctaagtatccatcaatggatgattggattaaaatgtagtgtgtgtgtgtgtgtgtgtgtgtgtgtgtgtgtgtgtgtgtgtacacagacacatatatacctacttacatacacacacacacacatacacacacacaccatggaatgctactcagccataaaaaggaatgaaatcatgtcttttgtggcagcatggtttgaactggaggccatccattatccttagtgaaatgactcagaaacagaaaatcaaaaaccacatggtctcacttataagtgagagctaagcaatgggtacacatcgacatacagagtgggataatagacactggagacttcatatggtaggaggatttcgggagaaggatgaaataccacctctagggtacagtgtgcactatttgggtgatgggtgaactaaaaaacccagatttcaccactgtgtgatatatccatgtaacacaactgcatttgtgtccccaaatctataaagaagttaatttcaaaaaatattttgattacatgttgattgtatttgggacatattaaatgaagtatattatcaaaatatttttttctacctgtttctttttgcctttttaatgtagctactagaaacatttaaattatctttgttggctcatatttctattgggcaatgctggtctagatcaggattcagcaaagtatagcttactgtctatttttgtaattaaagttgcccacttgtttatgtattgcacatgctgtgactgctttcatgctatagtggcagagttgactagttgcaacagagactatatagctcgcaaaacctagaatatttatcatctggacttttacaaaagaaggttgctgaactctgatctaaataattctagaagacttggcaggacctaaaatcaatctaggaaaccctgattcttactcttgtaggtcacactcttaggtaaggaagagagaaccaaggattctcctgacactttagaggtgcttctggcttttgctccctcttattcctaaactactttatctaaacaagctgtaaactttcactcccctcctgctaagagcctggaaggagggactggagagccagcatattggctctgcatagaaggcagatttggagcattttaccacccagtggaagactatgaaaactttgctactgattcatgcatttctaaaggttttccagtggagacacagagtaagggctgaaaggtagggacaaacatatggactgacttaagaggtccagtgaccccaatgagcagccatagtacatttaaattatttggggtggtaaagatattttagacccaagaggtttcatcatcaagaacctttttcaaggaggtgtgtagacctaacaccttcattatcagctgacgccataagctttggggaatggagaagactggaaaggagatgtggaacacaggatagaaggcacaagaggctggagcttatcttgactagaccacagcccacacccgagaccgccctatgggcatgggccactggagggtaatcagagactttggtgtgacgcctccttaaaaatctcttcccactttcttctcccaaaataaatacattttctaagacaagaccctgaatcagaatcagtttttctacaaactttgggtggtgttaattcctgccaacacagggcaaagcatattacagtgaatggagttacagtattcagaatgaattatagggcgctaggcacgtgatttaccacctatagtaaacagggcttcacacatggtgtatttctgctgtgttggttagttattaactgcaaaaaaggggaaattcatttagaagacgtgctcattttttatgaggtaaggctgcctggagatgcatggcattttaaagcaaacgaattcctgggagagcccgagcttaccacccagaaatgtggcaaggaataaaaacatttacaccagtttaatatgaatggttgaagaaaatatctattgcacattgaacatgatatatgaaaccataacctactcttgtgtagtaagctacagaaccattcacctaacagattactattcgagttgacattattctgcatcttttcgatcttctcttgccaagtgctggaaactgtcagagaaagccagccagatacataggcactgttggcctgggggttgagaactcataagactcttgaaggcggaggttacccagtgacccccttgctgcaaactatagtggaagtcaaaggatgacagccaacataaacagcggctgcatgtggaacgtcaaagtcaagacaaatagaggtgggactttctctgtctcctgctccctttctagtctgtaaaatggagcttatttcctatcatctagcagaataaaaagtgccatatggctttggggggcctcagaagtgcttcttggttcattcttataacataggtggaatttgacctcctcaaaaattattaaggggtgactcttgcttaatcctactgtgatttattggctacatactggatatcaaagccaaaaggaatcgtaggagacgttttggtataactctttcttctcccagagatgaagaagctggagtctcaaaaaggttaatgaattgccaaatgtcaaatgctagttaagtgcaggactggtgctaagaatgcaagtatatctcaatttctggcccggagctcttgccttctacctttctgcttgtgtgtgcacacacaaagttgcttgcaactgctgttttctttttgggtagagtaatgaaaaatgacttttgatgtttttgtaaatttgcaaatggtctaggtcagtgtccatgttaagacaccttactcggcctgacactcctaattggttttaagattctgggcctgtggagctctttcttttaaactattaactacgaagttttatatttcaactcattcacatctactgaagtgatagcagcagttttatatgtgggcagattaatgcactttgggaattttagagaattaactttactgcccagtgcatttgtggcatatttaagtaaactagagaggccgatccttgcaaaagcaaaagatattctttttaatgtgaaatatatgggttttgacatgactataatttttagactctcaagaattttattctgatgttttgtctgacatctctaagctctttaatatcaccaaagaactcttggtttgtattaattctgtttcatttgtgtattttatgtgtttagtggtcatatttgaaaaacatctcttgtgagcgctctgtataattttggcagaaaattactttttttgtgtttctgtgatgatcccctgagatcatttttgcataaatccggccttctattttcagatacaaatctgttgtacagatgattcttcttagaagaaaagatgcatttgtagctaaaaaatgtaaattacttttcatggaaaatacctctctgggcccccatttccaaaatgtgatgattgcacatcgcatgtttttgtgcgtgctcaggggactgcttttcttataattagaaaagtcttgattgtgcagcaggtagaatggggtggcacggctgcttctgcagcataggtgagtcagtggaggtaccagaggaataagcaagagaccttatgtggaggtggcacttcactaagggaaggaggtcttagttgttgaagtgggtgtgtcatgagccttctttacaggatgggaatgttaacagaggacttttagacctggagacatttaaacacaattgccatcctctgtttgtattttcttcttgcttgtgattttttatacaggattcaaagttttatttggtctcttatggaagcatgtttggaatgaacaccctcctcatcacaagttttatgaaatagtggaggacaacagaaacctcttcctaaaatgtcttctgctcagtacaagggttagtgtttgagggactttgaggcactgctgtaaagcaaagtgcaaaaatcaacatattcagatttgtgccaaagaaagacttgagtttgagaacatttacatctgttttcaataattcctcgcatatgttgcagaatgtacgttatccatcttgttatccaggaaataacatttgttgcaaacagtttgccaattcgtaattttattgaatttgtttatcatgctgtggcttcatatgaggtctgaaagatggtgatctttggtgttccagctgttgtaacattctgcagtggggccttaattccaggatgagctggaattctttggagggtctgggctttctgagaactacagcataagagccggcattgctgatgggcaattatctttggggaacgcagtaactttgcttgtacattcctcaaccccattttcatttctggcttttaaatgtagtcttgggactgatgtgttgaatagcactccttgtgtgccctatactgtctcctttgaaacctgcccaaacttttaaactgtttttatgtttggtttgagaggatactgctccccaggaaaaaaatgattatttagaacgaccccaaactatctcagacctgaaaagaagtagattctcttcaacagagaagctaagaaatatctttttgctgcataaatattatcattttcttaaggagttgttggtaggtgaaaagaaagttcaaccaggtccaattttataattttcctattttatttagcaggcattttctttactgaggtttatattgtctgccaaaactaggaggaaaagaaaatattaacaaccctgaaagctctttcattctgaattattccttaatgtttttaatgatttattataaccacacaaatgtgatcttggggccatttggaagttattgagtttccttggagatgggacttggcattttccaaaccagagtttgcttttgtggcctggaagttgcaaggcatatatatttggaagactaaagattattccccaccaagaagttttgtcaacctgaccttctctactcttatgacgctgcacacacagcagtaatctctgcagaggagagcaaataaagtgaagaaatatagcggtacgtgttatttttacatcctaaagtaaattctccagcattaaggctgactgggaatttccatctcagagttctcatgaatgctgctccactttggtgttgtcctcttgaatctctttttattataggtctttgaaggaggtatttcttgtaatttattcagccagagagataagtgagatgtggaattggggaaacaagggggtgggaaaagccttctggggtcagctgtccctgccgttgagcctgcaggctttttttaggtgctgcagccagtcaaggtgaaggactagttcagctctatttagaaaacaagtgttatctaggttctgtgttatgagatgacttttagcacaagattcaaaagttagtcttggcaaaatggacattctttgaatgttgttggagctgaatggctctagatggtgtgctgagcccttcccatgagatgatgttccagaagaatcccagagatatgaggccatcctcttcagctccacaccaaagcaggcatccactcaaggccagctcaacacttcagctccacaccaaagcaggcatccacccaaggccagcccaacagttgaacccttccactagtaaggagcaaagcagcctggatcatggctgcacagttctcgggagaacagttgtctttgttttaatgggctgtctgtggccctgcagcttctctctactggccccaattctgagaatgcagttttaaaaatcactttttggaaagaaaaaaggaaaaattctaggatgttaaaaaataatgtttttctgatttatttttacctaaatctggtgttctgagtcaactttcaaggtcaattctgttattttaaggaataaaatatatttatttattcctgttttttcccttagaatatgttagtaacacttctaaagcattcatgaaatatcttaggtttgaaggaagattcagatatgttaattaagtctatctatacttcccctggcttgtatattctttagggtaagggatactgtcttatggcaaattttgactggtaccatgttcagcacttggcctacaaaacaaatgtttgttgttgagtggatgttgaatgcatacatttttgaataggccacttttttttttttttttttttttttgctgctgagagatgtcagttgactgcttgtatcccaacttcatcgtgaaaagatgtttttctgctattcactttaaaagcatctgttcatcccaagtgtgcagtgaaagggcttccctccttccacctcctctcatcatagattttctttgattagttatcactggatcaaattattttgcagtatgatggagtgggaagcatttttgagacctaggtcagccacttacctgcttatgagcattacttgggaaaatatatcgaaccaccttaaacgtccatttccccatctaccctcccttgaggggctgttgtgagcaaaatggcctgtgtgaagctctagtaacccagcagatgctcaggaggtagagatggtcatttcgcattattctgctggacttgaccctacatctcctgctgatctttgtgtatgccaggggtttgggccctgtctccaagtgcctgcattttagtgaacttggattctgagattccatgtacattagtacactgtattagtctgttttcatgctgctgataaagacatacctgagactgggcaatgtacaaaagaaataggtttaattggacttacagttccatgttgctggggaagcctcacaattatggtggaaagcaaggaagagcaagtcatatcttatgtggatggcagcaggcaaagagagggcttgtgcagagaaacttctgtctttaaaaccatcagatcttgtgaggcccattcactatcatgagaacaatatgggaaagacctgccccatgattcagtcatcttccaccaggtccctcccacaacacatgggaattatgggagctacaagagatttgggtggggacacagagtcaaactatatcattctgcccctgggccatcccaaatctcatatcttcacatttcaaagccaaccatgccttcccaacagtcccccaaagtcttaactcattttagcattaactcaaaagtccacaatccaaagtctcatctgagacaaggcaagtcccttccacctatgagcctgtaaaatcaaaagcaagttagttacttcctagacaaaacaggagtacaggaattgggtaaatacagccattctaaatgggagaaattagccaaaagaaaggggctattggccccatgcaaatccaaaatccagcagggaagtcaaatcttttttttttttttgagacagagtttcactcttgtcgcctaggctggagtgcagtggcgtgatctcggctcactgcaagctccgcctcctgggttcacgccattcttctgcctcagcctcctgagtaactaggactacaggcacctgccatcacgccaggctaatttttttcatatttttagtagagacgaggttttactgcgctaaccaggatggtcttgatctcctgacctcatgatccacccatcttggtctcccaaagtgctgggattacaagcgtgagccaccaggcctggccagggcagtcaaatcttaaagctccaaaatgatctcttttgactccatgtctcacatctaggtcacactgacacaagacatgggttcccatggtcttgggcagctctgcccctctggctttgcagggtatagcgccgctcctggctgctttcatgggatggcatcgagtgtctgcagcttttccaggtgcatggtacaaactgttggtggatctaccattctggggtctggaggctaatggctctcttctcatagttccactaggtagtgcctcagtagggactctgtgtggaggctccaatcccacatttcctggccacattgccctagtagaggttctccatgagctccccacccctgcagcaaacttttgcctgggcatccaggcatttccataaatcttctgaaatctaggtggaggttcccaaacctcatttcttgacttgtgtgcccctgcaggctcaataccacatggaagctgccaaagcttggggcttccaccctctgaagcaatagcctgagctgtaccttgaccacttttagtcatgactgaagtggctgggatgcagggcaccaagtccctagactgcacatggcatggggaccctgggcccagcccgtgaaaccattttctcctaggcctctgggtctgtgatggaaggggctgccatgaagacctctgacatgccctggagacattgtccccattatcttggctattaacatttggttccatcttacatttctgtagctggcttgaatttctactcagaaaattggattttcttttttactgcatcatcaggctacaaattttcgaaattttaatgctctgtttcccttttaaaactgaatgcctttaacagcacccaagtcacctcttgaaggctttgctgctgagaaatttcttccaccagataccctaaataatctctctcaagttcaaatttccacaaatctctagggaaggagcaaaatgccaccagtctctttactaaaacataatgaaaatcacccttgctccagttctcaacaagttcctcatcttcatctgagaccacctcagcctggattgcattgtccatatcattatcagcattttggtcaaagtcattcaacaagtctctagggatttccaaactttcccatattttcctgtcttcttctgagccctccagactgttccaacctctgcctgttacccagttccaaagtcgcttccacattttcaggtatcttttcagtggcaccccattcttggtaccaatttactgtattaatctgtcttcacactgctgataaagacatacctgagactgggcaacgtacaaaagaaagaggtttaattagacttacagttccatgtggctggggaagcctcacaatcatggcagaaggcaaggaggagcaagtcacatcttacgtggatggtagcaggcaaagagaaggcttgtgcagagaaacttctgtttttaaaaccatcagatctcgtgagacccattcactatcacgagaacaacacgagaaagacctgcccccatgattcagttgtctcccactgggcccctcccacaacacttgggaagtatgggagctacatgagatttgggtaggacacagagtcaaaccatttcatatactctccctagtttcctggctaaataaggtgatcacatatcataggttttctgtggctatctcattttaaagtatgttgtccttttgtcctctaaattattgaaatgtcaagaaaatctcaacaacttgatgtctagttttagaatctcccagccagccccttgcaccagaaaatagcacaaacgacattgtttaatgcatcctaattttaatcagaaaacagttatcctatttctggcatatcatggatcacctgactggtacaagagaaagaagggttttgtagggatattgcaaccacgtattaaagcctgaaagacactctgaagagcatctcatattctaatgtctctgcctattagggtggtgtatcaagaagatgtatcttgttcattggtactttcaagggctgtgatctctccataagtaagattatcagtgattggagccttttcctcctttgatgatctcttctctttttgcttagtttcccattgctgctgtaacaatttgcaacaaacttagtgggcaaaaataacacagctgtattctccttctgtccctccaaaattcacatcaatcctacgtgaagtatacattcaccccatcccaaggtcaccaaaagtttcagccattacagcttcaagtctaaaacctcatctacatctcatcagctaaaaataacaaatctcatgatctcaataatttaaatcaagtatgagtgagccgctaagtataatccattcttggtgaaaattactcttcatctgtggacctgtaaaatcagaagtaagttgtctgcccccaaaatacagtgatgggacaggcacaggagactgtttatagacattccattttaaaagggatacagtgaaagggaaaaggagtcagtcaccagtcccaagcaattttatacgtggcagggcaaacttctttaggtttcaggacccgggaataattctgtgtggcttgaggacctgcgctctggatttgagcttctacactctgggcttgaggctccacccactgggtcatccttcctttttcgtgaaggtaggatgtgtttgcagctgagtagttttatcagcctgtttcttgtctgtagaacttgcctactttacagccttctttcattttatcctttttatcccttctattctaagctgacagtatttctgctagtataacattctcaaaaaacttatggtatccaatgtatgtcatggggattcattccatgagacaaaagggtcctccatagctttttctggataattctatgtctatttctggcttctgttgagatggttgaggggattcacgagtcacatgcctaatctcttcaaagagctttctgtgtgaaagaatactctgatattttgacccttctgagttatttgccaaaggttgttcatttacaccctggctttctttctagagtatcccttcatggcagtgaacctcctaattttaaccttctttgcaatctgaatagctgagcatttcccaaatcatcaagtcctggctcctttttaattaacatcccttccctccacttatcttttccttcttgcctttcactataagcagcaagaggaaaccagattggaccttcaacactttgcttggaaatttcagaaaaatatccaactttattgctttcaagttgtgctttccatgtaactgtaggacacaattcagcaaataatgctgccattaaaaactaaggatcctcttccagtgtccagtgatatgttccttatttccttccgagctctcagcagcagtggctttaacatccatactgccactaatagtctgttgatgatgatttgggtattctctaagacagtgttggtttctctgcgacagtcctcgcttccttctgagtcttcaccagcggagtcattcatgccaatgtttctactaacagcctgttcaagcccatgtaagcttcttctatcatgctcctcaaaattcttccaacttctacttattatcaaattccgaaaccacttctactgttttagatatttgttacagcagcactctatttataagtgtaaaatctgtattcgttttctattgtcattgcaacaaatttccacaaacttagtagcctacaagtaatacacatttgttctcttatagttctagaggtcagaagttcaaaatgaggcatacagggctaaaattaaggtgatgggaaggctgtttcttttgggagcctctgagagaaaaatctgtttcctgtgcattccagtgtctagcaaccacctgtattccttgtcttgtggccccttcctccttgttcaaagcacatctctcagtttactgttttcattactatatcactgttttctccgactctgactcctcctgcatccttcttataagtactattgtgatgacattgggtccacccagataatctagggtaatcctttcatctccagaattttaactcaatcacatttgcaaagtccctttttccatatgaattcacaggttctgaaaattcatggacatatttggggtggtgttatgtagcctaccatatcgctattatttcagttctcccaacttttagaaggttgatagacagcacgtagtagtggaaggaactaatctgggagtcagaaacctagatttcagtcccacttgggctactaaaaggttttatgccttagatcaagccattttgcttttttggacctcaatatcatcagttgtaaagtgaggggattaaactgagtgatggctaaggcccttcaggactctctactgttatgcttctttggttctgggctttcattgcaatgaggtgcttctttagaaataagaaatggtgagttttagttgctgaacagtttagagtgaattagccaaaatggtgctgcagttcagtgctaaagtcagttgaggtgacttagtttactgttgttgttcttgccagattatgggccttttacatacagtagatgctcatcaaactcaatggaaaagcattatcaagcacagtttctcttagaaggcacttgcactgaataagaaaaaaaatcctcactctcttagtgtaggggttcagggcgacttaaatggtaaaatctgaggtctgagtaaagggtttcttatgttctctagggtggaagttatggctgaggaaggatgggaaggttttccgaaggtccgtgtctccagtaggagaaagcaggtcctttggagaaaatgtgcattggcttttgctagattcttgcagctgcacagaaggctgctgcagccaacacatgttatagagctcaagagagttggaagtgatgtctgatgctaagtcctccacaagcaaaccagggaaatcaactgaagaagaggcctcaaagaaatcaggtcaaggaatttaagcactgagtctaggaggattcagaagaggatatttagtttttcagcttgtcctctgggactctataccactggggactcatatacaatatttctgttgttgctaaagggcagtaagtatgatgattagaatttgaaaagcagtccctctggtaggccttaggattttctaaactgctttgcaaggctaggttaaatcttgtgtttttttaaaagaggaatcttctattcagcacacaaatgagcaccctacctttgagcctttgtaattttactcatgttatttcctatgtctggaaattcttgtccacatctttacctgcttacaatcttctctgtccttcaaggatctgcttaaataccatgctttcaaacaaaacctcttatttcctctctctccgaatgatcttttctttttcttaaactcctgttgaattttcagtctttaattttttaacagcattggccacagtaggaatttaaatgcatgctttctctcaggtgcattataatgtcattgagacatttattcatctttgcatctctcatagtacataaaactggagaggagggcttaatatgtgtagaaagaatgaatagaaaaaatatctaactgtacatgtaagcatagactcactgggtacataaaatataaattaatgtccatagaaatctatattgatatactgatattgatatagatatagatattgatatagatagagatgacttagtactcaagatagtgctgagtgttgatgtaagagatgtataaggcttgaaactctaagccttagtaaaaccatattctaattgtggagagaatatagcaaaatattcatgagcgatagtattaggtggggttaaattttgtgatacagatagtcactactcctgtatttcagagaagaggatgctctctgtaagctggagtggttggggagatctttgaggaggagaaagaatttgagtgagcccttgaatgatcaaacactttttcaggttttaaggtcttcgtagaaatgtcaaacattttcatgtttgtctataggacaattgtcatatctttcattttagttgttaaaaaatagaatggacaaaaaatggtgccagttcaaaatgaatttacatgtatttgtaatgcatgttttaaattttgtcttcaaccaagcttaggacacatgtggatttgaaggctcaagaattccaagtaaccaaaagagtataattgtattgtttataacagaaagaaaagataaatgcttgaagtgatggataccccgtctaccctgatgtgattgttatgcattgtatgtctgtatcaaaatatcttgtgtaccccatagatatttactatctactatttacacattaaaataaaaaaaaaaattccaaggctccttggtgtggaccatggttctcggaatctgtggagtaggaccttagtaaatacttgtgtgatggtgatggatttctggttaagatttcttgatttttactcttttaccaatttcttaactatgtcgctaaggtttagttagctttttttgttgttgggtagacatgtcctaaaggctttttgtacccgatctcagaagcttgtttttcaactgaattgaaatgtattttcaattcagtaaatgaagtatatataaaaaccacaatgactaaaggggcattttaaagaaggttaggggcaggaaaatcaactaaatttgatgactgaaatgttctatttttcaaatgtccataacattatcaggaggggaaaagccagaaaccattgtgattaaaactggtgatatatgagcgtggctttatcgaatatataatatgattatttcatttgtaaagtgctttgcaatgcatgctgagtcaaatgcaatacaaatactaatataatatccagcattgcaaatccagagaaaaatgtattgtgtatcgtcttatgaaatataatttccagtgattctgaatagtttatatagggaacattttttttcttgcttttcatgcttctaattaaatgaccagaataaaacaatcacttgaaaataaattctgaaagattatttcttaacatattttcatatttttgccagcttcgaactcttggattctagctggcatgccagctgatttgtgtgggtcatccagactgtgagttcaggtttttttcagggatgaaaaagtcaagcctcttgctttggctgaagtgtctgagtttatgataatgtaaatattgccttgtttgtcaaaaccaagcctgcatcttggctttcttcaggagacctggaaagagctactacttcttaactcaacaagcatttatttgtttcctacattgtgatcacatatgttttaagcattcttggtaacacaaagagtatttcctggtttcttgccaacttattggtttaaagtcctgcccagtgaagagtgaagatgtgtatttaaatactgcattgtgtgacagaaattccaagagtggtagatgatcaggaaaggagagacaatccatggattctagtaggtgggagagcacaacttgatatggccagtggcaatccaaccccaaagactgtgggcaagctggtggatggagaaatacaatggatggtgctctgaaggatttgggggagtcaaagggaaggggaaaaaatcctccaggcctatccttcacttagctttttatttttaacaaatgaaaaatacatagagcagttgtcatttgttaaagtgtagcagaaagagcgaaacaggccagtggaggcttcatcaagaatgctcattcagaatgatgaatgtggctaaacacacatttgttcgtaaaacttgcagagtggctgagcatcattaagcatgagaaataggtgcagcatgctgagaagagagtggagcaaacagatgttgtgaattttcacaggcatccttcatccaccagtccatcattaatatagttgaaggtgatcctttctttttatttaataagcacaaacaaagtgcatgtgttgtgattctgctgaatgcacttctttttctgaagaagtaagggcgtgcaagaatggggaggatatgtagacacatcagttccctgtgctcccataacatgatatcagccttggggcacagctagtgcagaataccacttttatttttccttttttttttttttcactcatcttgcagtagctctaactgcctcatcactctgtttgctacctagcagattatctggatctgcaggagaatgaaaagctttatggcttttgaccttgctaccttccaattctactccttaggatgcatccgactttcttttttttttttttttttttttttttgagacagagtcttgctctgttgcccaggctggagtgcagtggcacgatctgggctcactgcaagctcttcctcccaggttcgcgccattcttctgcctcagcctcccgagtagctgggactacaggcgcccgccaccgcgcccggctaagtttttgtatttttagtagagacggggtttcaccgtattatccaggatgatcttgatctcctgacctcgtgatccacctgccttggcctcccaaagtgctgggattacaggcgtaagccaccacgcctggccgcattcaacttttataatgacatgctacaacttgtttgctgacatcagctgggtagacactttttttccctattggcagaacttcattgaccctaccctgtatcatccaattctacttctttcccttccttctcttcgtttttacttcttggccctttgctagcatagatcttggcctacatacccttacaggccttccttcacttggaagcacagtccaggcttctcatcttgatccttggacccttgactaccaccaaaggattgagaaccctctcttttttaacctcatttcccagtttgtgaaatgaagatggtaatgcttcctttccagggttggtctaagtaaaagcattttgtgaactctgaaaagcatcctacaattattatgaatgttgaattgtgatctattaaacaatgagttctcttttgtagagttttcacttagggagttgtcaacatctgcttaaatcctcatggtctgtttgcctagagcttcacatttagtgccagatatgttgggtctgtgaagctgtatctgttttcactgtgtgtgtctgtgtgtgtgtgcacacgagtgagcacgcacgtgtgttgtatgtatctgttcattttcagaccaaactggaggggaaaaaacctacaagaaggcagtgaaactctcatatagagcttgagacaagatattgctttatcttgctattaatgaactatgaagaataacttataattttacagttgcgcctttcttcattcaaaataagcattattgggatcctgaataccctaaggcagaagtgaggaactccgtaataagtcatttcaaaatgcaaactatctactggtaatcataaatttgtttaacttgttacatgtactttttgaccatggcagctgtctgcctatgctttgaattggcatgttgagtttaagtgtgtttgtgtgtgcttttgtttaaagaccaatatctctactgtcatagagacccatctgagttaaaattgccaacattgccagggctttgtgacagtgctcatacatgctgtagctctggggttcatcttcagcagaattcatagaccagagtgccaggcattcactttgaagcaaagagaagtgttattttagctaacattgagcccacattctaaaggcaacatgcttggttcccgaagccttagcaagaggacaagataacatatttacatgttggatgtgttttaatcatctccttccatgggccttctcactctcaagtgcagcacatgtgtccttaaaggccttgagtagctgtggatctcctatggtttattatcgaacttaaatatacctgcagttaggaatgctatgttttgtctgtgtgaatgattgccctcaggaagagcatatgcatgtcgactcaagccagtcctgggagcctgagtcctaccttgtggctgccacccaaaccttgagagccctgctgttccctctggttgcttgggcacttggccaaatgcacaggaaagtggagtatatatgtggagactttgaatggtgtggtttgtcttcccacttgatactagttatgccgtgaagacttacctgtgaatgaggtctggtggtaacttatgttcaagcctggtgatgacagttcagctgctttgagatccaagcaccctgtaggtgatcagtgttatgccaagaggaaaggagggttggctttggcactttttggtaacctgcacgttctaaaagaaaatttctttattggaatgcatagtcatctctgctggtgcctctggagtagtgagtgagtgcttgctccagaactgatcttggtctccatgctgtgatcatcctagttaggacattgtcacagcttagatggctgtagtacaactagccctgggtttggaggcttggagtctcgtttcccctctgtctctgtttcttcattggtagatggagatgatggggctgaactcatcgcttgtttaaagttcctcagttatttagatatccacgtttttctgggtctttctccatgccaggcattgaaatgaaaaccattgaaattttaacattatcaatgaaaactgggtttactctaagtcggggttggcaaactatggtctgctgcctcttttcatatgcctgcaaggcaaaaatggtttttacattttaaatcatggagaaaaatcagaagaatactttgtgacaagtgaaactgatatgaagttcaaatatgagtgtccataaataaattctgtgcttctcattagtaagctgtgttataagaaattatgctcaatatttattatatttttaattttgtcagtaaaatttatttggcaaaggaatttttttctcttgttagtttctccatagtacccttgattttaccacttggcctagaaagcctgaaatatttactctctggtcctttacagaaagtgtttgctgacctctggtctatgttatttcacagtctcactagatgagtggtttgcaaactgtgggtcatgatccattagtttttggtgaaatcaatttagagggttacaaacagcatcttataaataaatgaaataaaagagaattttaaaagacaggacatatcaaagtgcattgcatgtggtatggcgaatgctgttttatgaagtttttctttcagatgggagcgtgtttgtatgtgtgtacatgctgggtcaccatgtcaaatataacgtgggtcatggcccaaagaggtggaaaagggtggggcatggtgtctgacacctataatgccagcactttgggaggccaggatgggaggatggcttgagcccaggagctggagtccagtaacacagtgagacccctgtttcttaaaaaaaaaaaaaattacctggggtggtagcatgagcttgtagtcccagctactgggaaggctgaagagggaggattgcttgaggcctggaggtcaaggctgcaatgagccatgatggcaccactaccctctaccctgggtaacagagcaagaccttatctctaaaatacgtaagtaaataagtaaatgaagaggtggaaagccacagcactagagcacaagctctttgagggcagaaagcctgtctcattcatttttgtttccttgggcctggcacaatgcctgggaaaaaaataggcttttaagaatgtttgaagagatgaattaatgagttcagggaagaaataaggcatgactattgaacattatggacacagctactaaataatctctgaacatgtcttaatgtgtttagctcaatgcatacggtttcctgaaatgaggaaatgcatttcagagagtgaacaaataatttattttctgtattggaagatggcacctaggaagctgggtttgagttccatcctgaaggatagtcaggtcatgtgttaagtgtggtatagagaagggggacaagcattggcttaggggtcctgagtgccagtgcttgctctaccctgaacttctgggaacttagatgagtttcctgtgtctttcttgccaaattccttcagcccaggcaaagtgagaatgataataatgattatcagacactcagctgtgaagatcagaggagaggatgaggtggagagcactttgaaaagtataaatccgtgtgcaaaggcagtgctcattattatgtcatgttaaaacgtttgtatcagaccctttctgtgggcaagacatgtgcttggcacagtgggaactagaaactcagaccccttaaggtcctcgtggttaaactaatgaatctttaaggttgttatactggtgaaaaggtaaatagcaacacaaaatttaaaataagccaatagaagaggagatgttgtaaggtcatccatgcccttgcaaatgttcagactccccaggctgaggcaaaagctctggggaaaggtgagaaggggaggtggtgccagaggtatgagatagagagtcttgaatagaaaggaaggcccttctcgctgggctgtggtagtggcagcagaaaggagaagcccctgtagatgaaaaagtcccctctcagtgagtgactccctgggctaattgctgcattactctctttgatgggcctgatggtgctgagataacaaaatgaaaaatcaaatgagaaatggaacccaggagtctaaaaagttagtaaattttgacattagaaatataatcaaatttcaccagtgcttttctgtagtgacagccaaatccatccatgtcagagcaatggcctatggtatgtggtttcgtgtggcttttcttccccctttctcttttccttttgcaaaatcagcattaggctatttggaggacaggcgagaactattatgttaaattgtgctacctacaacttaagcttctgtctttgctaaagctgccagtttttataaacaacagaagacagaaagggtttactaagaataatgttgaagcccaaaagaatcctacagcctataaatcttaatagaggttctgagattccagcaggctggatgtgtctcttttacccgggctcactccatcttggctcccccgtgatgactccaattttctcgaaacacaggcacagtgccttgaatttacttgtggcactttttgcctacaaacaggaatacatgcatataacctatgcaaatcaataaaaacatgtcaagaccccttaggtcgcactactctcctaaaatgcaatttatcttgctgcaaatgagagtaagggactaggtaacaaatagcgtctgatcatttaactagcacctgttgtcaatgcatttgaaaacggcatttttcatttgacatacagtaaattgcattttcatatatatcgaatagaaaagtgagctgggatgtacatatgaagccctttatgaattttatgaacaatggatattttagagctgtatgtttaaaggggtcacgtcagttgctgcaaatttatttgttccttccagcattggttgtgaacataccatagttttcttatggctggatgttgaagtgtggcaacgctgaaagtataattatatcattcatgttaggtgaaggacaattactataatttttgtataaaattgaatataacttaaatgtgtaaatatgatttttttttgtttttttttacaaaagtttcttgggggaaagctgctttttatacattacatttttcagtcaattcctttgtcggcttaaattatgagccacaggttttttttttaaatgcaatattttgtttgcagacgggtggctgttgcacaaattcaacaacacttaggcttatcagcaacaatggttttcacattagtgagcatggtttggcaatattatttgacatctggaacaagctatattataccagacatatcaagtataactgaatggatcatttaactggcatttgtttcaaaaactcccactccagcttttgcctggctgtcatgatatgccggcaacacatcctgtgtttccctggcttctgtgtccctcattggcatttggcagtctcatgctcccttcccaccttcaggtggacacttagtcatcacgacgatgaggccatattcttgcgtctctttttggagaagtccaggatgccaggtagctgcagagggaaggagctctgtgaccattttagccaggactcaggccatcaattgcaccatcagctcttctcttattttgagtgtttgattatggctcccccctggcacatctacatgttttgtaactatgtcacacagggagatcggctttgttgaatttcctgtaacttggatagagaggagaaaaaacaggaaagggccctctgcgttgcatcctttaataaaagaaccacatgggggcagagagagaagaagctggaagtaagaggaaatggtaatagcagaattttaacacttagtttttctcagtctacctaagattttcctttagcaatttggagtatatagtcacaacttggcagcctagcaccaaagttgtatatcattgctgctattgttttactttgttgctctgcctaaggaattcactccttaggatgttgaagccaggcttatgaagaatctccatggggaaactggtatgaaaatgctaggtacctcctaaataagaagtaatgcatttacttcttgcagaaacgctgttgcttttgttacttatttgtgtgtgtgtttgtgtgtgtgtgtgtgtgtgtgtgtgtgtgtgtgtgtgtatgagcttttctctttaaactaagcaggatataagcagaccccacccagcttagtgagtaaattcataccaaccattcaaaataattaaagggaaagaaggacttgttaagtaaagcaaataatgaacaagtctcaaaaggcaaaagccaaataatgagaaaagtcataggcttaacctcattttcactgcatttggtaaaattgtttttatcaatataaacaatcagaaattgaggcttgaggcagaaaagggatttattatctaactaatgtcactgaaaggaactgctcaaggtggtcatagcactggaaagaaagaagcagccttaattctcctaacattgccgtttagattagttggagacaaattcatttttcattaagtcttttattcattccacaaatatttcatgagcttcaaatgttatgtgcaaagcaccatattaagtgtggagtgtaggcaaagtaaataaataaataataccgaaatgataccaaaaacaaaccccccaccaccaacaaaaaccaaagcagaacaaacccatttataatagcatcaaaaagaatacttaggaataaacttaaccaaggaggtggaaaacttgtacaaaaagtataaaacattgctaaaagaaatcaaaggtaccaataaatggaaagataccctatgtacatagattggaaaatttaatactgttaaaatgtcaatactacccaaaacaatctataaatctatgtaatcttgatcaaaatctcagtggcaattttgcagaaatagaaaaagctattctaaagttcatgtggaatctcaaggaaccctgaatagtccaaacaatcttgaaaaagaagaataaagttggaggcctcatacttcctagtttcgaaatgtattacaaaacaacagtaatcaagatggtgtgctattgacataaagacagacacatagacaattggaaccaaatacagagttcagaaattgaccattgtgtgtatggtcaaatgattttcaaaaagagtgccaagacttcaccatgggtaaaggacagtctcttcaacaaatgatgttggcaaaagtggataaccatatgcaaaagaatacagttgggtcctaacttcatattatatacaaaaatcaattcaacattttatagttttagttattactcttagggtctaaaactataaaactcttagaaggaaacataggaaagcttcaatgcagtggattaagcaatgatattggatatgacaccaaatgcacaggcaacaaaaacaaaaatagacaaatggaactacatccaacttaaaaacttcacatcaaaggaacaattaacagaacaaaatggcagcctatgtgatgggaggaaatatttgcaaatcatatatatgtagttaaatccagaatatataaagaacttctacaattctataacaaaaagatgacctcattaaaaaatgggtgaaggacatgaatagaagttctccaaagaagatatacaaatggctaacaagcacatgaaaatatcacatgattcaacatcactaatcataaggggaaaatcaaagaaggtaccaataaatggaaagacatcctctaaaagattcatcactaatcataagagaaagaaaataaaaaacatgagctatcaccttatacccatttggatggccagtatcaaaggaatagaaagtaacctgtactgctaaggatatggagaaattggaacccttgtgtactgttggaaggaatgtaaaatgatgcaactgctatgaaaaacagtatagaggttcctcagaaaattaaaagtagaattaccttatgatctagcactctcacttctgtatatatatctgaaagaattcaaagcaagatctggaagggacaatttctcacttatgttcattgcagcattattaacaatagtcagtaggtagaagcagcccaaatgtccatcaatggatgaatggataaagaaaatgtggtatgaaatgttatgcagccttaaaaaagaaggaaatccctgtcacatgctacagcatgaatgaacctctaggcttaattaaatgaaattagccagtcacaaaaggacaaatactgtatgattccacttgtaggaagtaactaaagtagtcaaaatcatagaaacaaagtaaaagttggtgatgatgtagagtatgggttttcttttgggttgtggagtggaggcccattgcttcactgggtgaatgagcagcttttctaccagagcctgctgtttgttcaacaggcctgtaaacatacctctgtgctatgctgagtcctggtactgtgatccagcattgggcacccgggactagtctcttcttttcctgcctccttcttcctgggtattcataggcatctgcctatttacttccaaattccaagggagaattgggctcataaatcttcacaataccccagatgcattacagtgttactcactggcattgttaccttaatgcctctctaattatcttgtgtgcccagaccatagacacttcttagggaggaagagcaagagcagaagaggacagccacacctgcatcactcttctgtgtaagttccatctggcacatcctcttttctctttgggagggaaaagtggctcgttttgcccttagacccattcttgcccatactctgctttgctgtctatcacaggggctgtcatctgtgggggcagttcccaagctccttgaccagccagcttcctattgggtttgaccaatgggaggccctgtcaggagactggaaggtggagcaagtggtaagccagggtatctgtccctgtcttctctgcctctggtagcttctctggcatgggctgatctctgctgtggctccaactcctcctataggacatggcctaccagggcttagttttagttggtgaccctcgtcccagtgtccccattgtctttcagtctgagagtggtaatgccttcttattcttgcttctcctgtgctgtatatccttgctgtaaattcaattcccagcattgcatttcttcttatgtagatacttgaagcagttcctattttctcggtttgaccctaactgatgcagttctgtaggcctttagaaagccctaagtagttctatggaatccacccaagtgtccatcaatgatagactggataaaaaaaaattgtacatatataccatgaaatactataaagccataaaaaggaatgagatcatgtcctttgaggggacatggatggagctggaagccattatcttcagcaaactaacacaggaacagaaagccaaacaccgcatgttctcacttctaagtgggagccgaacaatgagatcacatagatacagggagggaaacaacatacactggtacctttcgggggtgaggttgcgggagggagagcattaggaaaaatagctaaagcattctgggcttaataactaggtgatgggttgataggtgcagcaaaccaccatggtacacgtttacctatgtaacaaacttgcacatcctgtacatgtaccccaaaatttaaaataaaaatttaaaaaagccctaagtagttctgttgaaaaaaccatttactgaaggaaagcaagattggaaaccaacagtgtcaaatttttacacatggttcagtattagttatagtattagttagttgtctgctgggtctgtagccaaagctgaaagcaattgatgacaatgtgaaggtaaactggttcatgtttgctgagtgtttttttacttgtggtagcatataaattgtgaaatgggatggaaataaatgctggtatcttagactttattttagatcattatgatgataaacatggtgttttcatattatagaaacttctatcatcataactcagcatggatagtctatccagtttaataagactgtatttattatatgagcaccttgatggtctggcatcaggccagacataaactagaaagagagcccagtataagctgaaaagcggtctctcaattgggaataaaaagattaaaaactgcagattacatttagtctgtaaccattttttcattttatttgagatttttaaaaagtatagtagggctattgtgaaaattgtaaatgatggagtcttttattttaggagtctttcattcctttttggtgtatgctggaggtgccccaacaagctgtcaaatccactattagcttcaagagttgggcattcccactcaaacttagtgttaaaaacattattttctttcttctcagtttttaagctcccaagaattactgggtgggtaagaatctagtgtttttctgttgctcatataacaccatctgggtttccaagaggtacactttggcctgagagaatggctgttgagtggtatagaaaacatcaaagtcaaaacagtaacatattaaaaaatattggttcatctaatacacagggtttgggggttagaagctaagatcactcggttcggttcctgccatcttggagtttataatctactggaaaatgcagacaatcaggatggtaactgtgaagtttcggggccttgggagcagaggaaaggttgtctggacagatctggaagctgaaacttgaaagacaagaggaattcatttgacaggagttgaaacagtagtgttctgggcagaggctaccagagtatgcagaggtttgaaggcatgaacaatgagagaacatattgtctcatgagaaatgacacagaaatattttaaagttgggtctttctaaaagtaaaataacagctttaaaaaaaattgtttttttaaccccgcctggaagaggatcattttggtggttgttgttgttcaacatgattgaatatgattgggtattattacttgctgatgggacttaattttctcttgtttaaatgtgatccattatcttgtgtctagaacatattaaaatgacttcaaaatgagaaacaagggaaccttggttacttcagcacaaacatccttgtttattgagctgacatgaagggtgctgggatattttaatattacgataatatagatgcttaaatctcagggttaaagaactagattagtcctctgtgatgctgggctactcagaccataaaggtaactcagtgtttactgttatgtttttctattcttatcctgttgtgtcttgcctcctggcttctctctttttctttttttcctcttctttccttccaactcaaaactcatcaacttgcaatacccctgataaaactcatttatactgcttaccaaattttctggcttcagccagctgttcagttttttttattgtggaaggccccaaactcttctcactacttgttctgaagataaattagcgacttctaaataatgcagtgaaccctaattctctttgattagtagcaagttagatgatagtgacccattgaaattggccatcagcataaataatgagtgaatgaactgataaaatgcaaagtcactggccatcataaatcaaatgaaatccactttctctggaagtcactgaaattagaagtccatgctcctattaattattttgccttctgaagacgacagtgttataaatcagccttgaaaggcccttcacttagaaagctgaaggagtacggctgcctgcaaattgctttgtgtacgcacctaattgtttcttaagtaattcacctttgtagcattgcttcaggaaacgaagaaggtcccttcggttgagatccatgacttgtagccttaggaatggccttgagaaggctctctggaaggtccaaattggagtgggcaattccccacccccttctctagaacagatatcctcatgttctttgtcttacaactcagaccccatcaggtgggctggcatttttggagtggtttgctatggcaggatccaaaaaaaggctggcagtaggccctgagccatttcatcatcttgtctcaacttaacttccagccaggcctaagaagccaagcttcactagaattcagtgaaaaccaagattttaaaagttgagaaaaaatagagattgaaaactctgacttctgaggttcattgtaaagagttgttgtaatctgcatatattaggtatgaagtgacacataatttttggtaaaaggtgggtgggaaattatattcatttaggagcctattttgcaacagatattttaaaaaacaacactttttggaaaagaggttaattggatggtaggaaatgttgtaaattagtttcatttaggaccattacctgtcatttaaagttctgaatttgagactgctgattaaaaaaaagcaaaacaacaacaacaacaacaaaaaaaacaacaaaaaaatagtaatctcttgggtgtggtctcaaaaatttggtccagctttgagatgtgatcctggattgttagcaaatctattcagagctgacaaggaaattctctgttgcctattgagtgtgggtgacttttgctggcctctgtagagagatggatgggcaggcttgtggaggtgaagacagacatcagtaggcggtagctcctgagacttccagctgctagttaagtatatgatgagtgttcaaaactagctttagtataggctccatagatgggggttgtattagtccgttctcatgctgctcatgctaagtaatttataaaggaaagaggattaattcacagttctacatagctggagagacctcaggaaacttacaatcatgtcaaaaggggaaccaaacacattcttctttacgtggcatcaagagagagaaatgctgagcaaagggggaaaagccccttataaaaccatcagatctcatgagaacttagtcactgtcatgaaaatagcatgagggaaactgccctcatgattcgattacctcctactgggtccctcccacgacacatggggattatgggaactacagtacaagctgagatttggatggggacacagccaaaccatatcagaagtggaatgaagatagggtttttaaggaaaactcattcttacttttctcattttctaaacttcctatcatctgctgcaggcctgcccaattcccctagtggccagtacagtaaatgtacatcctggccttggaaaatgaaaatgatctcctggattgtaagaagcacattctcttacttctttgtgttgtgataatcagagtgtcctggcatgttctaaagcatccacctaaagaagaggggtgtgtgtgtgtgtgtgtgtgtgtgtgtgtgtggtcacatgcacacacagtcatctgcacagctgaaagaacaatctgctttcaagtgagtggtgcaaattctcatgtgtgagtgtgttctggtgttggggttagttgctgctaaatcatttgtgcatctgaataacccattctcaaaactaaacttaatgatgtataattgagcattatgtcatgaagtagaaaggagcaattgttccctgagatattgaataccaaatgcaaagatgttctgggctgtgtccttgaaaccagccgactctgtgatttcacagtgattccatgaggcattctacaccttcaggatgagaggacatcttaatcctctggacatccccagaactgcctatcccagctactgggcctccccaactcttattagattcctacccatagtagtagaattctgcttgttgttggagaaggttggtggaagaaaatgcagctaatggtctttctgccttgcttctggaagtccaggagggccctgccagtggtctgtgctgcaggacagagtgaggcatctgtgggcattccttgcctggcagctgatattgtgtgtctctgttggtcctcattcatctagcttgcgttttagagttgtggttatgtaatgggggcgtgtaataaagatttgttgattgttggacatgctgtgggagtgcaggaggagctcatgcgaatgagtggctctagtatttttggatttgtttctgaggtttgtacaggataggcaaagtctcgaccatctataagactgtcctcctggcatgtgtcatttattgctcaaggtttctggattttagaacatccttctttgcttgggtgatattcccctgtgtggtatataatcaagtaaccatatgtcctggtttccctgggatagtctcaatttatgcctatttttctagtatgattattaatattggccaccccccatgccttttactctcaaaatatccagatttggatggccactttctatataatactgaaaaggaatgtttatatttgttgtcctagtaccatagaaacagtggcatattgaaataatcaaggctttggaaaaatgaccaatttatttatttatttatttatttatgttttaattatactttaagttttagggtacacgtgcacaatgtgcaggttagttacatatgtatacatgtgccatgttggtgtgctgcacccattaactcgtcacttaacattaagtatatctcctaatgctatccctccccactccccccaccccacaacaggccccagtgtgtgatgttccctttcctgtgtcctgtgttctcattgttcaattcccacctatgagcgagaacatgcagtgtttgatttttcgttcttgtgatagtttgctgagaatgatggtttccagcttcatccatgtccctaaaaaggacatgaactcatcattttttatggctgcatagtattccatggagtatatgtgccacattttcttaatccagtctatcattgttggacatttgggttgcttccaagtctttgctattgtgaatagtgctgcaataaacatacgtgtgcatgtgtctttatagcagcatgatttctaatcctttgggtatatacccagtaatgggatggctgggtcaaatggtatttctagttctagatccctgaggaatcgccagactgacttccacaagggttggactagtttacagtcccaccaacagtgtaaaagtgttcctatttctccacatcctctccagcacctgttgtttcctgactttttaatgatcgacattcgaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgttggagttcattgtagatcctgggtattagccctttgtcagatgagtagattgcagaaattttctcccattctgtaggctgcctgttcactctgatggtagttccttttgctgcgcagaagctcttgagtttaattagatcccatctgtcaattttggcttttgtttccattgcttttggtgttttagacatgaagtccttggccatgcctctgtcctgaatggtattgcctaggttttcttctagggtttttatggttttaagtctaacatttaagtctttaatccatcttgaattaatttttgtataaggtgtaaggaagggatctagtttcagctttctacatatggctagccagttttcccagcaccatttattaaatatggaatcgtttccccattccttgtttttgtcaggcttgtcaaagatcagatggttgtagatatgcggcattatttctgagggctctgttctgttccattggcctatatctctgttttggtgccagtaccatgctgttttggttactgtagccttgtagtatagtttgaagtcaggtagtgtgatgcctccagctttgttcttttggcttaggattgacttggcaatgcaggctcttttttggttccatatgaacttttaaggagttttttccaattctgtgaagcaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcatgtccgttgtaagttggattcctaggtattttattttctttgaagcaattgtgaatgggagttcactcatgatttggttctctggcagagacacaacaaaaaaagagaattttagaccaatatccctgatgaacattgatgcaaaaatcctcaataaaatactggcaaactgaatccagcagcacatcaaaaagtttgtccaccatgatcaagtgggcttcatccctgggatgcaaggctggttcaacatatgcaaatcaataaacagaatccagcatataaacagaagcaatgacaaacaccatatgattatccaatagatgcagaaaaggcctttgacaaaattcaacaatgcttcatgctaaaaactctcaataaattaggtattgatgggacatatctcaaaataattagaggtgtctatgacaaacccacagccaatatcatactgaatgggcaaaaactggaagcattccccttgaaaactggcacaagacagggatgccctctctcactactcctattcaacatagtgttggaagttctggccagggcaatcaggcaggagaaggaaataaagggtattcaattaggaaaagaggaagtcaaattgtccctgtttgcagatgacatgattgtatatttagaaaaccccattgtctcagcccaaaatctccttaagctgataggcaacttcagcaaagtctcaggatacaaaatcaatgtgcaaaaatcacaagcattcttatacaccaataacagacaaaaatgagcgatttaaacttactccctggcatgtgacctctggcaagttagcttctctgagcctctgtttctttatccaataaatggggatcgatcattgcacatccctcacagatttgtgctgaggattaaataacagggaaaagtcccagcagattgttgggcacataggtaggtagaggataaacatttgttcttttcctcagaatatgccaagaaacttggcgggttgggggccagaggctttggcatgtttccgaacctcctttccagttgatgcaggcagttcagtcagcatcaggtgtcacaaaaagagagagaaaaatcatcctctcaccacctggtgtgggtgagagaaggtcctctttgagggaaaacctctccccctaaggctcttggaatgccccatgtaaagagatgcaaaaagatatccccagaagagtgagaagctgaatttgctgtttgctcaaacaaaggattgattcagcatttctagcaaaaggagcaggaggcttgccagagggccaataaataactttgcctttcacatgtaatataatggtgaaagtaatctattggtttgggagcctctatctcttcatctgcgaaatggggatagagatcatagaattaaaggaggccataaagataaagcagtgttgcaaactgtagatgcagggcaaatcatgtttttcttgtttatacagaagtaaagcaccaaatgagctgaacactatcctggggtaaaatgaccgcatgaagcaatacacataagatgcacaggtctttcagacgatcttcattcatacgcttgctgtctttcgctaatgctgcaggagggcacacacagttctgttttactggccctacagggattgctgattttaagcaagttgtgtagtttcatggagattactattcctgttcacatttttaattagaaagagaaaaaggatttatttttctcagggcttccagcccagatggctcaaagtctatggaagaagggtcccgagtgcaggtggccaggcctggttgtctgctgtgatgctggctttatgtgacctttctggctgcctaggtggggcacagattctgaggcccccccgtaccagcccaccagcagtgccctggcccctctgtctactcagtagaagcaggtaccacatggggaccctgtatcaccgcagtaagtggcagtatgcagctcatgctaggcccggtgaaaagatgctgatagcttgcaggagcccttggaaggacaagctaaaatatatccatatgtgctcatgtctgctccttctggtacctgtcgcacccttcccttccccatcttctcttcttccccctctccactaattatcacagtacagcctaacaatgcataaggctctccacccaaactaggtgggactctgtgctgcatttatttagctaatacttcacatagcacttaatgtgtgctgagtaacagcagcattcccttgaccaagtcacatgccattgagagtgggagaggctgggattagagcttagccagctgatgccacagtccttgctctacattgtttttacttcccatccccctcctttctaatggctacctttccattcatctggtttgcttgttgtttgttctataaatttctgaaaatactatgaactcttaattggagaatgcttgaagggaaggttgccctgccatgtctttttatgcattgaaaattaaattttaactacacaggtattctccatactaactgctgaggctcagttctttttggctgctcctctacccctaatctcttccccagaagagataaccacattaggaatttgctacattgacttctgcttcttctgtgaatttatatccctctctgccacaggcacgtttatttatgcatgctaaagaaagtatagtgctgtatacattcagcagcttgctgtttacacccaaaggtatgtcttagctatcttttcatgtcaatacatgtaaatatacttgcactttttgacttgtgtgcaatattccatagtgtggctatgccaaagtttatttgatccttagctttctaatgggcattttgggtgttggtcatttttggtgtcacataagtaatgaatggccttattatgggccttttgtgcatatgtacaggtgtttctcttgagtatgttctaagagatggaattgcttaatcatagggtttgcacattttaaatggtactggatgctgtcagtttggcccctgtggtgatttttatcagtactcacccctcccggtgatttatggaaagtattatttgaccagctgccctgcccacatttggtattagcatgctttcaaaatgtttgcagtctcttgggtatgacatggtacatctcactgccatttacaattttcattttcctgccaaatttgaaaaataatttcacatatgtattgtcttttttgttgtgaattgcccatgtatattattggttcatgtttctgttggcttgcatgacttttagttattggtttctaggacatctttatatattcagggcatacacacacacacacacacacacacacacacacacacacacacacacatacatctggcctcgatgcctcatacattgcaattattttcttctaatttgttgccattcagctttatggtaccctttttatatataggttttaaattttgatgctgtcaaataaacaggtcttctctgttatgctatttatgtctaatttaaggccttcctgaccttttggctgtaaacatattctcctgtatttcttctaaaactttgattattctaattttaccttttaggccttgatccattgaatttttttcccttggtgaatggttttatgttaacgttgatgttaaaattaatatatttttccccaaatggatacattcgacccaacaccatttgtttttaggtcattttgctaagtattttgaaatactgtttttgttacatataaaatttctaattatacagaaaaccagactctctattctgttccgttgatctatttgtctatctgtttgctattagaagtattaaaaatagtgtctaaactggctaagagtatttcacaaaatttatgagaggagcccaagaggtcgccttgtgcaagaggtcaccttgctctttgctggctgttggcttcaactgaacagtaatctctagagcctgaggactacgctcgattcctgtgttcttggaaagctagatcattatgatgtttctggtttttttttttttttttttttttttttgagacaagtgtcttgctcttttacccaggctggagtgcagtggcgcgatctctgctcactgcaacctctgcctcccaggttcaagtgattctcctgcctcagcctcctgagtatccgggattaaaggtttgcaccagcatgactggctaatttttgtatttttggtagagacagggtttcaccattttggccagactggtcttgaactcctggcctcaagtgatctgtccgcctcggcctcccaaagtgccggggttacaagcatgagccaccacacctggcacattatgatgtttctaactcatgctttgaagcccaatgttgcttgtgtgatacattttattactaacaaacattggaacgcttctcataggctttgaggcatgtgagtcaaagtgatggtgacagggtgtccatcagaagatacaggttctaattttaattctgccctaagttctgtggccacagattacttaccctgcctgttatacactggggaagaactcggattgagtagacctagcatcctggcttgcacctgccacttattgaacatggggtttggggcaagtatttaatttctctatctcatctgctaataaagatattattgacctctcaggatggttctaagagatttttatagaaataaggttataagatagcattttgttaactgtcaggtaccctggaaactggaactatatactaatgtgtacaagcttcattttcattttggtccaatgacgataataaatctttgtctcacctgcctcagatagctgttccaatcatcaaatgggatgtgctttgataaaattgaaatgtcatacaaattatttattgctgatgaataccaacaggtggattggaatcagcaaatattaaccaagcccatggggttattacagtgaagcagggtcatattagctgggtatcctcaggggagaattgttggagcgtgatttatccatttataggggtcctttttactcacttgggtgaaaaaaggtgtaaagttggtcctttgaaagactcaaatggtctgttaagtgtgaataatgggagaacaagtgctgtatggagttcttctgttacaagagtcaagaggcagagtgggactggctgcagtattccttgtgttatcactggctatgtctagagtttttcaaattaaaaaaggaagttttattttttatttgtttataaattgtgaaatgcttctctttttctctttccctacttacctaaatgtaagaacactaggtcattgaatattaaagtgaaagactagaacaagaaaaaaaaagatagtttcttgggatttactattataatggcaacagtctttatccctctagagggaaggtgctagttatggtggattcttactgtggtggcccccaatgaaccacacttcctagtagttcccttttatatctagttcccttttatggtgactctggacttggcaaatgggacattagcatgtgggatgcaagcacaatcttagtaaatgcttgcacattggagctggtcttcttggaatgcttgctcttagaatccacctgccaggtaaagaagctctacctagccaatgtggagagaaagagctcacagcctccagctatcccccccaagattcttgagatataagtgaagccatcttggacgttccaattcatgccactatctgacaacaaatacatgaggggcctcaaatgagaccagtagaagaactgagcccctatcaacctacagaattatgggcaggtaaaatagtggttgtttaaatccactacatttgttatatagcaatagataatcaaaaccttgggttcacacacacacacacacacacacacacacacacgcacttaagtcagtttaatgtttgagcatgaaatgatttttcatatctgagaagttggtgtttttggacttgggttcaggctactttatcaggaaatacttttatttacttcctaaatttagttcagactcaagatggagcattgcatttggggtatgtccatttcattaagaaaaaggtagtgaaagaactacctgttttcccattagggcacagtcccttcccattaggtcccctcaatccagaagaggccatgaggggaggtgactgagaaaggatgtttatttctgcagcttgcatgcatggagaacctggaagaatttataaatccatcatttcaagtcattaggcgatatgttggtcagtccaggagactctgttctcattaattcaggggagatttacttgtgtcaccctcattagtatttatgggatttatccacatcaatcggtagtgcattaacagggaaataactaaacctcctagggtttgttggcgctaataaaatgagctggaagttccagaaatcaccatgatcagaagtattctaaatcagggctgtaattgatcctttcaaagtaccctcaggatgtttttctgttcgcttcacttccagtggcatttgcatattagcatggtgtctacagccttagagggcagtccatttcttaccatgaaacgatgtgggagaacccaatggagtgttgaaaattcatcgtcagaccagggcatctatgtaaacaaagggttaattttcttataattctttttgtttggtcctggcttataaaaaaaaaagccctgcatgtaaatatatcttttatgtattctgaacataaagatagctctgtcctaccatattgatttattagattctctgacattttagttgtggtcgttatgttatatttatgagatgaatgttggattccctcattatgttatcctcatttattttacatacttttatggctggttgtgcatcgctttacagttaaagctttattgcagctgttagcgttggggggaggggaaggcaagtagttattgatcggaatttacatgtttactgttgtaatcatgatttatttaatctgtctgcacatataagcccactctctgaaatcaaaaatatatactgtatctatattttagatggtggagcattcattggcaccctcatgccctttggagtagagaatttggggatgatctggtgttctgtggatgagcacttttcttacagcttggtggtaaatggtgcagactttggagccacactacctggactcaggtcctagctgtactgcctaccggctgtgtggcctaggtcaaggtatttaccgctctgtgcttcagtttcctcacctgtaaaatggggatgatatttatacaacctcataaagttgttgtgagaagacaaccttggtaaaatgaacaacattggtaaatgcttagaatgctggacactggaaattatgaaatgctagttattacaactccaatgagtaggtggcgagctaggtagagagggaaggctcagctactttcagatgggaaacttgactttagttttaattcagcagagcaaggacacttagaatgtgcttgggtatcctctagacaagaaaagacttcattgagagctgaagaatagtcccgaaaattgatttttcccatatattattttttaatgtttttaaattttgggcctgccattagctagcttctaaggatttgaagctttgcctcagtcttctcatctatcatgtgggtttaatgttacttctctgcagcatgagatagtagtgatgtgaacagtgaactagaagtcaatagacaacttacagcctcaggcctgctactgcataaccttactaccttggcagaagacttaacttttaacggggcaaggtctctgtctactctttaaggttatcttgagaaccggatgagataatatttgcagtgttattttgaatactctaaaactctatagtaaatgttagggaacttctaataataccacctaacaaagttattgcaaagacgagatgatataatagatatgaaaagactgaaggaagccggatgtgctctatgaacctatgggatgtgctctatgaacctatgggacatgatgcaggttcagccctttaacctcctgttcccctgagtgtgagtcctaacccttcccaagacacagaggcctaggggaacctcaggctccctggattcttagttccaaggagttttaccctttcattcaacccatgtggcattaatatggtttataatatactatttgaccacatccttaggaaaaaaataaggccttcccttgtaatttccttattgtttgtttattgggtgcaagactgtgttttatctccatcatttaatggaagctacactttctgctctaatgttagtaactcaacatttgctttttacaatttacaatttggcagtgattctttgaaataatttacttttatcatcttgcttcagattttcaaagaataatccatctagcaaaacagttttatcctttctatatattcatttttgttttgaggctctttagcagaattaatgatttttaatcaaatttctaggccactcatcataattaggtttagaattatgaattatgtacagcttgccattatatcatacctccttgtggtaggtgagtgaattagagatcatcacaggatttccagagcctttcagaatgatttatgacataaaaaaatcttcaattttttcttccttgtttaaaatgtctctagaaaaatctgttttttttctgcctctttcttttaccctctacctgaaagtactgttgcttgtcagttttccctccaaatcatttggcctctgaaaaattttgcatagctaagttttaaatgaattaatcaaaattgaatctcaaaaacatgctgggtgaaataagtcatacacaagagtatttactgtatgattccatttacatgacactctagaactaatctggggtgatagaaagcagaataatagtttgttctggagagagccacaggataactttgtgggacagtggcaagttagaaatgttctagatctgaatggaggtagttctatgggtatatgcacttgtcaaaactgatcacgttgtatacttaagatctgtgcatttcattatgcaagtatatctcaataaaaaatatgaaaaaattaatcatgactcactggttctttacatatattattttagacacacttctatggtgattaaaatctatggaattcttgaggtgatatgatgtgttttccttgtatatttttagccagaatttaaagaaaaggatgttatcttaccataccagttcttctgaatcactggaggtttagaaaaaatttgtttgtcagctctgttgtccaatgatattcaagtgagtacctgccgtctgggttagcttttataggaagccattactcattctaaaaatgttcccttctcctgccatttgacttatatggaggaataatttcttggctaattttttttttgctttatacttctgaaatacaaattcactttttctaatgaatcattatcatgtactaccatcaaaggttattcactgaaagctgaagaaaaaagcaatgaaaactaattttgattgttaatggaaatgtatttttagtcctaaagagcttccctcagcaataattatagttatgcctcttgggtgtttttggacttttaaatttacgtctagtagctctttttcatttagtagttaatcttttaacagagctctgcaaatttgttctttagtctggcgttagaaaaggattgacagagattttatttcttctcttctattcaattttttcccctcctcatcgtgctggcagcccaggctactccccttattgggcaaccctggaccctgtgactagtcatatgggcagtgagggatcaggatggaaaggctagagagggagattttgcttttctgcagccagtggccacccatggctctgtgagccacctctgctccacacagcacagaattgtggcacagcaagtgggctcatcaaaggtgtttgtgggagatgggcaacactcagctttgtggcctacaactctggaatacacactcagcctgtaaggggactggctggctgctgcctttccctggcttcagacatccaagtacctgtaggcatgtggggagcttgcaaacaacaagatgtaaagctttggtagcaatgaagattgcttgttggttttgctgcttctttgctgatttcagagagaggcatgggcagctgagagggcatgagaagcgaaggggttctggcaggaagtttgctcaggttttgccctcttattaagaaacagagtacgtcaattaacctggccaacctgattagagaaagtgcaagccactgctgaggatcttgtttctggtgaaaattgacctcacccaggaacggccagacatttgggtatttgcaaagcactgctgaacattaaggaacagttaaaattaatcctgtgtactgcagctcctgagaaagccagcccacatgtcaataaatctagatctgtttgaagctaacgtcactaaatcttcgtcttgactgtttgctggtcgtgtcaagagctgcctgggaagatgaatttgaggggaggatgaaaaaggaactgtattaaactgcagctctgataagtttagttaagaggcaggagatgtgtccttgccatgacattcagtggctgatatttgtttccctttaaataatatgctgtacatctgtgagaatgatggtttggggctggtgacattgcatctccaccaaggttactgccgtctggacaggcagtctctctcctttctttctctatcctgcaccctgtcaataaatatcctcttgtctgagcaagtgagatacagatttttattttttttttgagacggagtctcactctgttgccagactggagtgcagtggtgcaatctcagctcactgcaacctccgcctcctaggttcaagcgattctcctgcctcagcctcctgagtagctgggattacaggcacccgccaccacgcctggctaatttttgtatttttagtagagacagggtttcaccatgttagccagggtggtcgcgatctcttgaccttgtgatctgcccgcctcggcctcccaaagtgctgggattacaggcatgagccaccgcacccagccatgatacagattttacagctaacaccagagcgtcttcatttctagaagcaatgaggttcaacccatgtagacacagtagggaagggtgaggggttagagagaaattaaagtgactggaggaagctgttttggttgtgaaactgtcaaaggaaccccaaagcacccagtgggaaggtactgacactttaagaatttatccctaaaaaccccatttttacaagcaagatatatgaaatctggggactcaggatttagggttctgttttctcctgtgattcccctttctaggtgctttggtccttgctgtgatttgcagacctatgatctttggaagcagtcagcaaactttctctgtaaagggccaaatagtagctatttttggctttgggtccatatagtctctgttgcaactattcaagtctgctgtagtgtaaatgcagtcacagtccattgtaaatgaatgggcatgtctgtgttatggacaccaaaatttgaatttcatataattccccaggtcacaaaatattattcctcttttgattttttttaaccatttaaaaatataaaaactatccttagcttgcaggctgtacaaattagatggtgggctagattgggcccatgagctttagtttgcttacctctggtctatgatttgctctgtcttgttattttccttttgtcattgtgaggtgttggctgtcgtcttggtaggaggatgaggacaccctaaagattaagttcatggcctattcaacaaggagacagagtggatgggaatgaagacaatgctgggctctgaggcagacagtccaggttcccacaccaatcccccattaacacttcctagctgtgtaacctcaggttggtcacttaacctctctgagctcctgtttcctttttctttttatgaaatgggggtaattatattttcactgtctgtattacatgactatactatagcccaagtagtcaagagataggagaatgcctagtaaacgttgtcattatatgaatgtaaggctttgggattatttgcactgcttcaccaatgcagactcttattaactctgattgttactagtattaaagcattatgtcttttgtatttcagctacaaaaacagaatcagaatttgaatggtgtaaagaaaagatactcttgttttttcactttcttagactctgatgttggctgggcattcctgagcctctcccgcttgtttagcgatttctcccagtgtgtccagatgcttggtgtaactgaagggatcacatgcagtttgtgctgtcccactgctcagaaagccccgccctcctctctctctccatcctggctcaccttcaaggcctggctgaagtgccgtctcacccaggatttctccaccagggtccttaacacatgcagctccgtcctgtgtgaatggcttgaccccacccctggcacacaccttatagaaaggacatcctgtcctcccaaagatgtacaggttttaagaaaaagggtaaaggcaaataatggaggtcacaggtaaggcaagcaggatgtcttctggccaagttgagtgcccctgaaatcactgaatgttgcccaatgggagaaggattcagatatgaagggatgggggtctagagaacttgttttctgtgacagtgttccatctatgtcatctgttacacttctagaacattttcacatccactagctctttgatcctataacaagtctttgaggcacagggaacattttaatccccatttgaccctgaggaacagaggcccagagaagctaatttacctgtctttgcatcatacagatggttaataatgaagttgagactggagcctagttctggttaccatgctgcaccccatggccaaccccagcctgatacaggcccatattgctgccatatgtgatattccgtcttgagggtgagggcacatttctatatggatatatcaaactagctgtctttgagtatgttagctcgtcttatctttccatcccagaatgcatttgtggagcaggtttttgagcaagagagcctgttatcacgtattttcagcttcttctattccggtcatacctgcattatgtaaatatgtatacacagagtgtttgcttatttattcggtctgtggtgggaaaaccaagtgcattactgattcctgggctgtgcttttcagcctaaacactttctgcagctcctcattgctcacttaatgaagtgtgaactcttcaggttggcttttaggttctccgtaatctggttcctgcctgtcttccccatctccccttccatctcaggggaagccatctgcctcttcttgatccaggctcgcttttctgtcctgtctcctctgtcatctagaactttgatccaccactcctctttttcatgtgtcttcaactctccctctccaaagataatttcctgtgaatctgtcatactctatgtgctttctctactcttaaacacatccttgatcctaactgtcccttacactattgtcctctcccctcttgctgcttcgtttatatgaaccagcctttctcacctggggctgtgggtgataactaagctctgatgtcctaaggaagggacaaactgtcacctgaaagccacatgtggccaccatctttttttgtagggcttgtgggctaagaatggtttatatattttttgaaggttgaaaaaaaataattcttgacatatgaaaaatagataaaattcatatttcagtgtccacaaataaagttttattggaacacagctgggcccattcattttggtattgcctgtgactgctttggcactacagaagcaaagtgtagtagttgctgcagagaccagatggctctttgtagaaaaaggcattgattgtgtataatgaattgatttctctgcatttagaaacatgtgttatgtacgacatttgggagaattaagaagtgagtcacaggaatcacattctgtgattcagatgaggaaaccccattgcaaaagactgactctctcccttattccttagacctttgttgtccggattctggaacaagcccttctctactggaatatgtcctttggagctctcccatgacttctcagtcaccgcatctggtgggcgcttctaggtcttatcattccatcctctctgcagcacctcccactgttgaccagcttctacttctgaaattctctgttctgtctgcttagaccttgtgatctctccttgctgtctcatcctttgtctactctccccattcactgtttctttgtgtctcatctttagcaaactcccccctttcttgtagagtgcttgtagcaaaattgtgatatttacccctgtctccatgccgatgatttccagttcactgtctccccagctctgtcccactttccggggcatcatcttctctttgctgctcttctcgtgttcacttctctttggtccctcacacccctttgttctctgttgtcataagatttagaatctcagttatctgtgatgtatctcctcaactccaaatagtttatcagttgcttaatctgtgaggatattttcagcatccattcccatctccctagtccgaccactccttcagctctttcttatctttctctttcccaggctagccaatgaccatttcccctagctgttccccttcttccctgctgtgcagtcaggctgccacctgactctagcagacactttaggggcccccattacatctccttggctcacctctggtttcagtgacagctcccatgcagagtttcgcatgggcttagtttcctgctgatggtgtctcacaagttactgcaagagtctgtcttctttctgccccaggaccttcccaggagccaaatgagcctgtgcataagttcagtgtagcctgcaagtgcaattgagccagtgcctccatcaggggtaacctgcaactgatgggggactaaagctgatggattgctgcccagcctcttacctttcatgcaggcagctctgggaggcctccgtatgcttcttgggcctactggaggaggagtcatgcccattgccaagagcagcaaccttgataatgcaccctgatgttggattttcctcctcccctccctttcctgctctcttgggtcatctcccaaataagcttcctgcccccgtgtcctctcaggctccactttcagtagcattcaaaccaagacacagaccagtcttctaaaagcttctgcccagacatcttcagtggcttcacaagctccccaatatcggactgattgtgttttaaaatcctaggctccctgggtttgtttgatatcagcttatcttactaattttatcttcccctactcacctttaccctttgttttcatcaaaccaggttccttaagggcagagattgtgtcttattcatctttgtttctccatttgctcaatatccaagatctgaggaaactgaaggcaaatgtatatttttagtgagcaaattaatgaatgagtgaattgaatgtattcatcttcacatgtgcatccattgaggcattcctcctcctcattgcttagtagtgatcttcacctccactaacttgacaaagcaccccatctctaccactgtacggtacttttaaatttctactttatgtttttttacgtgtcttaacttctaatatataaattccttgagagaagcgatgttgctttattttctttatatttccccacagatcttatgggtacatggttccttaataaatgttggttgaaagactgagagaacatctcattatgtttccagacattctggggccttctgattcgttctattctctctctctctctttttttttttaatttttgagacgatggaatctcgctctgtagcccaggctggagtgcagtggtatgatcttggctcactgcaacctccatctcctgggttcaagcgattctcctgcctcagcctcccgcgtagctgggactacagttgtgtgccaccatgcctggttaatttttttgtatttttagtagagatggggtttcactatgttggccagggtggtctcaaactcctgacctcgtgatccgcctgcctcaacctcccaaagtggtgggattacaggtgtgagccactgtgcctggctgatttgttctattctctgttctccaaacatgttacatgttttctcgttcccatgaattgaagctatttatttctcctttgctttttatacatgcttcttacagtatttgcctgtttacctataaaaattctattcttccttcaagtccaagcttaaatgccatctttttcataaagcttttcccaatccaccctgttaaatcatcacctcttctgcaacacacgcctgttatacatttgtattattctgctttatgtagcataattttatgtggcttgtcttctctccttcttagagacaataagtgtattcagggcaaggctggttatgtcctcattgaatccagtaccttgctcaatgccctgcaatcaataaatatctgttggaatgaattaatttgaataggttaaataatataatcatgcttttgcatgcacatcaccttaactggtgcccctgacctatttttggtgcatgtccttgagtttcattttggtaatggaagaaatatcaagcagaagaaaagataaatacccagagctggtcaacatgatctactgtgtttgaacaggaatattggaacataacttctaagaatgccatttcaattatttgtaaaatatttaaatagtataatccaatttacattctatcatttctaacagctgtaaaatttactttacaccaaagttagctcaatcactttaattcagtctggaaaaacagtacaaatgaaagcttaatttgtatttaatctcctcttttgtttctacattattgccttcgaatcattccttttagtgattgagatttaaaccagagagaggaaaaaagcttgatgaaatatttgagaagaatataagccataatgaaaagtatgaagtcaatgttttaaaattccaactggctttgttctttggggtttcaattcatggcaatgtttttgtggtaaacctgaggtatgagatatgtgggttactttgtcagaatcacagggctataactctcaggtatttaaaactaggtgattcatttggagcaggttacatttatactctgtatatgaagattggcagggaatacaaaagtgcataattattatttagtgtgttgatcatactcgtatatttccaaatggctttatgatcattttggttagtttttctctctaagctctggcagtcttccagctaatgtcatcagcggggaacagcagcaaggagaggtggcagaattgtgactacctatggctttcctgtcactgtatagtatcaggtctgatgtggggttgggtggaggaagattccaggtaagggtagaatggccaaatgatgtgctacttcttaggatgaaacagccttctcttatttctctgttttccaggtggtggcatttatagaagtgttccagaggcccacacctgtccttacctgagcccttcttcttcatccctatacttaccacatcccaccctcacccccagcaaacctctttgaactcaagaggtggtagattgaaagaggcttcaatgaagggtacatatgccttagacttaattctgatcaataaatgtaagttaattaagtaaaagtcgggggaaagaaggggcttcaagctcatttatagccaagaagagttagagaagaccatagcattttacactttagaaagatgatttcagaagaagggatatgatgtgatgggccaagagtctaaaatgaaaaatagctaaagaggaattttcaacagtgccatcacattctcagaaaagaagaaaagggccaggcatctagacacctgtgtaactacatgggataaaattttaaaatggggcagaattgttacagaaatactgagttacacttaataagcacatttctctttgttatatcagctattctttatagcagctctgtgattttggtccaacatggagtagtgaccctacttcgtgaatgaggaaactgaggcccaaggattttagggacttgcctaaagtcacagtgctaataaaaggcagaattaagtttcaagagacctaggtattatggctccatagtgtagtgatgtttctacaatactatgctgtaaactgttggcaacatttttaacagggctgtcagaagatcaaagccacccagtgagctgaggtttataaaatatatacatctcccaaatatataatagtatatactaatgacagaggataagtcacagaagatgaggtcctctgctccactcactggaatgaatggaaagaagcacaacaacttaagttacattttggcttccaccttttctatcaattcagttcagtgagcctaaggccatccaagtgccacatctgtgtgtgcacatgcagataggcagggaatataatcatgagcaattattcagtctcagggccacatcgtcctagaagctcttgcatgccaatatcaatcacttagccatccaccagcccctggataatggtaacatgcacagggtagctgccagtattccctttaccatggccagcagcttgtgtgttctagagagagatagaagagtggtggttaccctagccaggcagttaagcataatgcagtgacaggagttactacctcatctctgaactgcttcctgctaattttggtgagacttttcaaggtatagactatacagaagtgagactgttccctctgggagctgctggtttagtgaagaagacagaaaacacatcagcggtagaatcagtgactgaggagtttggagaaggatgagaggcttcttccttatggggaaagatgacaaggccatttggccatttctttccttttctgtttttctttttcttttttttttgagacgcagattcactcttgttgcccaggatggagtgcaatggcatgatcttggctcactgcaacctccgcctcccgggttcaagcgattctcctgcctcagcctccaagtagctgggattacaggcatgcgccaccatgcccagctaattttttgcatttagtagagacggggtttcactatgttggtcaggctggtctcgaactcctgacctcaggtgatccacctgcctcagccttccaaagtgctgggattacaggcgtgagccacggtgcccagccagccatttctttttaaagaaagagaaaggtctaattggatagtagtgattggaccatggtggtaagatatgaggcctgattggaaagcagtgattggactctgttgggaagacatgagacctgatttgacagcattgattggaccctggtggtaaaacatgaggcctgattggagagtagtattggaccctggtggtaggatatgaggcctgattggagagcggtgattggaccctggtggcaagacatgcggactgattggagagcagtgattggatcctggtggtaggacatgaggcctgattgtagatcagtgattggaccctggtgggaggatatgagacctgactggggaacactgattggaccctggtgggaggacatcaggcctgattggagggcagtgattggacctggtagcaggacacatggcatgaagagaagcaggtgcagctgaggctgcagtcagcctgaagagtgtcctggggagctggctaaggaattggaatccttcttggggaggcagtgaaagttgatttgcttattttaagcaggaagtgatatgcttagatttatattttagaaatgtcacttgagggagtgatttagaacaatagactggaagggagaaaaggctggagaaggggacagtagtggaagccagtgtagaaattcagaagagagagacagaaagagaaggagagaggccctcgcgggagctatcttaaggtagatgcaggcataagaaaaaaatcgaaagaaaaatatcccaataacaaacacaaaaccccgacaaacacacagagtacctggtagacttctgcataagaggttacggagtcccaggtcctagtctagaactttctattcatgggcctgatatatagcccagggatctgcattttgataatctcccaggggcttctggtgcaggacgctagagctcttgaagttctcccttggttctgaccttcagcaaaagtaactcctcccttcatgtccttttctatgagactttcccagggggcctcatgacataacaagattcaataactacgattaagtgcttccttagtgtttggcattttgtgaagcactttaacaccagcccttttcatgagtgcctccgtgcttctcagactttaaagtgcatcatcagctgtgccccacccccaggatttctcattcaggaggtctggggcggagtgtgaaaatttgcttttctaacaagttcctacagagctgctgctggcccaccagccacattttagaacccctgctgtccaccactcataggaggggcagggattgttgtctgtatatggctcaggaaaccagagacttggctaggataagtaattttcccagagtggtagagttgcagctagaacctgtctgcctgaatctccagttcatattcttcaccacagtctcagcctttcatgatgcatgaccaggattggtggaacccattctctgctgggcttacgtcccctttccttaatgagctaaactgactttgttactgctttcttgaagtcttcctggaatcctctgccatgagttggcctcgtctgtgggcagtggaggtgtctgccttccagcagtgatttaagcatcctccaaagcatcttcccgaactgaaataccagagctgacatagtctctcaattcccaccaatacagttacccttttagttaaggctctgtctccaggttgtttcttagattgcgtgtgagctcctgggtggcatggatcacactgtatttgtgtttgtagctccacacctaatgcagtgctggactcattctaaacgggcagtaaattgagtagaacatgagtgaatgaaatatgttacttgtagggtataatagttggacctattaacctagtctaacaggcaaactagcttagaggataataggatgggtacattttgaatacctggaggtagttagtataaaaatgtgccaccttccttagtaaaagcaaaactcagaaccttccacagatagtgagactctcttgaaggggaggggctgatgggactcctgtcccaattttcctgtgatcattgctaatcgcattggtaccagggataagctgttttctcactctatccttagcacaaatgaagcagactggaacctttctcggggatgacacagggatgtcaagatgaaatcggaggagttcccttatccccctcacagggcatgcaacaggggtgtggctcgcttctttgatgccctgctgctgaaaccccttggggaagcatgcagacgggcaggtcatgaagagtgtttttggactccgaccccacagcagggtctagggttgaatgtttacagctcttgaagccccagtggcgtatgttacagtgtattctttcagttttgctgtctgcaggtggcttgtgttaatcagctcaattagaccctctggcttatcccaaggacagagggctttttgcatcccgtgttcttgccctagggtactggaaaaatcagattacatgtgggattggaggattggtgcaaggttttattgagtggtagaagtagctctcggtgaggtggatgggtgcaaagttttattgagtggtagaagtagctctcagtgaggtggatggggagccagaaggggggcatggagtgggaaggtggtcttcccctggggtagggccacccaacagctggactctcctcagaccgtcactgactgcccctgactgaattctgcgtcatcccgcctcaaaggccttgtggtgtctgctggtgtctgttggtgtgctcttctgctcctcttgatgtctagctgattgtgtctgtgcctgctagggtcttgggtttttatgagcacaggattgggggcatggtgggccagagtggtcttggaaaatgcaacatttgggtgtaaaaacaggagtgcctgttctcacttagatccatgggtacaagcccaagggtgaaaccctcaccagggaccccacccttctctacccagcacttccctgccccctcctgtatcaaagacggtaccaggagtgtagtctggctggcttccagggccccaggtgttctcctgctgacttgaccagccacctctcagagctctggagactgtcatctctgtctcaggtcatctgggcccttgcttagtggttcctgcttctatgcagtgggtgcgttccttaattcccagctccaggagcaccctcctagatacttggccccttccaaactcaggccaacggagacgtttctttcacttacctaggtctgctgtcttggacattgcttctcatccagagacacatctgttccccaggtgactctgacagacatagccttactcttcaaccgatctcacaatcccctgcccaccatcacaatatcctaatgcagtagcggtgtcagtcttataacttgagtgatgcagggtggtggcggcgtgaggagtgggctggcattttctcacaaggggcagcgaggcccagagtgtaaggaccacaggggtgaagcaggagaaggatcggacctcccgaacactcaattggctgctgcagaattttgcttccattagccctgcgtacctttgcccttagaaactctctcttcccaccaccaggttcctaccacacaattagagtagacactctttaatttccaaccgccttgagccctggaatctgcatcagcagtctggcattagccatggtcatttaccgcctcagattctaaataacatggtttgtgctgatggaaaatgccggccaggtccctatagatgtcactgcttgttgttgcgctgatgtatacatgcctatttctactggaatataaggtctgggggaagggaagagactgggatgaggctgagggcaagtgacctctcatcctttgttggtagttttcacaccaggatttggggtttgggttccttggggtcttatgaaaagccattgaggttgggaattttgcagggaggtgttttatttacctttcccctgcttggtgattctcagctctgaatgtacctttctgtatccacataccttgtggatttactttttccatttcttggaatgatgcaaaatgcctgggttatgacgaacatgggactgtattttctatatttcctttactgagtatcagaaagttatttgaactcacaacttgtttgccattcatgcttataatttcctggtatgattagcttcttctacacatgtgatccttaagaggaaaataaaatttccatgatgttagcaatattctcgtagatttatgcagtaggtataatatttaagctaattttataatgttttaaaaaaatcattgctgtttgtcggcctgattcctttgtttgcgtgtcatcagtgtccaatgagtagtatgtgtttcttccagtcattgttaaaacccaatatatggaaacagtgtttataccagcagctgttacaaatctggggctatggattaatgtcagtttctgaatgtagagtgctttagttaattccacccaaggacagatgatatcatctaggaagaaggaatatattagaaactgtcagccagaaggtagtaaaaggaggtgatatgttataaggagtactaaaaggtcattcaaagaagagatattgctaataactcaattaaaattttcacgctaacattttacaaatttctgtgtaagccctaaaacattttcaaagctagctaaattcataccatagattggaaaaacaggggtcaaataggattcacacaattcctttgtgagatgaacaaattgggataatctccttttccaggaagttctggcaagctaattcattgaaactcccttgatatctaggtgagagggtgggattttgtaagtacacactttcactggggattttctgttttctgtgttacactttggggcagggcaacccactcatttggtccttgactctcaggaaaccggtatttgctaagctggtgcatcactgcagttatgctctgtattttgctgcctggaaaacaaaaggatccatgttcttcctgcaagccaagaggcaaaacaaaaagtggagataaaggccgttagtggagcctgtacttggtgtaggagtacttccagactgtatgatgggataggaccaccatgctgcacagtcgggcagccaggacaggaaacgcaggaacagcaggttcatgagaggtcatctgaccatctgcctactctcctgtttgggaggaatgatactttcttgaagatgttcttacctggagtccacctggcttctcttagtagctctttctagtgttcagtcactgttaaggttcattcagttcttctcctgtccagtgaatataagcagatttctcttcttgctaatttttcccatagtcatggagaggaagtggtcagtatgtatggatacacatacatacatatttagcaatggctgtagctgcctccggtgtgctggtgctacagatttgatggtaaggaaaagtaaaggtggctgctgccctcctggagctcaccatctagcagaggtgaaggtcattaattataaaatcactcacataaacagatgtaaagtcacaatagggataatgaggcaggagaataagatctggaggcagggaacctaacgccgattcacgctgacttcctagaactgaatcaaaaggaaagccccaactttccacactaagtaacaaaaggacgagaggctactccctttgcaaatctctcccccccactacccctacttttctgcatggcagatggaaaattgaaagtacctctgattgatggctttttgcaaccaatcagacgtttgcataggagtgtaactttgtaacttcactttagcctctgattcgttgctttccacaaccagtgagactgattgcaggccaccacttcatttgcatggggtgaacaccaagtggccaatgagaaacctctaggaggaatttggacccccaaaagattctgtaaccagggcccttgagcctctgctcatcccactcctaccctgtggagtgtactttcattttcaataaatttctgcttttgtttgcttcattctttccttaccttgctgcgcattttgtccaattctttgtccaaacttccaagaacctagacaacttgcagtcaagaccctctcctggtaacaacaggggctaaggtttcagaaaaaggatatggtgttgtggtgggaccttgtttgaccgatggaggtctggattttcctgatgaagtgttggctcacctgggagctgaagggtgcagagttaactagaggaaaagaggagagggaagagcatcacaggcagagggcacagcaagtgcaaagcctcttgactggagggagtttggtgattatgaggaggaaccgaaaagaggcctgagtggttgttgaaggaagacgggcaaaactgaacctggggaggcgagcagggtcagttaatggaaggcctcacaggtggtggccaggaatcttattttttttaaatgtgaaataattatggaggttgtattcactgcaagccaaactcaaacttcttcttctcactgtaatataatcatagttcctttcctcttcaattctggggacctatattggaactttcagctgaggatttcaaactgaatttctttgttttttgaaattccttctgcaaaggtgtttggcatagaaatgaggacagcagctatagagcacctaaaattttctacaggtatctcaagatggagtgtcttaagagtcagaaattgtgacatgcatgaaaagataaagatatatgtcttttctatgtagcatgtacacaggaggcacttaataaatgcttgctgatgaatcagaggtgacatccagctctcaggaatgcaaaacaatgttttctgttttccagctatctgaacgttgctaacagagggcctggggaggagggacgggcacgaccgcatctgctcctctgtcctgtgtgcgtgtttggccacctgatgccaactccatgatggcacatttgtcttattaagtgtaagccaattcctctcccccttccagggccctcctgatggtggctgtggaggacagggatatgctgtgaaagcccagttattatggtctgtaaagggaggtggtggctgctggggaatgatcaaatgaagacaaatgcattgttaagtttttatggaccaaggccgcactttcattaagcgtaatttacataacataactgatgctcaaggccaaacagtccttgtgccccagtgacagtccctgacaacccatggaccgaggcctcatgcacaatcccccaggtcaggaaacctcctccttctccttgctagctcagcacgctggttgctccagtgctctcattttgacctctcaagccaaatgctgatgacatcaaagctacccattctactaccgattagcagtaaaaccatcgggcactctctgggcagagttcaggtgctatgttccttcctcttttcccacaggagttggcttcctggtctgaaccctccataagccctggctgggaattttcctcactgtgaccttgtgagcagtccctggttaccctcaaggattgtgccaagcaggctctgggttaacatcttggagagtacagagtaggctgataatcagcctatgctcaacagcacacccaagagttgaagatttctgatggcatccctggggtgctcagcagtggcctttgtctgcacccatcttcattacatgttaataccaccagagacactttgaggtcagccttttcaccttgcacggcaaagcaattatcatttcctttcattgcaggggtgggcgttggttatcacatgatggatttttgctggtaatcagaactttctgcccattggtcttcaagacatacttttgtgttgacatttacaaggtatgtgtcaggcagagccgaggtactgagtgagggaatgaaaggaggaggggggagaggatcattatattcaatttaatgacgacaatttccctacatttacaacttccagaagtaagagacaatagatgtgtgtcttctgcttgcatgtacaatgaaggagatgacatgaggagattctgttagtgggaatggtgatatattaccttaatgatttcattgcttgccaaataaaagaaaaattctcactgtagtgcaaagccctgtcctcatcaagctattcattgtgaggcgtttgttgttaaatcggaggcataaggaggggttttgaccttccataagctgcttttgaatttttatttttttcttggctaaattgatggtctgttttctttttttagtagacatacgtgaacatttgtatattgaatattgaagtttgttaatagatttgaagagctcttagatttttttggcaggtgggtgttgaattaatggaatgtttcacaatagagttcaatgaaagctcccctccactattatgctagtgtttggaagggcaggcgactttgtgtgtgtgtgtgtgtgtgtgtgtgtgtgtgtgtgtgtgtgtgtgtaggggaggggatgttttcatgtgagctgtggataaactgaacaaatttaattaaggtctaaactgaagtaggatcccatagtctaggtaggatccaagggactattttctcagggctgctggaggttggataatctgaattatagacaaggaggagtccaaagtcttagttcaaggatggcaccaagtgacaagtcctgtgatctagcagaagcagatggagaactaagaagaagatcagaaactaagatgacttggagccaactagaatgagatcatggatagacagccttgtaggctagacctagggacaggagaattagagtcttctggatttccttattacatgaacctgacagtggctgtttaaagaagcaatgcagggcctgacagtaactccttgcttggcttctgcttactctgtgtagtctgctttttctagtaggttatccagatttccaaagtggtggagtcaggtttgcatggtagagcttgggaactgaaggggaccattgtggtcatggaagtcatgagcatcattttccagtttagaagactgaggcctagggaggacagcagttgggcaggcccaacgaaaaatccagtttaggaggtccggggaggatagcagttcaggaggcctggggagaactccagtccaggaggcccggggaggacagcagttcaggaggcccagggagcactgcagttcaggaggcctggggagaactccagttcaggaggccgggggaggacagcagttcaggaggccagagaatgacagcagttcaggaggctgggggatgacagtagttcgggaggcctgggaaggacagcagttcaggaggccaggggaggacagcaggcatacccaaggcctctcaggcattgctgtgcttcctcaccctgcaatgctgccgccacatcctgttgctctctgtttgtttgattggagtggctctcctgaagctgggctgtttgcatgcttggtaggcccccttcctgaatgtgccagccagctctggagccctactcagtaactgtttcggatgtgatcctcatcagatatatttctacctactagttgtgtgactttgggcaagcctcttcacttctccaggtctcagcttttcgtaagtaaaatgttgcaaggtctctgtggaccctttcagcttaagcatgacatgttctgtaactaaggaggcccagttatagaagctcctggtgtagctgacaatgtgaatacagtcaatctcaggaatctgtggaaatggaagtgatggcttatactttggctcttcacccacctgaaagatcacgtagaggagttctctaggctgcaagctccttgaggccaggggccatgtgtcattcatttttacacatccaaagccatcaggctgtgtggtgaattgtgatgtttagtaaattgggactgactgaatatgaagtattacagaatttcagatgataagacatacttaacatagacattgcataagcataacacatgtgcctaggacatgcctcctcaaaagtgctcgctgagctccattgcagcagggaccacacctgtcttatttaccactaggtctcaagttccttgagcatgactaggcacatagaagttgtttggtatgtttgctgaatagatgaatgaataaagatatgacatgaaagaagcgtagttgaactttccaaggttatttggattatttggtgagagaatataaacctggaaaagagaagaaagtaggaaacttggtggcaatacacctagttttgctttccttccacccctaagctgtggctgaaatctcttgtacataacagaaagtgacaaccagcagccccatcttctagttgacattggtctgcagatggtttctagtgtatgactaggtaagtatagaaacagagcatatacattaggaaacttttacagaaattggacactgcatgacacccaagcatgtgattgctggatttgtttggctgaacagtgtatggaccagtttgtatattgctaaagtcataaatgaattgcacatggtgtatactgcacaccagtcctgtatggtaggaccacaaataggtctatgacatatcagggaagaaattatcctgcaccacataactagaaagaaactaggtgaaatccttggttttgtagcctagcagtcatatttttattaaaatattgatgatcttgtttgtcatgtaaagctgtttctgactcatcataatcacatattttctatgttgttgatttgagaaggactgaactagctacaccccctcagtcaaccaagttgagttataatctgtgtgacagtgtttttctctatttaaaactagctagtcttgcatggctatttaactcactcctttggcctcattagtattatcctataatcaaataagctaattaagctgtttcctatccactgatcagagaatattaaagctcggaaggtgactctagctatcctctgctccagctccttcatttttcagagccagttaaggctcagagaggttaagtaaagtgtctcaggtcacacggttatttataaaagaattgggactaaatcgtcagggccctttactcctaggttcttgtgcttttctactttatcctgaagtttaataaaattctttcagattttataacatccaaggtgtgtctctgttgtggtaagttctgggccgctatttgatagatgacctagaatggacagattttgcttgccaaataattatagatggttctacctttaagaaaacttggtatctgaaattatgaacacagggaacgaagaggtgattttatatataagtatatatacatttatacataaatgtaatatttatatataaatatatgatttatgtaaataataacaaaataatatatatgaatgaatttatagaaaaatactggctttggagagatgtggtgactgctattccttatagtctcaaaatgaggataaagctttacataaaattatgtattaatggaaaaataatggaaaaataggatacaaatatattggtacacgcacatttttagaaatgtatctataggagaaaatgagactcttctatgaattaaactagggagtgttgacggaggcctgggtgggtgaatttgtttcccccgaacatcatctctgtcttagcaggcttcagtgtggtctaactgaggtgttggcaaactttgacttgtaagccaaatcctgttgctaccttttttttttgtaaataaagttttattggaacacagctgcacccatttatatactgtcatctgtgactgtctttgagctgcaacttcagatttgtgtcattgtgacatatgctttatggcctgcaaagtctaaatgtttactatctggccctttacagaaaaagcttggtgacctctggtctagatgcatatctggttcatatcactgattctactaccataaggcagggggtcttcatttggaatctcacctagctgagttctgatagggaaggaagaaaatgaactttaatcaccttgctcagaagcctgttttaaaatccagtcaccagctgccggtttttagtttacctatgacctcctggagatcctgagagaatgaaattaaccacctctggaacaaacatccgatctttttattttttccactttcttaagagagtaataaatatagtcaatgactctggattctattactatgtaagagctctttaaaaacatctaaccatctgcttaatggccagtaatacgtttctaatggtcactctcgataagacacttttagttcactcctgtaatcgttgtccaacagccaagaggctcctgaagaatatgaccaaaggccagccccagccccagccctgtagccacagaggcctggcaacagtactgaagaaaaaaagagagagttctgagagctgcatgtggaaactcttttctttctcttgacactctccgcgtatgatgagttcgtgatccacaatagtggatctgaaaacttcgattttttttggcatttacacgttcaggtacagttgcaactagaggtcagtttaattaatatctgtcctttcctctcagatgacatacactgaaccgttgtcactagaaactccacatccctgatctgggcccagcagctggtgacagcttggcaaattatgaatttcctagcttaaaacagcctaaattgcagacaaaacaagccatcagctgagtaaatactgtatctctgtttagcttctgtaagaagaaggagattagcacgaatgtttagtgttcataattactagtaggaagcaaatattaggctcgggctgactggagattatttcattatatccaattaacacccacttgattattcttaattacttctgcatgatgacagaggagtaaagatgtcgtacttcaaatgtacaaataacatctgggccatcaacgtacatgtatttgtaatataatatcctgctcattttgggatggctaatatggtcttagcagagggatggaaaatgaaatgacaagattctggtaattactaagcgggtcttagacaagatgccaaaagtaggtattaggataaaaatgggccttttgtagcaatctagtttagacatgttttctttaaaaatgccttattacctttctgtgtaagaatttctttcttcctctgcccattgactatagtacaaagatataaatggaaatagctaagtgcaaactttccagaaaagagtgagctatatgtgtgtgtgtgtatacatgtatgtcaagtggtatgaatgggaatccctgctccaagggtgtttgtggagttttgagaaactgagacaaaatcagcctgtgtgcgagattcttaatgacctgcctagtaaagaatatgaaatgttagcaagtgatgtaatctcccaagcatgtgcgaaggataaatacagtgagccagattttcaggttcaaacctgaaattagaaccacctttaggaacactagaaatcatctttcctttcacaaggaaaaatatgaacaggtcctttcccttcagctattgtcttgagttagaaggaattgctggtagagcatagccttgctttttggagtagagattattagagtcttaggtttcccctccttgctttcttctggtgttaggggtattgcactgtcagtaacattgcaatggattattattttttttccaggatcaaactttggtattaaatcatgcttaaagatggaggtaactgtgagcagcaagaatggtgagattgggtgattgtgcaattgtgccagcacacgcctagaactggcaacttactaaagatcagagctgaacttggagaggtggcatgtgggtaccaaacaaatccggttgcagctcttgaagtcactcagcagttagttattgagaacttgcttgtgcagagcatcaaaccaggcacatgatgggggtggaatggcccaagccctccccagctggagagacaagaccattctatgatatggttatgtttaattaattgctaaattgcatggttcaaactaagggctatagaggtttggccaagagggctgggctgatcaaagaagaataagactctaagactgggacctgaagggtaggtggattttagctggttagaagatgttctggctattggtgctgtaaaggatggtggaagaaaagcctgttccatgtaagcagaaacatggcccccttatcctctgatgcaacccagctcaggcccaaggactggcgacctcagtagtcctcactgtaagcaaacgcaaagctcacatcttgagatggaagggacattgcaaaaggagagggccccaaggagatggtgttaatgaggattccctggtatctatttccattatgagggaagagacattggaaaatctgtcaaagtcaaaaattcataagtatatttaaagatttaagcctgaaatggaatatcttaggcagtcatttgaattctctctctatatatgtggtggctgatatttaaaaggcacacaaaacattaaaaaattactttgggaatagcatacccttccctgaataataaagaggtaatatcagggaatagagtagtgtcaggatgtaatcagttctcacctgacaaatgatggccagggccagggttattcatctttgctggtgatatatgaagccgatccagggttctcagagttggacagaaggggttgtttggcaggtggtgtgagggtcctgaagttggctggatcttggtagttgtgttcattttgtaggtgtgtatatgtgtgggggtcatgatgatagtgaagaggacctgtaccatgctttacaaaatgcaacaagattgacttggtacacagaggtagaagcttggatgccagctggccatggtatagagctactgtagtgttgtgtcatgtcatgttgcacatggcatgcttggcccacctgagaaaactgccaggaagctgttgaaagtttcttggcctatggctgggtgtggtggttcatgcctataattccagcactttgggaggctgaggtgggcagattacttgacatcaggagttcaagaccagcctagccaacatggtgaaacccatctctactaaaaatatgaaaattagttggccatggtggcatatgcctgtaatcccagctactcgggaggctgaggcaggagaattgccttgaactggggaggcagaggttgcagtgagccaagatcgcaccaccgcactccagcctgggcgacagagctagactcagtctcacaaaaaaaaaaaagaaagaaagaaagaaagtttcctggccatattgtgttgtgtagcgtagtggctggcccacctgagaaaactgccaggaagctgttgagaggtccctgcccttccctgtaggaagaaacaagaatggatttggcttaattactgcagacatgtgtcttatagccccttgctaccacaagtgtagtccatagacctgcagcattggcattttctaggggtttggtagaaattctgattgttgggtcccatcccagttgctgaatcagaatcagcattttcagaggagacctgagggaggggagcagaggagccatcttgatgtctgtggaggtaacagcacacacaaagccttgaggcagaagcttgctggtgactttgcaattgggtgagaaggtcattgtggtgagatggggaagcaaggtactacttcaaaggctgggtcatgggtgacctcaaaggctctggtcaggactttgggttttattgtatattagaggggaagccattgaaaggctttgacataatttgacttgattttagactcctactgatcactctggttggtggatcagagtgtgattgccatgggggtagtgggacatggtcacattctggatgttttagaagaaagagttgaaaggattggctgactggaaataccatgtaagagacagagatgaacaacaggaagagtggaggtgccatttactggcaaggaggggcagatttggggctgagaattaggttctggacatattaaactggagatgcttatcagccatccaaatggagatgtcaagaaggtaactgaattgagaggacccctgtggggaggggtcaggactggagctagaaacttgggagtttctgtcagtatgtaggtgatatttaaagtcatgaggctgaatgagatcacttcattccccaccagatacatgtagggaattagcgtgacagtgatgatcaatgggttttggtgatcatggtggtattgctggaacttaatcagctctaatgtcctctgattccatatagtgcgcttgctcgttatattccttgtctattctcattttgaatgtaattttaatattcatcaattgcagcaaaaggaagaaaatatgttattaactggacccttcagcttctgcctgtctatgccaactccagtgcacactagggaaacctggactccacactgactgggatgtccctgtcaccttgaattggctcagcccagggagctctgggtggcagggccctgaaatcctgccctattgcagcacaaagcaggatggatgagatattccaactcactacttacaggtgttctttaagggagcgcttaggaagttttactcagtttaacttaagacataagtaataccattcccaattcagggcaatggcttagaacctgactcaatgtcctttttactaagtaattatccagatttccttgctaaatgttattttatatattatgtttaatagcctctttcttttggctatggaaggatggtaatagcagccgataatgtatcacatactcatctcaaagttctgcctctggcacctgtggctggagtagagggaagcttgtggtcaggcctcagacaaattccatgtccctactcactggtcctgggttggttcacttctcaggggcctaaggaatcacagataactttttaacctttaaaacattcctcatttttaaagatttgggtaaacctatagagctcatctggccaaactgctcctttgcctcaattcagagcccccatgggacaactgtgggtaatagaaagccctagtagagaggaactgagcagcatagacttttgggcaatggttagatgtcataaatgcatgataaaaattaagccaccactgcatctcaagatagccaattccttttagtaccctgaggctggctttcagtaaaggttcactgggttggactcgtgtgataggaattaggttactgtgttgtttgtacagcgtgtgtttggtagcatgcacatgggcttcttagtgacgacctggtgatgcaaacagtcttccagtagctactggacacctactgtttgccagttgaccccctaaagagttactgagggctcagtgggtgctaggcatatagatgacaccaaaatatttgtcattgatctccatctgccctgaaattatgttctccagatagtcaaggctaaaacccacatcaaaaatatgtatgaaaacctaagagagcagggaatgacattggccattgtatttataaacaggttagacgtatttcctgccctcagagactttccagtctagaagggaagcagagtatatttgcatgaaatgccaaataacagaataatgcttagtattagtttgaaagcggaagtggcagagcttccaggaatcctgaggatgtgtgaaccttttggctacatctcagaatcacctggtgaactgttgaaaactgagatgcctgtgcccagccccagactcattgggcatctgtgtgttgaaaagttccctgggctgggcatagtggctcacacctgtaatcccagcactttgggaggccgaggcgggtggaccttgaggtcaggtgttcaagaccagcctggccacgatggggaaaccccatctctactaaaaatacaaaaattagctgggcgtggtggcatgtgcctgtaatcccagctactcaggaggctgaggcagagagttgcttgaacctaggaggtggaggtggcagtcagccgagatcacaccactgcactccagcctgggtgacagactgactccgtctcacaaaaaaaaaaaaacaaaaaaaaaagaaagaaaagttctctgggtgattctttgtttttttctttttagaacctgataatacttgattttttaattttgttttttatttttccataagttattgggggtacaggtggtatttggttatatgagtcagttctttagtggtgatttgtgagattttggtgcacccatcacctgagcagtatacactgcatcctattgtagtcttttatccctcgtccccctcccactcttccccccaagtccccaaattccattgtatcattcttatgcctttgtgtcatcatagcttagctcccacatatcagtgagaacatacgatgtctggttttcagttcctgagttgcttcactcagaataatagtctccaatctcatccaggtctctgcaaatgccgttaattccttcctttttatggctgattagtattccactgtatacatataccacagtttctttattcacttgttgattgttgggcatttaggttggttccatgattttgcaattgtgaattgtgctgctataaacatgtgtgtgcaagtatcattttcatataatgacttcttttcctctgggtagacacccaatagtgggagaaccaaaagtagatctacccccagtgattctgatacataatgaagctcaagaaccactgctttggaaggatagttggtgtgtgggtgcatgtatggagatgggcattgtagcctggcatgagaaagatgtgagaatgccataagatggggagcactgcaagactgcttggtaccatgcccctttgctgactacacaccagagacaaccagaagatctaagcgtttcagaggcaagaggcaatgaagaggagaaaaccacaattaaaagaaaaaacaacttttagatcatcagtaaacaactgagtgtgctaagtactagtctaagtgttttgtacttacataatcatcatcataaacccacaagttaggtaatactgttttccttactttcagatgagaaactggttaagtaaattaccccaaatcatgtggtttcctggcctggagggtaggatttgtttggatgaaaagtggaaatccagtgggaaagggacagctttcagaagaacttgaagtcctggagaagagattgaattttatcctgaaagccacagggaaatcctgtggttaccaccatcctttatgtgaccttactctcaatagtgagtgtttggactttattcattggatgatgggcagcttttgagccaacaaacaacatggggaaagtggtgttttaaggtgaatctgtcaggtgctgtgtagattcaagtggagggtacctagaaacagattagctaaaactaaaaccatttcctaaaacaccacaaacaacaaaagtgaatattgattgagccctcactatatgccatgtgctgtcctttacatctatcatcttcacaaaaaccctgtgaagtacatactcatcatgtacccattttacaggttaggaaaccaaggtacagagaagtaacttgctgaaggtcacacagctggctagtgtccaagtcaggattcaaattgtgttgcttgattccagaatctaggttactgtctactctgttataggctcttatatctcctaggactttggcagtgataagtggaagtggaaatagagatacatgacataaagagtaaatgtcaggtattacatgatgctggaatagtgtgagcatgcttaggaaatccccagcagggaagagttccttgcacaaagaaattgagtagggtttagaacagcacgtgaaggaaggcagaaggcctttctgaaataagcgggtttatgtttagaacatgggagaagagatagcataggaaattgccattctgatggccctgcatgtactctgataaaaaccatggaagttgtatgagaaatgagtatggtgaagtgagtagatttgttggttttggaatcagacagatgtggttgtgggttccagtccttttcttactaacctgtgacctagggcagtttgcataatctctgcatttcagttttcccatgtgtatattgaggataatagaagcatcatccttattaagatatcataaagattgagttcatgtatggaaaggagatgaaaaatatgacatattccatcaataccagctattactgttatgcttctcgttattacagtcattcatgggtgttaaaacagaataatgagatctctattttggagagagtactttggtgttagtgggtgcaacacaaactcaagagcttctaggtttccagttctggctccacctgctagctatatgatttggggtaattcacttaaccaatttctcatctgaaagcaaggaaaacagtattacctaacttgtgggttgatgatgatgattatgtaaatatgaaacacttagaatagcacttagcacactcagttgtttattgatgatccaaaagttgttgttttttcttttaattgtgattttctcctcttcattgcctcttgcctctgaaacatttagacctcttgttgtccctggtgtgtcacaggggcctgtggcctgtggcctgtggtgttgcccttgctgaatcctatttaactgttgagaatgtgtctgggtaagtagtcattgctgcctcaaaacatagattcatgagcaaagtgactatgaagatttgatgtgatatgtgggtgatgatcacacataaagggcacagcacataggttacaggaatttcgctgggctgtgaatttctgacatcagcctcctcgtttaatatttatccgccccacttctctcttacttgggacctgtactgaggcatggaccttgttccacaagggactgagagataacagtgctaactctgagagtgtgcatttgtgtgtgtgtgtgtgtgtgtgtgtgtgtgtaagagaatattagtagcctaaagggagatctcatgctgctttgctttgtttcatttttttggttgtaaagttgaataaaaggcacttagtccaaaacttcaaaaaaattgctactgggcaaagtaattttgtgtcaggcttctgttcagggcagatttacactggttataaatctctgaaattaaggtcttaccgtagaaaagctgaaatgtattcaacattagcagacacccagccctgttctgaaccagtggccattcttccgccatgtataatagcaatatctatctatgtgtttgggggcaataataagtttaaatatgcctcttagaatgggtaatggctctccaatgagtagcagaattttctatcaacaattcttttcctagaaccaaaggttaagttcaagagtttgatttaatgacaaagttaattaggcccttaacattacaggtttcttgcctttcattttctaatcaagatcatagtctaaggtcagcaaccttgcagaagtggggaacacaaggccagcacttgttcttctgatgtttggggagggtgactgtaggagatgaggagtgcttagcaatcactgagttgacaaagggcctggagaatgcctgctagacctgaagaatttcattcttacctctaccgaaccttagatataaaatatgcttgagctttaaggaaacttaaggattatctaatcagtcctttcattttacagccagggaaactgaggctaaagggactaagaaatttctcagtggttacatagttcacttgaggcagagtaatggatctcctaagattaaaccacctacttctaatcaaaatgatctatcctcaaatactcatattcaaggaaaagcaaaacctcttcttggcttataggatttatgttgtttatgagctagttttgctaaagcacttcttcctgcctttttttttttttttttttttttgagacggagtctcacgttgttgcccaggctgtagtgcagtggcacaatctcggctcactgcaacctccacctcccaggttcaagcagttctctgccccagtctcctgagtagctgggattacaggcacccaccaccacgcctggctaatttttttttgtatttttagtagagacggggtttcaccatgtgggccaggctggtcttgaactcctgacctcatgatccatctgccttggcctcccaaagtgctgggattacaggcgtgagccactgcgcctggccttcctactactttttaaagcaaatatattccatttgatcttggaccatgataaaccagtaaagactattggtttgaaacaaagaaattgcctgttgctacttagtccaagaatttaaaaaataataaaaaaagaaggaatccattagaagaaccttagggattctcataactggtcagagattgaaggacctggtaagggaaagggaaagatatcaaagcaggtccagaagttctagaaagaggacacaagacagatttctggaggcagaaacttccgtcccagcatttgacactgctgtatcataaatgaatcctcaccagctctctgtcttcatctcacttgttcctgatgcaaagtccaggtgaggaaatttaaagaattgagccaagggatttgccagtgctttgcctgccgggaaagcagggagaggagaggtatggatgctctagcttctactggaccctgggaacgggcactgcccactgaaaaaaaaaacacacattttggggaatttctcaaaacaagaaaaaaaaagagtccaggttttagattgtcccaaactcaagaaatgtctaagataaaagactttatgggtcattctgaagcttgaccttgctgtatgggaaaatatagtccaaggtacagactaattcatagataactttgggattcaatttacttctgggctcggctattcatgttttaatcttaaataggagtctgctggttcagggccttaaactttaagtgaaagttttgtggtgggatttttggactataatataggtgaccagatttggaaatacccttgaaaatgacgacatttcagaaatagtaaaaccatccatgtgtgtatctttccacacaggtacatgctctatacctggccctatgctgtgcattggttaccaagaagcagacaaaatgttgtgcccttctgcagcctgggcattagtcaggttcatatatagggtgctttgacttctcgcttatagtaaaatattcaaatgcagagaagactattgaagaaggcaagatttttggttacacgccagtacttcaaaagctccaaccctctcaaaaattattagtgtttgcttttccagaagagctgtttctaccaaacttggttcagaatcttcagcaaacatttcttaccagatgcgatgctagaataagtctagccatgaagaaccttataatccagtagaggagacagacatggaaatgaatcatttctatgaaatgcgttaagttctgagacagagatgtgcccagtgtgctacgtaaagacaaagactcacattcttcagatgcgctagcataggaaagttttcctgtagtttgtcttaatcctagaggtacaatgtaaatgcatcttctctgttcacctgtgtggtcagtcatggacagttactgggtggctgttacatgcaaggccagaatgcggggcctgtgatctagcagctaagggcatccattcagctaaagatgtcttcctttctccctttcctttccaaaaatggccaactacaacctcttagatttggggctggagtaggtgggggactgatgaagcatccattcatggctttggtacaggattcgcctaaatctggacatatccccaaagtactagttctgcagggatgaggacagagcccaggagaactgtctttggtttcaccttcctctccaatgtgttcaactcccttgcaggaatgttcttgggggagcactctgcaaatccacatcaggcccagaagagaaatgtttctttgaagacctgtctctattaatttgcatagatatttgtgtatgattttatttacattggtgaggcagaacagtagttctccagctttgatgtgtgtgagccttggagattagagctggggctcttcctttgagaaaacaaatacttttgtgttgatttctatgagatataaatcatacccaggaagtttacagttgagtaagaatggtataattactgattgtataccagaagcggacatatttatgaaaagacttgaaaaagcttgtaatcccttcccgtattttgaataactaattgctatgtcatcctggcatatttgcaccacaagagttaagtctgtcaaatgtttccctctgaaaaccttgttttaagggatttctaacttggtcgtaaaactgtgctccaagttggagctgacttgatgggagtctgtgcttggaaggcttgatttgaatggtgccagtcagagttaaattacaggctgggaaaaaggaaacaaaatttttaaaaaggaggtgtttatggttcccggttcccctaagtacttcttgaggatcaaaatagcctctttaaaataaattgcagaccattagtacatgatggaggaaacccctttgagactagattgggggaggggaaggcaagggcacaagaaaaaagagattgatttgggccactttcagcctgtgcagtgcattgccccccagcccccgcagcatgcccctggaggggttaatgcacacagatggcctttcatgtacccacagttgccatttctgtcagtctaagtggacctcactgcagatccactccaattctgaatcttgattggaatttgggtttcttggaatgtgttcttcctccatgcccacccccccacctttctttttctttttaaacaaatagaacactattgcctgccatcttatgcccttatggatcataaagtcttactgcataggaccttgagtatatcctgtctacgctgaactagagatagctgctggataatcatatttgcagagatttcttcatacttgatgccagacattcaagccaaaaaggtagtccttggctgggagtatttatttgatcccctacgtagagccagcttaggtatctctcccatccatcaacaacagacaattcaagataatgagaaagagagagagggagacagagagggaaagggagatgcaagaggaggaggagaggaggaagaagaggaagagagattgtttctatctctgtgtgagtcaccttgaactccagtggtctgggagtagcctctgtgctctagcacttaccatcaatggaagtgggacagatttatggcctggcatgttcaacctgaattcaaatctccttgtctttttaagatttcactcatgccttaatgacacctttttttttttttaagaaagctaattgcattggtttctccaagaggcatcactttgaacaatccatcctgactgtgaaaacaaatatatgcttgacttatttcatttattttctcccaaaacctaaatgaggataaagccattctggataagaagacatgtgtgtgtctttgtcacatcttttatcatcatgactgcttttccaaataatacaacttgtgacaaatgcgaacattaattacagttaacaaagaaatgtcatgtgaagtattcatggggggagaaaaaagaaccgagacaatcaatgagattacatcttgcaccaagcttcaagtcaaagtgcaaaagtcagaaatcaaataccatcagttatcaaattatgttaatgattctaatgaaagcttctggtattttgttcaagagtgtgttgctgtaatggtaactaatagaacaagagaagctgattgccgcgaattaattagaactgactgctggagtttcctttttatttatttatttaaatattgacaacctgttttagatctcgaggtttttcacgtggtctttttcttcgctccccaagtcatcaacctgccaaggagtgagaatgtaattgtgttttctcatactgtggatatctctcaccagcctcagggttttgacccagactgacagcagacaaattaaactgaagtacccctaacatttggggggttcagtatgagagtccagatgaggccccttgctcaatgctcccttctcttttccttcagccccacattccccccacaagaggcctttgcacacatccacatgggcacccagcttgcccatccaaggtctacccaccaatggctgctctttggctaccccttggccttaggggtgcatgcccgtggcaccatgcactattgagagataggacccagggaagaggtcattgcaggcgctagaaatgcttagggttgtttgagaagtgaattttgggttccgggtaatcataacatggtctactaactggggagtaggctccaggttggaaatgcccttgttccctggacctctttatcccataggggtgggaggggatggaggagggccagagtgggccttctaaagtgcttggccttgggcagggggctctagttacttggatctaaaagcagtaccggacatgcatattctttgctttggggtatctagagctctctcactaaaatctattttattctttctgtttttgtttgtttattcattccttcatttattcaacactcacttggcactgactgtgccaagctctaggacacaggaaaataaggtctctcccttcagggatctcacgggcttttcaaatttgtaatgcattaataaatactagatagagatctgttcaaagttctttgccttccagatctgccttgtattctgtcctctgagtgctgttcttttcttctttatcatggcagcaggtgttacagatcctgtggcagtgaggagggccaacccagggcttagaagaggggactgactctggttcccccgacaaccccccgtgctgctcctttagggctccccaggggcccttcagagctcccaccctctggccagagaaatgtccccactgaatccagatcagaagcagataaatggagagtctggcagggggcatcagtcccacagagaatcttctacagctatagtgaaaacgcccagtctaggaggggccgttctgactgatgactccaggcagcctgaaccaggatccttttgtggagcttctgcctagaaagtgaattgtgttaaaatcaacgtatcttgctctcatattaaaatccctctctctatttaagtcattgagggaatttcctaaattttccaccatggagggaaggttttggttataataccaaatggatattgacagggccttgctcttagaaaactaatcatgacatctgggtaactgagcacaggtcagctctgaagccctccctcctgggtgtcgggaagcacatcagactgtgttgaatttccttcgctggctaaattggtacattagggcaaaaacgatgtccacatttgcatagttgatttcattactattgccattattgatgcctagctcctctgaaagaaaggagccataaaagcaaataaaatcacttcgcgattccattattggataaattaccacattactgcctgcgttttagggctaaagccattccccgcatttgcatagtttatttcattatcattattaataacaacaacaataataatgatgatgactaggatccttgaatgaaaggaactagaaaaatgccagagcctcgagaagtctttatggactcagtgcgatcactaggagtccctttatctgctgctgaaatgcagccactccgttgcattgcaccaaccaaaagcttttaacagagctcccgttaaagcagttcagaacatgtggggccgggtgcctggtttgagatagtgactagttacttgtgcctactaaagatttaggttgggagtccctgcttagcccctaactagttctgtctcttcagggatgttgcttaaattctccaaacttcagcttcttcgcaaatgaaatggggattatgacacttgctctgctgtgtgatgaaaagcaaaagaaatggtgaatgtgaacatgttctatagaccataaaactacccatagattcaagagactaatactaccgtattgaaccttggaatgacggctgtggctgggatgctgtacagtggaggcagtggctagactgtgtctctttggctgggagaattttctaaaaaactaccataggtttctaaggcatcatcctctatgataagtagggagagcatacctgtgtatatttaccaatcttggatatttacaaatagcttactttgatagccagcatttctgggatgagctggtggccctgatagtgttctttcttactcagcaacttctaattatgccttgcttttctccttggtcatagaggcaagaagtataaagtctttttgtctattaattctgaggtcctgtagtgaaagcaaggtccactggtggccgtctatggtttgctggagaattttccccctggttttgtttttattattttattttatttctgctgtaccaggggctccaaaaaaatgaatgtgtcagtaaaggatttgacagtatgttacgacagtcatcaatccactgagccctgtagccataaataagcttcattcgctgccacactaaagaggacagtttttcttctccaggacattgaaaatgtcacagcgagggaattgtttgtccctgtctccacggcaacgccaccagcacttatcattaactttcacaccaagattttaatcagcgctctttgcggcctgagaccaagtcaacatcagcccaaattttcaaagccgttattctaattatgacgagaaagctatagattgatgagccgagttttctgcaaggactggtggcagttaattctcgtgacctgtgtggctcggggagtctctcttagagatggagtcttgaaagttcgattattagtgacagcttgtaagtgagaggagccttatctctccagagagtgttgataacttgagacaaggtttaactaggaagtagtgagacagtggaaggaggggagagagggggagaaagggaaaaaaaagtgcacactctatctgcagcgtgcatccagtgtaatgagaaaatatggacaggcacaatttcacaagttgtaaattctggtagccttcagttgtaaattctggtggaggctgttttactcggctatctgataatgtgtgaaaatatttgtccctttgcttcacaggcatgggcaagcactattttccagaaaatgcattaaacttcccagctctctcctgcctctttttttttttttttttttaaatcatagaccctctaaaaacaaaatgagaatttgtgattgaaatgaaatggtaactgatttttttttaaaaagattctccctaaatcagacctagtgtttgacagaacagtagaatgactatagtttacagtaatctattgtatgttttgaaatagctaaaaaagaataattcaaatgcttctagcataaagaaaagataaatatttaaagtgatgaatatcccaattacatcaatttgatctttaaaaattatatgaatgtatgaaattatcacatgtataccaaaaaaaaaaagagtctgtcaaaatgttaaaaaagactcttccttctcatttccctcagctgcctcccacccccagccttttttgagtcagtctaatttctagagatttggggtttgcaatgaaggggagtagcatggtgctaaccactctgtcccttcctgtttctgttggtctctcgtgttctctgctttcgttaacctggctgatgtatgtccctatgttcttggccatgcatagacaatgttcatgctgttgccatcgtcatgccttcaaacttgctcttgggaagtgggacatttccctctctctgtctaaggcattcagccgagccattagtctgctggggaggaggtgggagtgatggtcactgagtccccctagccaaaggttttttttttcttttttttaaaaatgatctcattatttgttctctagtctcttcctaagggagggtgcagaaaggtagcatggtgaggtcagaagaacctcatcctagatgctcccagtcccagctctcaccccagctccacccctgccacagaggaagactctcccctgcctctgttttctcatctttcaaatggtgatcatagtatctgtccagcctccttcacttatcaaatgagaatataggaatgaaattgctcatacttcatgtgatcattgcattaaagattatggtgcatgtgtgagcactgttggttgtcagcttttttagtttatcttcttttccagaactagaaaaatgatgatgcagttacattttatagtgttttctttttcaaattattttcacatgtttaaaaccagcaccattatctccattagctttattttgcccctgagaacactgaggcacagaaaggtgaggtatcttgcttgtggtcacacagccaattagaggtctaaccaggtatagagctaactgtggcctccgattcccagcttgcacttccctagtctcatgctgcttaccatattaataggctgggattaacgaaaaaagcaaacccaattagtttctgttgcagctcttttacaatcctgtcttgtttccctgtgtgtttatatgtatgttttaatagcattccctgccttttatgctgaggttgctcgaggtatgtttataatggtggcgtaattataataataaaatacaaatccatccacggagtgcgctcattactggctggccaggtaaaacaaacaggcctggcattgatgccgaaacaaggcagtttatttctaatgtggtgcctctttgaaacacaagatgctttacttctctagcaaaggaggccctgtcctctgaacataagtggacttgggggtgcaaggttgaacaggtaattgagacaccggggctaggttgctttaacatggtctggccttttcaatctctctttttccaggggagagttgaaaaccaagaggggaaattgttccctctgattctctgtagctgtaagatctttcctggaatatacaagtaggccctttggcattcaaactcttggacgtaggagtttctaatgtatacgaaagggaaaattattgttgtgaaaagagtcataggagagagagaatgtgtgtgtttttttaaatgcctgtctgtccttgttaattagaagtgcacatattgggaaattaactatgaaatactaaaaatgataaattattccttatttgaaagtataaattaaaggtttagtgtatataaaatttgtcatgtttaattgcaagttcaattaaaattcagggtaatgatgatttatacaggtttctgtgtaatttgatattcattagcttagccagacacatgctgatattagctcgttaattatgtttccttttgttgaaggcagccttgtgaaagcaatctgctcaaagttttctaaactcattctgctaaatgaatatttggcagctgttcatgttattgagatggtcactgtggcttcatttcactcattggccgcatcaatcataccttctctgtgacaaacaagggtttctcattacaaacccatttatgaaggttatggctgacattaaagagtgatggcatggtacgctgctgttactttacagtagcgttagagtggagctgtcgttaatatccacacctcccatgtggtcaacctgtttaaaatacgtaggaagggagggcgaaatcatcacagtggccctggtgccatttccaacaccatcggctcaaacttgggaatcaaaacttgcgtctcagaaggaggactattaagggagcagtgtctcagctccccactgtaggcttcccagggcttgccatacccagttcataggagtagatgttgaggtccagaaaagttaagggattcactcacggtggcatggtggctctgagcatgactcttgggcaggtgaaggggaaagcccaggttgcctgatgaagacgctccctgaagcctgtcatccatggtggtgatgagttggaggaatcaccatctgcctggggaaacagctgtgtaacagtcctgtgccctgcatttttggaggattataaatatttttacagattttccatagcctttattgtagggtcctcatactttacttgggatattgtggaaaggaaggtgctgtctttccaaaaggaaagctttgacaagtaggaaagctgaggcgcagagaagttttttgatttgtccaaagtcactgatgcagatactgactggccagagccagggccctgggcttctctgcacatcatgtgctacagttgtcttccctccaccagcaccttcttgcaggatggaactagacacttggtaaatggtaaaaatgtctctaggctgacccatatattagcttctactcatttgtatagtaataaattggcagtctggtttgtgatggcaaaatgcaatggaaatttcttacaagaagttatcatgtagtatgtctatagttaaatttacatacttgtgcattttttgggaggaagggtttagggactcatatacacatttctttttttctttgagagctgagtcttatgcattgggtctcctttgtaggctgatgtttcttttgaggtcgttgtgaaagagatggctggctagctctccatcgatgtcatcctcttcttccacagtggagcgttgttgctgggactacatcttccacctcctatccccatcttgctccacgtgggatcatgcgatttttgtacccacaggctctacacgcgctctttccccatctgccagttagaggtgaaggactcagaggcataggcaatggcagagtcaaacaaaatagaaggagcctgggcccctgaatcactgtgtggaaagccatgtactgaacatcaagtactgaatatctgattggacttcttatgagcatgacataaacatctattatgtttaaagtccctaaaatttcaggatttatctatcacagcatctagtattaccttaactagtaactaactccttcattcattctacaaatatttgttaaatattttgctctgggccaaatcttgggctaagggttgaggacataaggataaaaaagataaaaagatgctatttctgaccttggggaatgcaatcacatagtaagggagctatacaagtgaaaatattttaccctagtatagtaagtgctgtaaaatgtgtttaagggaggagaacccaaagaagtaatttttttgaaatatctagtgaaatagcagatttaaacttttatatttcagtaggaccttttatttggaatgaaatcatatgtgggatccttcagttcatacaacagaaaaaatctgaagggcctttagtagaaacaggagcctctaggctcatggaacctctctctgcatcctcttggcctgctctgatgtccctgcagccctggatgctgtggcgtatcctctgaaaacccacagagacagattcaagcccaaagatagactgttcttgcactgatgtatttttttttttattctgtaagttgtggtacatggtagctctgttttatagaatgcttatctctaataggtggaagttgagctggtggtaggtgaatagtttattccagaacttttatttggacacattatctatttgacctcgggtaggcttttaaactttttgcctcaatttcttcatatgtaaaacagcgataataatagtgcctatatcctagaatgattatgagaattaaacaagttaatatacataaaggactgtcataagcatgtcatttagtgaatggtcaacagtgttgggtctctgaaacccatgtgttacaaacatatcacatcatatttgtgagtacttctaaattttgatggagtaagcaaaagaatgctggaaacgacttcaatgtgtagggaatgatatcttagtaacaagattctgaaacctccggtagctaatctgtgatttccttttgcttctatgcaccactcaagttcttcttatggttttctgaaacttaggagggactggaatttttcttcatcgtgtttatagagaaatgtatcataggagaaacttgagttgggttttatttctttgacattgatgtttttcatttcacctccactcctttggagacctagacaatgtaacttagaactttttattttctaatttcgccactttatgtcttattaatgcattttgtcagtgtggaaagccctctggtggtcaaagtaattcctatgtggctcttttagatgagttggaataacatcaagttgatgttcaagagctgggttcaaattctatttttctcctttgctcatttctttttctagttaaactataaagtaaattttctattaaacaggtcttctgcagcattttagttctaaaaatgtctagggaaaaatagtggtaggacagttagctttactcaggttaaaatttattagtgatagtattaacattttggagggtttaaatgctgtgccgtccagtattttgctgtcactctaggaatgaaatgtaacatacactctgggttgaagatccttaggactctatgtaatgtaaaggctggaagtgggggacttagaatttatcgtctcatcttctagaaagagaaattggagcaagtgatttgctcaagatgtcagctgggagcaaagccatgcatagaaggcaggtcttctgtgtgtgattcctgtgctcttttagccatgttgcttgaggaatatcatagccaggccaagttcatcaatccctggtctctctaccagataccgaggtggccaggtctcatcaaactcagccataggatacttctgtccaggcaaaattcaactcatatgctttccatgggttctctgtctcttgtttggtgcgagacagggtgcaggattttctttttgtggtttagtgttgggagttgattggttgcgtcaatggagtaatctggcatgaacaatcaccctcagcatatcctcactattaaacagcattttttttttggagaggatgtgcattattctttactgtgtgctggccactgcaactcatcataaagatgaatgactgacaggtgacctatgtctggtgtcctaggagagtagataccttggagatgaagaaacatctgttccactctgacattggcaagaaaagctggcttgtccctccctttcctggtgctattgcatgggcttatattattattattattatttgagtctttggctatgtctaatgtaggctgggccccgaggctatttcttggtgcaccctgtgtgacatggtacaatcacaagaaagctgggaggtggcatggggggagcacagaagatcccctaatgtattctcaatcccagttcctgggcacagacagtgctacctgagagactgaggagctaggggctccagaaaggtagaaattcaggttaattacccagaatcttgtagtgttcctgggtcgttctctggatgtaggtacattttctcaagagactgtttaactctttacatctttgttactgtcctcattgctaaacttcacaagagcaggtaatgctggcgtttatgaaagagtgaacagctaataagataggaattcaattcacatggcttggtctgattcaggagttggggtagtaagttaaatcactcactgttcttcagtgagcatgtatgatttgagtccttatgctgtggctatctactgtgtcagatagaaaataaaatgtagcccctgccttcaaagagcttaaaagtgatttcattttgtgagcacttcctgagtgcctgccacatgcccaggatcctgctgggtgcttgaggctgaataagtccatgctgtcttcagcagaagttgtcggtgaccacctatgccctgtcagtattaccctttctgtgtacattgcccagccagcagcacctgcagctttgccttagagttttctctggtgactgaaccacttttgcttgggacagggaaggtgataaggccagagaagcaggagttggtggattaaaaactctgttatttttcatgggggtgactttgaggcacagtcttttctgtctcccagagctccccagctgcatgaactccagctggacacagtgggaacttgctcaacaatacaccatgcaccattactcatttcccccccttccctttctcatgtccccactctcccactcctagggtcacctccccaaaaatgctttcacctaaatccttcttccatcatctgtttctgaagaaaccagactataatatcttccatgctcttcacatgcctttgattgaagtaaatttctgatgaatgttgcagaggacatgcaaagtgctgaggtaaagaagagaatgggtgacagaatccaaatagaaggatcttggaagccctcttggaagaggttgcatctgaattagaattgtaggggttgggttgggctttgttaggaagttatggaaaggaagggcattccaggctgagagaacagcttctgcaaagacctggaggtgggaggaatatgaggcatatttgcaaaatggtaaatgtctgatatgtctgtagttcagggtacattagggtgggataggggaggtgaggatgagggaatgtaggaagaagaatgtaaggactgtaggtagagttctacttattgatggtttgaatgtgaggctgagacatgtagccttgcctttgtgggcagtggtgggctctcaaggtatcttagcaatggggtagtatgtgtcttttaggatgaagaagcaggaataatatatacacaaaatagaaacatgtcaagtgtgaggctattgcttatcctctaattgctggggaatttcaaactgaggagagacaagtgtgagtattcagagcagccagggagggatcaagtgagaggtagaagttgagtctagtgaatgaatagacggtagttaagagaaggttgaagccaggcatccaggacagaatgtgcaaaggctcagggacaggaataatctagctttagagatgcatcatgactttcatagacgctaggtacatgggcctttctgggtcccttcccacctaaaaaactgctagtagttttttttcttaatgattagattgataaagacaaacatgtataataatattatatattaaaacattttctggctgggtacagtggctcaggcctgtaatcccagcactttgggaggccaaggctggtggatcatgaggtcaggagttggagactagcctggccaatatggtgaaaccccgtctctactaaaaagacaaaaattagtcatgcatggtggcgcgagcctgtagtcccagctacccggggggctgaggcaggagaatcgcttgaaccaagaggcagaggttgcagtgagccaagatcgcgccactgcactccagcctggacgacacagcgagactccgtcttggggggaaaaaaaattcttctgcctgaagttaatttttcttttgactttaaacgaaatgaaaacatttttgtagtctctaaagtctcataggtcatgcgccccgtgtgcctgatagagaagtgagccctgccttttgggagccggatgaatcttcatacctccttgaggctaggctgaggtttccctcacctcttttcgtagagctgcagctttggcattaggagggagccttgggctcacctgccaggccctgagtgagaagctcgagggcacaatgtggggtggccttttaggtatacctggtggccggcatcagggtgcccctggagaggagcaaggggacaggagaacgtcctggagcccctgaaattgggtccggctttctatctgtctaggccacctgagcaggctcccatttgcttattttcccgtatgaatcccttgtgagcttatcctccaaaaggcttgccccgccgtgggggtaagtgaaagcttctctgcctgctgcagcatcaccctccttgagcgtttccactgtcagtgttgctagagaagcaccctcctgtccttctgtgtttcctcggaaatgcttacaaagaagcagaggtttacgaaatgaagtgatatcatccgaaaaaagcctgcgaaaagcaaccatggtgagaagactgcgcaaggatttttttttcctccttcttctcaaaaatagtcaaaacacatgcaacgcatacttgtaaaaggatcaaaaaaggagagaaaattgtagctggcagttgttttccccactgttatttggttgctccttagcttccagctgttgaaatggctagtttatgttaatgggtattttgcctctcctattcgtgttactttactccaaatttaaaaatgaacctgtgactttatttatcccatgtgctgggaaaacagagatgcagccttttctgtctatatgatttgcattgtaaggatgcacttacactgccatataagtacataaaattttcatttttgtgagcagggacatattttgagcctctttttttccagttctttctccaaagttaagaagcataattcaataagtgaatgctgtctcccaatatcagagacccattttctgctgtgatagaagatctattggttcccttttatggatctgaaattgtgattggcatgtcatggtcaagatatcacctagagtacacatccctcagttaactaacctctctcttatccttcttctcaaatgatctttcttgtaaactgggttgaatcatgtgtatttggtttcttaattatagacaaatttctcactggatgaaaagtctgctaattagtgattttaaatgtcatccagatatattagtagacaggtgttattttagaaatacagggcaacatgacctcttgtgttgtaacctatacaaaggtaaaagtctatatggtgttatttaatgacaaaagaaaaataaaatcctcaaaatacacctccttcccctcatatgcactcactggcccattgaagaaccaggttgttatcttgttatctgactggattaagttactatgtcatgactgactacaaatactatagctttatattataatgtcagagaagtttaaagctgaagaggccttagaaattctcatgtctaaccttctttttttttttttttttttttttttttttgagacagagtattgccctgtcacccaggctgaagtgcagtggcatgatcgtgatctcagcactgcaacctctgtctcccaggttcaagcaattctcctgcctcagcctcctgagtagctgggattataggcacctgccatcatgcccagctaatttttgtatttttagtagacatgaggtttcaccatgttggccaggcttgtcttgaactgctgacctcaggtgatctgcctgtctcggcctcccaaagtgctaggattataggcgtgagccactgtacctggccctaacttttatttatttattaattaaattatttatagagacaaggcctcctgcctcagcctcctagagtgctgggatgataggtatgagccagcaagtctggcctcgtgtctaacctttttaatttaacagttgagagaactgaggttcagagaggttaagtgacttatccagatcacagtttgtaggacgacctaggcttgactccatgtcttcatttcccaagttttgggccctttctaagctctgaactaggctactttatttagattcagggggcagttaccaggtgactgggctaggcagtgtgggtattctggagttgagtgagacatggtccacctaagaggctgtctattcagctagctctgcagggggatagggtcagaatataagtagctagaataccaggccagtgagttggtgtcataaaattggccaccgttcctgtggactgaatacttaatgagggagtggtcctacctcatggtatcagggaaggcaccttagaagagacaatgacatctgaagtgggtttggatgtacagattgggcttttataggtgctagagtaggtcttattgggcccattggtattaattgtgtccaggaagacagagacttgtctagaggttggaagtacctgatgattctcatagtcctgctttgtcaccatcttggctttcagctctggggctgtcaggaatgggcatggccattgccaggcctatgtgtgtgtgtgtgtgtgtgtgtgtgtgtgtgggtgggtgtgcatgtgtgtataccgaccaccatagcccgtgagccttccctgaaggatgctgctcctgcaagcaccaagtaccaaggaggctaagcagtgggtgcaggcaggacatgcagtgcctggcagcagagactgccaggcacacatggctattgctggctgggctcctcagagctctgggcctggcaagagagaggcagcaggggtgaggcagcccctacctggatgggatggctatttcccagcgcctcattccccaggaggtcacctcgtttctagaggtgctgcctcttgccttgcaaacagagtcagacctgccataaggccacaggggacttagaaaaaccgtccccaccccaccagggctgcctggcacataccctctgctctgccatgcttttctgaatctttaaaataagtttttcattaattttagcatacagtgaagggaagtaacctgtggcttataaataatggcaacagctttatggaaacacctaaaaatcaccaggggcacataacaagaaagttctccatctccaggtgcgaaaacacgctggtgattacttgttgagcaagaccctgtcagcttttttattacaatacattattgggtaatagttttaaaattatttatagaaagaaatcgagctgtgccgagaattccatcatttaatatgttgtctgtgaatctcattagcctttttagcctaggggttaggaaggaaaacagagcgttggctgtattttgaagattgagcactatatacactttttgtcgggggcttgttgaccttatgttaagttgcttctttgcgagtctttctgtgttacagctctggtttccatggtatttacataaacctagcaacagtttgctgtgtagaggcagtggcagggcccaccatctcctctgccaagaaggaggagcagcttaggatgcctgctgtgcaggccatcaatgggcaagtctctttcaggtaagttacagaataggtaagaattggggtgagatgggatgtcagctgctccccagtgtatgtgtggcctctcctctgtctccaggtgacagaggcagctccagtattctgtttttgaaacccatccggtgagttctcccatctagccccaggccaagcagcatgggtctcggcagaagctcatcctgggagtgggctgctctagagaacacgactccatgctgtccccaggcctgtgttctccactgaccccacagctgcatggccagtaggccttaggctaagttcaggaaggacccatctgaaatactcctcctaaatgaagagccgttctctggtataagagggatgttagtgtggtcagaacaaggctaaatccggaatcgggagagtgtgacaaatatcaacgaatggattattttcaaatgtgatctctctaatcagctgtgcagggtgataagaaagagcaaggggcttggacactggccccagaatggtgcaatgagttctttatacctcacaacatggcaggaacatttaaaaaacaaggtaaaaggaagtcactgggagcaaacagaagaagtgaagagctgacttagagcacagtgaccttgggcaaataaacttctataagtctcggtttctttctccataaattcagaataatggtacgtaccccgccttggtacttggtgcttgcaggagcagcatcctgcagggaaggctcacaggctgtggtggtcggtgcacacacatgcacacccacacatgcacatgtgcgcacacacacacacacacacacacaggcctggcactggccatgcccattcctgacacccccagagctgaaagccaagatggtgacaaagcaggactatgagaatcatcaggtacttccaagctctagacaacctctgatttctgtgagaacttgatgagatcatggaaattaagcattcagagcagtgtcacggctcactggggtcgagcaagtagaaaatctgggattcaaacccagacagtctagccgtagaacagtggcctttaccactaccctattgtattatgccattctttcattggtataaagaactatttgagactgggtaatttatttttttaaaaagagccttagttggctcacagttctacaggctgtacaggaagcatagcagcatctgcttctggggaggcctcagggagtttccaatcacggtggaaggcaaagagggagcgggcacatcacgtggggaaagcaggagcgagcgagagagaggagcaggaggtgccacaccctttcaaataaccagatctcgcaggaactcactaggacagcaccaaggggatggtgctaaatcattcataagaaatccacccccatgatccaatcacctcccaccagaccccacctttaatattagggattacgatccaacatgagatttagaagggacacatatccaaactatatcaactatgatgcctccaacaccttcagaagcagatgtcttgaactgagccataagcaatgtggagaatcaagccaggtggagaagaggggctttgactttggagcatagagagcatagagtaggtaagtatgaatgtgaggccttcatgggaacctgccccattcttgcctttattcacctgtttagtttaaagacgttgattgggcaccagttatatttcaacccaggcactgtgtgtgaagaaaaaaaaagatggagcagacagttcctcccacaaatagttgggagttaggagagttgtcctgcagagtaaaaagagaaaataacagctttatgagtagttaccatgtgtcaggcgtgattttgtgggctttacgtatcttaaatcattggatcctcacaagggccgtaggaagtaggtgccgttattaatgtctattttagacaggaggacctgaggttctaaagaggcttagtgaattgactgaagtcatagaactgaccggggacaaagccgggatgcgaagctgggcagcctggcctctgattcctggctctgaaatttctctctatggcctgtatgatgctaatcatgggcagctccaaagctgtcggggatgtttagtctaggggttgactaagaaacaggagaatagtgaaggctcaagattcatttactcagctggtctgcaaatttttattcttggcatcatttggaatgtgtttcagcagtgtagatgattttatcttacaggttttattcagctcagtgccatgcaggtgcaattggagcatacagatcctgtgcaccgccactcgttgagctgtgtgtggccaaacacaggtacaggaaagctcagcacctgggcctttagggttttgcctactcagtgttctaagatgtagagatatttctgtaggagggagtgatagtaggtttttggatccaaggaatctcagttagggaggtccttggagctcatctcatgaaaactcaatggcttaccccccgaaaaaggctttctgaaatctttaggcattctgtaaagttgtatctaaggttaagagaattgaaactgcagcttttatggagatgtctgcctggattagatatgtttcctctttctccctgggatgtgccacctggagaaggtccagggagcagccctgtggcttttgagaaatggttcagtttgctctggggccttctgatgcttctctgacacgtccgagtaggcagcatttttttttaaacccttgattttcagaaacgcattgtccctgagttattaataattatctctctctcctctctactctttctttctctcactctgaaaatcaacatcaacttgactaaatcccttgagttgagcttagtccagtttttcagttttcttctgcagctgaacactcaatgcttgattctcctgggggttgggtttagggccctccctatgttcccagtctctaggcctagtaagtacattgttttggaaagcctcttccctttcagtgctggctccctagagaccttcaaaacatcttgggtcagaaagtgcaatccaagcaagcctagatggtacaccacccccacccaaaagatccggatttgagattacccccaggacttttcctgttgatggcacatttgacttacagtatagtaatgtgtagtgctttttctctatgagcacttcataagcatccttcggtgatcatgacttagaaatgattggagaacctgcttgttcagaaggccagatgtttcacaagaaaatgaaggacagaggtctcccagtcagcaatattagtagtcttgggataatagcattggcaggagtctaaaagtttgtctgataccaactccttgctataacttatccaatccagccctctctatgcgctttacagataaggaagccaaagtatatagaggaaaattcccaaggatagtcacatagctgattgttatggcagagctgcgttatccttagcattgtaccacattcctccttcttctctggctctcagattttctagcacaaagagcaaaaacaaaaacaaccccaaagactagaaaatgaaacacagctcagcctgggttttataatgccagtcataggaggtgctcaataaatgcttatgacttgctgcacccccaggaagtactgcctcttctttatgtgcatagcttcgcgcagttgcaggcatgattccagcctctggagatgtctgatagggtgtgcggatgggccatgttgttccactagagtaatttcctagagagaggagagaagggagctctcattttgtatgtggtctgtctaatgcctctcacatccaataactttaaaaccaatcaaattaataatgtagggagaaacaaatggattcactctttagatatttaaacagggatatttctgccactgacatgtaaatctttaataggatatgagatttggcaataagaaaaaatgccaagttgctggagacctggttcttttgtactattttaggtccaatcattacctcctgacattaccttcctcaaataggtttatttgttgaggccctactttgtattgggtagtgtgtatttaatactgggatgtaaagtagtggaatatatggtacttaccctcacaggacttccactctgctgatgacagacatatatgtgtagaaagatgaatacaaatacagatcagtaagtgcagaatgtcagcctagttctgtatgtaatcactgctgcagatattcatgggaggaatggatgatgtgtagggctaattagccttcaaatagggaagctcatgctgtgaaatattttcacctggtcaaaggatgaggggctgaatcttgactcccataggagacaaaggatctggagagattttcagatagtcactgaagatttccagttgaagtagaaaaaagctttgtgtttgtgtctgtgtgcatgcatgtgtgcatgtgggcatatgtgcatgcaagcttatctacatggttgtatagacatttctgtcttttagattccaaagtgacttcctggagtgatagtgaggctcctcaaaacttggtttaaaaccaacctgaagcattctttattttcaagatctaaaatttctagaagctcttgttgtgaggaagttttcataaaaccatatttacatatccccttcctccttctgatccttcctggcatttaatattgataaacttcctattcccttgcccacctctattttctgtcatctggacttattaatgtgtcttaacagtaaactcttgcatcctccaattgttctcctcttccttccccccaacattggcctccttttactttttatctctttcgttttcttccactatagtgagttagaagaaccaaatgtaaacttgtagcaagtctttcttctgggttgatatctgtttcctgcccatcctggtggccagacttcccaacaatgggggaaagtcatggcgtctgtttcattccttccatgctccatcaagaagaccgctttttaggatcaatttcctccctttctggaaaattgctcactatttagaaagaagaagtgttcctactctgaagctttcaattgttgccaccttaatggtctctctcattattcccaggcatgacagcatgagttttggtttggtttgccttccttgacatatcagaatggttgagatgaccttgcttgatggaccatgggcataaaggaactggttggttgagtgtcaagaccaggaaaaagtatggatctgtccttgttgggagccctcttgtctacttgcttggttcttattagccagtttggaggttgccttctgccatcttcctttcatctgtgtggttcatcatgaatcctggcctagcttctcctccttaccttatgcttaccctttgatgcagagttccaacattaatgtctgcctttccaacttccacatattacactgccctctacttcccactgtgggcataactcactgactgcaggactgtttctccagaatgtggatgagacctcagaatccttctcagcaatgtcctgagggtagacaccagctgatcagttttatcatgaaaattgaaacctatcttctctccctggatcttaccaaagtactcattttcatcttcagcctagatgtcttgctagacttttttcttccctattctttccatctatttcctatactttgttcttcatctattattggtggtgatggtgatatccatatttatcacactcttacagtgtgccagaatataaaggctacaggtatcatctcatttagactttaaagtcactctaagggatactgatactattttacaaatgggggcccagagaggttaagtgactttcctaaggtcacataattcatcagtgtctgagctgaacctgaaacacactctgcccttttctccctgcctctgcactaccttttacttccttagtacctcattacatcttccatagtcactgaattttattctttgtcattgcggcttatttaaatactgactgtattggaaaaattaaaattatggtatccttaataaaataacattgaagagggtatagatgtctgcactgggaatattctttgtgtgtgaaacaaaaattcaacttgttatagtcaatgaagtcaatggttcagttaataatgcctctaatggcataattctgctcagtgccggtgatgggtaccctcaaaatcagagactagatttaatgacaggacatgtagaaatcagcgctgtcataaaaacagccgggagaggaactccataggagaggaaaacccctagaaatggcttgacgttattggttccagtctcataaatctcagtctccgatccttcccgtgattccccctttccatccagctgcacctaagtgttccccctttgcagtgaatgcttgcatttcccagtgagtttcctgtgcttagagatttgtttttagatcaatgccattttttatgtgttgctcatgcatggaagagctctactttctctgcttgttctaaataggagaaaataattttaaagactccttttaaggtgtcttaagactcctctgtgtgtgacacccttcagaggaatgaccttccattttagggattcccttttttgcacccctcccttacccccttgcattggagtaagtctcttgagactcactacggcctaggaccaggatgtaggccaagtggaaacacaccaaagtgatttaatagaaaaggtaattcctattcaaacgggatagtcccttattcatttcctcggattatcatcaaatttatgtcaccagcaaaggagctttattgagtttcacagagatattccttttgctctcattgtcgttagttggcacgctgacattttcatatgtgtctcagctaatgcctcaaaattactccatctacaaatgtaacaattgaacagataattttaataagattcagcttgacttcagactgcactccttcctttctttatagaatgcaaattgtaacctgtttttaaagccgtgcaatgcagtgaactttaatgggatttgacaacatcatattaagcacaacaactacgcataatgtaccgaaaaattggacgtgaaattggaaacatagctgagaacaaagtaaatttacatggtttggtagcttgaatgtctgatatcatattctctcatgcaagccccataaaaaagcaaaggatttaacaatggatatcagcagaaagtgcttttaaagttaaaactgatggatggcttgtcaaaaaaaataattgcattggttggaaagtcgggatgcgtgctgagggggagagaacaggatatacagagaggatgatgggaagtgacagtggtctgtcaggaaggactggctgcccagaggagtgtgaagccagagctataaggtggcagagtagaacaggctgtcagagcgggaaagtggctttaataccctgaaaagcaaaggaatccgcctgtcagctttgctcagccgtgctgaaagaggaagagaacatggcataaagttagagacattaaacaagggggtgggggcgcagagagcagcgcggagagcacaggcagggagtgggaaggaggtgggggaggcttcgtatgtgggtttctggatatgttctttcctattatattttcccccttttctcaagggccaacaaattaaatttgaggggctggggtttctctgcttttgaagaaacgggtgatttaagagagtcacatgctcgtcccagtggctgccactctagttgaatgggtggctttcttacaagtgcacctcgggttgccttggccgatttctggcttttcagatctacagcctcctctgctgacctttctcctcatcggagtatgcagtccattctcccagagatgacaccaataccaagtcgtcctgggactggcttattgtctgacaaagtgctgtgaggatgtgacactttagctatgtaagaggattgtgagtaaaacacaataatctgatttttttttgtaaattttttttgccctctcagcattaggttttgaataatttattattccttcttcatatactcctggcggtgaggttaatttggtcatcttgcaggggcctggctggtaatgaacatttttatatcaggcctcggagtactttctccgtaagacataccacatgtttaccacttaattgcccaagttgcttgagagtgttagcgtctgggggggttggaatatggcagtttattgtacagaaatattttgtgtatttgatcttaaaaaatatattctgagagacatccaaattcttgaactgcatatggccccaatataattttacatttggtttagtagtttggagggggggagcttctttccaaagagataattatgtcattgtggaggaagaaggtgatggtggcagtggtggtggtaatggtggcagcagcagacacttacataagcattttctttttcttttttttttttggagacagagtctcgctggagtgcagtgacacagtctcggttcactgcagcctctgcctcctgggttcaggtgattctcctgtctcagtctcccaagtagctgggattacgggtgcctgccagcatgcttggctagtttttgtattttttgtagagacaggttttcaccatgttggccaggctggtctcgaactacgaactactgacctcgtataatctggctgcctcatttattacataccaggcagtattcatttagctcccataacaactctagggataggttctattaatattgcctctgtgcagagaaggaaactgagccccagagaggttaagtaacttgcagtcattgaattagaattcaaattcaggtagtctggtagcagagtccattcttttaatccatgtgctaggtacacataggcatgtggggaaccctgaaatgccaggtggagtcctgttgtgcctctattattcttgtgtgtctaaggctttctgggaaggattttattagaactgggcatcaactgcctggaaagcaggttgagccacctagcagggagcaagaccacagagctatcttctctgtgttagccgagtaaaaagtggagcaggggagagaaaagatgaaacagtggcaggaggatctttcctggtcacaaaagttaaccaacttccaagttagattcaaaacacttgtctgaaatttttcatctagtgctctgcagagacatgtatgtttacactctgcattcagttctaggttatagtaagccggtttccagaagatggagacctgcactcctggttttcctagaacctagctggagaagccgggtggcagcccgcccacctttttatcttgattttatgcagtatactatgaaattgctcactaaagagattaattagtggggtcttcacctgggtgtttatgggcatgtttggcagtttgggattgctcccgtgttcttcaagcctgcagggcacgtcttgtggattgcagtggtgtgctaccacactctagcacccactcatgctgctgttattttggtttcctgggcctgtaactttgctgtaaacaagcaaaattgctttctactcagtgggctgtttcctgacacagcaggagaccttgttgtttttctcctggaaatctctgggcttctcctatcctatctgatacttagaaggaacccttgcagacttacatattacagtaaggcgcacacttgtcacggatctgggttgacttcagtgtgtctttaggaagcctcccctagtgctccacgctgccctctggctgcagcaaacctaaaagctggagagcaatactgccagtctcaagttgcaccatcagggacaccactgagatttcaactcttgaatcaaagaatttaggattggaatggatagagcttaactagccttttcagtgcctcagctcaggggtctccagcgatagggaattcattatacccagaagcagcacaagccaacttatctgagacaagtagggtttgttcttaagatgagccaaatgtgtttctctagaatttccatccattggtccttttcctaactccctggggctacaaagatcccaggtgttaaatttgtgcatcccataaaccactgtaaaactgtataagtcttcagcctgtagagatctgcctgttttctccttcacttgttcgttccatcatgttcaatggagatattaatagctagagagagcttctatcaagactcttccctcttcctcttctcctcacttcttccttccagcccactcttcccaaccttgctctgcactttttatggctcacctactctttcaacagaatccaattccttgctttaatttcaggtagccctgagtccagaatttaggtgttcgaggaaggacctcctgaattgaggtaagggaataagacacattccccaaaatgagactgtaatcaagtggtgctatttccactttgcaaatgaggtaactgaagtttagaaaggttaagttacttgcccaaggacacacagctagtaaacagtaaagtagatttggactcaggtctgccgacaataaagcctcagctatttacaaagcaggtctaatgtactggttataattatggattctggagcccagcaggcctgggttcaagtctccatatactaattggtgaccttgggaaagttatttagcctctctgtatctcagtgtcctcattggtggaacagtaataataatgctacctgcctcacagggttgttgtgaaaattaaatgagaaaaagcatgtaaagcagttggcacagcacctgtatgtgataaccactcagtaagttttagtttaacatcatcatcatcatcatcatcatcatcatcatcatcatctatttttaaaattatgatagagaatgtcagagctttgcacggttggctatggagcctgaaatgtggccacctaactcttggggtggggggtgaattcacgcggcagggagctgcaaataaccctttggtggatgctttacaatggaggctgggtggggtctgggaagagtggcagtggctatgattattattttttagttttgggtttttttttttacactttgagaagattgctacagttatctggaaatctattgctcgggcaaaagcaggattgcgtgatacaatttaaaaggccggcagctgcatttcatccttttcacaagaaaataaccccttactccagtgaagctaaaaataaaaatggcagtacatttggcaaccacgcttcttcctttattacctcagcagtatctgaataaaatgtcttattaagcaagatataagggcaatgaaagggagagtaagtcaaattagttgacatctaaagcatggtgcatcatataccgcgagggtagttactgtttagtaaaatggatttaatgcttaatataaatgctgatatttagatggctatattttggcaactcaggaggaagagaggtggtttttgagctggtataactaggttttaggtcctttcctgacacaaaccactcatgtggcactgggtggcatgctccataaccttgggccccacttcctccatgtgctaaaggaagggtgttttctggcacccagtggctctgtggcaggatctcagggtaatctgggaagagtggcaaaaacagggctctgaatacccaccccactcagacaggtgcaacactgcctgtatctgctttacatattgggacaactgggtgagattttctttggggaaaggattacacgaataaaacataggttgtcaaaccaccagatttgattatttctaaggaaccctacaattctcacctttgaaagttccaccatgccaagtttgaactggctctgaaagcactctgggtcctgtttcagctctaccacctacagtgcccagaaaggacctcggggtccaggagacagggcagtgcactagatacagcacaaggtagggtgtgaccagggaagaaaagtggtggcaaatcccattataaacatggatggatgcaggcttgtgtgcctgtatacatgtgtaagtgcatatacaagcatttaaatgcatgatctatgtgtgtgtgtgtgtgtgtaaatgaatgcgtttgtgcatatgttggtagaattcatgtacaaatcggtttcttacatttgtgcatagagaagatgtatgcacagccataccatcgttggccaactgttgtctcatttatgccagccatcaccttggtgggttaaccttcattttcgtggttgaagtgaggaaactgagtcttacagaagctaagtaacctccccaagttacatggctaacagtttgcagagtagagggatcatactgtattaggtatttgttttatatatgcctgggatagtgccttactattagggccctggtccacatagccctcaaatttctgtgtgatgaggagagtctcatatatgacagggaccactgtgggttagtcttttagaattttggttttgtttgatttcttgtttcattacttttgggatcctgtagttgagggttacaatgacatagcatgaccagggcttatcccaaccactcttttcccaaaaatgactaaataatgtcgtcaggagtttgttcaggatttccttctttgagagcttccttccaaaacttcttttgtgacagagttgggagcctattgaaaaatgaggctgatcagtcacaagtcctattatgcaaagtcattcttaggtactattggcaagtaactgaatgcaatcctagcaaagaccttaggaaatcttgtttccttttattcataccatgaagcacattgaagactgtcagtcatcctgcttccttggaatcatatgctgagaggcttttattctgaagaaaatcatgaaacctgcgaatagatttatgctctgcttctaatggttcatgaagcctaagtatatctaataatagttctttcacctgatttgcctaagactaagatcttgtataaacaactctcaccagaaccatcaatcactgtttaggaatttaaattttaccaactaaaatgagaatggaggaagggcaagctgttttctgtgttgagcttaggccttttatagatacaacactttggggaatttctcggtgtcttagttggagatgaggagaaactggagcctttgcacactgcaggtgagagcatagattggtgcagccatttggagaaatctggacttactagctaaataaaatatatgtaatgtatgacagaggtcaactcctagatctataactcagcaaagttttatggtaagcagacattcgatgatggtgatgatcatgtctttgttgctggtttcagtgattgtgactgttagactgaaggctatttgagttgtagtttattgacaagtggtcaagacccttttcagggtatattctcaataagccatttgtcaaagttgctgagagagccttcatctatctccactcctatgcttcatacctgctatatattctttgagtgcaatgttcatttagttgatgttgctggaatgtttttgtgagtgttaattgtgattcttagaaaagaagtaatcttggacattaaaaacatagaatccccaagttgagatttgagattatttaattcaactaataagcctaataagaattccagctatagttattcttataggtgatctgcttagattctcccagtactgggacatttgccacatccagagttattagaacattctaccagggacagatagactacaaagtattggtactattaggcaaagttgcaggattttgccaactgaaaccccaaggcattttctaaggaacagacaagagacaattatgccatcctatctagttcccgctactgcatcaatttgcttgggagctaaaactgctttttactctaaaaacaagttgaaaaacctgagtatctctccagggtggaatcagctgcatatacccagggagataaaacggtctgaagatgtcatgggcattgtgaatagggacagcagaggttacatccagtgtcagaagtcagtcaactcataggcattcttgctgaagaaaagaggcaggaaggtcactgccaaatgtgaccttgcctgaacatataaataactgttcatgtgtctaaattgtcatcattaattaagtagtgtttcatattaaaggctctcagtccagaatctccgttactttatagatgtctgtagcctcatgaagacccagatttctaggatatcagcgggggaatcatctcaaatgatgatagtaatagacatcttggtccctcaatagaagatgggattgccaaaatacttctggaagtcattactgatgttataagtcaaggatctgaatggaaggaaaatgcaaaaccagaatctgtattatttccttcctctaagcttctgctcaaggaagtccacccaagaatgctggtgcatcagtgagactctttagcagagagaagagattccaggcctactgatgcttggaacagccactctcatcagcaatactgagctacctgcttctcttgctggggaagtcctgtccatggagccggctttaccagctgtgcagtcatactcagggtgtgcaatgttactgatttaggagcccatgttcacacattaggatcaacccaaaccatcatatcctattgtatgtcttcttcccctcaccatgtcaaagctatgttaggtcacgaaatccctgacagctcagtcacacacagagtgcccagctcaacaacagaaccagaggttcatgaagtcagttttgctgttattgtgagaaaagacaaattgcaaattatctcaataaaaagctgttatcatttatatcaataacaagttttttgggttctcatttcaagcttgattatattagtacatttatagtgtcttttgttttttccctgtggctgtactttcttaagaagctggaagactaataaacactgatgctcttttgccacagatttcatctatgattttgatttaaagctttctgatcagtatagctgactgatcaagccacatggctgcaaattacttatcttgggttctccttccaattgggtataatagaggggatggctgtagagaaactcattaaagaactcaactatttgggaagctgaggcaggaggacagcctgaggccaggagttcaagaccagcctggcaacatggggagacttctggtctacaaaaataaaaataaattatctgggtgtggtagtatgcacctgtggtctctgttacttgggaggctgaggtgggagatcacttgagtccaagaattcaaggctgcagtgagctatgattgtgtttctgcactctagcctgggcaatagagtgagactctatctcaaacaaaacaaaccaaaacaacagaaaaaaaaaccaatgaaaaagaaactcgactaatctaagcaaccagcctgagtaaattatctgcccccttccatgaaaccttgaaaacataaaatcatgttgtttattccaaaggctagtagttatcactttatcttggctattctaaagtgcagtacttttgtgaattttgctcattaagtaacttactgaagttttatttaggagtctagaatggatgataatgttgaagattgttagggataatgtcaagctacttgacataatcaaccaaaaatgctgtatatgaaaggtgttttgtaaaccattaaattacttaaccaaagccttagtcaagaatcagtattaattcttcagaatcattcaggcgtagattccttttgaaagtgacttaagatgctcacagatactctagttctagccctttctgaaatagtcacaggtgctttcaacacatggctggccagatgctatcatttctgacagtgggtctgaatttaaggaagttgtggacaggaaccttatctgagctgtcaccatcctgactcatcaccttcaagcaaataatcaggctaaaaggataggctactgggacatcctaggaggatgctagaggagattggccaacgagattcactggactcttagtctctcaacctgtcactccacgctcatccatggaaattggctctgattcattactaatggagaaatagttcaagacttgctttgcatccctacacctatgtttggatgaggacttcaagagtgagaatacatttcagatacagttatggctaaattgtagtctttgcatgaaaaagaaatgacctggtccttgttaagagcagtggattcagcccaaggtggtttcctgatatagcagttgaagttgcagaagattcagagtgcaatgtatgtccctgcaagatactgtagggccagtaatgtttgtagcagtaattcctgtctggtcatgcatctgctagaatgtcgtatctagtactctgcacccactaccacctcgtagaaatagcttcacaagttatatggaggattggtgagacaggtgggagggtattcgctccaaggaggagaatgctgtgagatagccattttttctgcctttatattcttgttggggatatgttttttaggtgcctgtagctgtctcctgctgaatgggctttgttcagagatgcatttgcctgtataagggttgtggttttagaagactgcttatctccctcctagttgctcactcttacataggacagccatgtccagctgtaaaggtaatatactgcacagctgtaaacagcatccctaagaacaagtacatcaggaaatgtcttggggttcctagtagcagttagtgatgagaggaccaagcagctccagccttcttggttagctctgtggccttaggtaagctattcaacaatagtagtccttcatttctgagtctgcaaaatgtgcatgggtcctgggtaaggagaaggcatcacctgctgacctaaggaaagtgaaatatgagtgaatgcctttatgctttctttatggcataaacatgttaattacactcattacacacctcagagtgtccagtgccagcctttcccctgagccatttcctttgctatggacctttcggttttctgggacactttggtaaaaggatggagacagcaattaaatatgccttagaattattgtcattccatgttttatttttgccttgggtgtctttatgggagagaggaaaggccaggagaggtatgggccagtagacccctggctacccttggaggtgtcctttctctgaaccttgagttgaaagcatttatagggaaggaaaaagcttagatttcttctgtttaaatacttttcttccaatagaagacagagtgtgtgccagtgccagagacctgggtaacagtgagaaccttgaagaggcagtgagggcataaagggtgtgctcctggctagtggggaagagagacaagtttggtgcaggggtctaggtaccactcggccagcaggatgggcactctcggtcagtgcctgcaaatggtgttgatgtcagtttcctgttcatctgggaatgtcctggcaacacatgctggtttgtttcaggctaagccactacctggaggcagtgtgaatgcgaagaaattgggttgctccctttttcttttagaacagttttcctcttaaatagttctgtacaacagttggagccaatctatttataactgagttttattgaacctgatggggcttcactctcattgagtccatcagcggagatttccctcttgggcttttttcatggcaggagggtttcctggcttaatgggtgctctgtcactagtgctcctggtccctggtccagcttctctcttggtttgctctcagtttctcatcccaaagggaactcactacagccactcccaaagaaacaagaatcctttttctttcccgtctccatccttcccttactcctgccactgcattctgctactctctccccacaaattccctcaaagccttgaggatcccaagaaagagaagggcaagggtgaaaaatttaaaactgcccaagatggatagtgaaaacaccatgcataaataaatttcagcaaatcccccggatgaacaatgattgtgtggttgaagacctggctgaataagtgtgtcaggtactgattggaagcatgataaatgcaatgacctaacaaaggattgacttctcctgcagacaggccccttttaatggatggaaagggaggaagcttcatttagaagggaaaggctgtttgctgtgcagatatgacaaaggggaagtagacaaccattgatttacgtttgggaatgacagttgaaaaattcagcaataatcatgacaaatgagaagagatgcagtcagaggaaaaaatgtcaatacgttaagcctgcaaagaaatgccaaggtcacagagaaaggttcccaaacttctggttttgacaaccttaatggaaataataggaaagatgagggttcaggttaaaagggatggcagggcatgaagggctgcaggtgtgggtaattagtggtgagtttggagagggagtggcaggaagtccttctcccaccactgggaagccgtctgtccacatgcaactgaggtgcttcctgctgctggcaggcctgccctcctcccagaggtttggaaaatcaggcaagttattttaatgtcagtagtgacagcagaaagagagaatgtgggctgggtgtgcttgtgatgcttgacggggcacatcaaatcagaggtttagctctgatctcaggactgcagtgtgtctgccccctcatttttatttttattttattttattttattttgtttaaaagactgattataagtgagaggcagtgagctctaggttatctgcctggttgagtttggtaagatgtctccttgttttatatttatcattgttgtaaagcacccggtacattgagtcctacatttctgcactctaataagagaggcacaatccaggatgttctgtctgtgggcgtgagaagtgggtttaaaaatgtgcatatgtggatagggagggaggtgacctgggaaggtgtggaggaatcctcagacctgggtcattgtttactactaactctgtatgtaaatgtggacaatttgctttacttctccagagtctgacgagctcatctttaaaatggagaaattctggagggaaaaggtttctgacattctcttcctggtatataattccaggattcaatattatatctagacatggtgtgtggttttaggcctatttgcatatctatttgtatatacaaatacatatctcacatatttacccgcacatatctttttgcttcactgtgttggtctgtttgggctgctgtaacaaattaccacagattgggttggttataaacagcagatacttatttctcagcgttctggagactgggagatccaagctcaaggcagcagtaggttaggtgtctggtgaggtcttactttatggttcatagacagcgacgtcatattgtgtcttcacataggggcaaacaaaatctctctgaggtctcttttataagggcactaatcccattcaggggggctccactcttatgacctcaccacctcccaaagatcctacaccctaacaccatcaccttgtgggttaggctttcaatatatggcttttgggacacaaacattcagatcatagcattcagccatgcatgtatttcagtattttagtctgcagttaacactgtcttctcatctttattttggtttattctcatctaaatattgtttatggacttaaccctcaatattataaaatcatccttctgtttactgggtaaaaatgatgactcatatagtttttacttttgggggaagaagccctaacacccctaaaatacgtatattgtgaaaccagttaccagttccaagaatgacaagatactctctgtgggaattcttcagcttcagacaacgtttgaactatgactacatttttgctaaatttgttgaacagagataaatatttttaaaatcttattttatttatgtgaaatcatgtgccaggaaaagctccaccctaaatgaaaaatgattttattttaagccaagcaactccttttagataagccttgaagagaagttatctcatttaaaagaatgagccattttggagctgctgttgtatcacaattcctcttgtcagccgagtagcttgggggcctggccctcacagggttatccccaagccttgtgtcaccactggcacgtggctgttttcatttgaattgtttgagcatgtgaaagttcaaagtaaagcaggtgctgtgtttgaaagcaacactgccccccgtaactcaagcatgtgcaccatcgagttgccaaaagctctccaatttccatcagttaagacaccctttaaaccatagaaatgaaggggggcaggactgggttataaatgagtgggatctggtatttgagataatcttgaatctataatggtttcttacgacttcacttccacctggggctgcggagcgggcgtgtaaggaaagaagcctcttagattaaacattttctaatcagctttatcactcatatctgaatttatcttatttgaggaaaatgccaatatattagcaggcatgtatgatacacaaggtgaccctaccaacttaatgacataatacattatccttaatgaagtcaatatcttgtcttttagctgtctgtctattggggcgattaattgcagtgtcattaaagttagctctcttttcatttgagcttgacaagtcgcataaaactaatgttcttagttatcagctactggaataggatggaggatggaggaaattgtaggacaaataaggggtactgctacagctaacttgaaggactttttccagtgactgtttctttaggtctctcctttcccaggctctcttgttaggtgaaatttaaggcaaaggtagatggctctgatttagccaagggttcaagaaggagagaagaagatgctactgagaattacacccaatttgggagattttgagccatttagtaacaggagcttgattactgtcagggtttctccactaaataaatttgccacgttacctcctagaccaagctgctagcctagcctgagagaggagccgataaagaacacttgcaaccatgttttcatttagctttgaagtttttctaatttaacaggctttttggaagaagggaggactgaggatgggagaagggatttgtgcccgaaccatgctttgcaaatggttccaataaacaccagctcatcatgggcaatgtgggagctatagcgcctggtccggcactaattgtgaagccaaagcatcactccctgccttccccctacctctggaactacgagacaggatggctgtaatttacagtgtgttatctttgtctatagcggcaagatgatatgaagtaaatcaaggtacgagtaatgaaagactgagaatttattccttggagcacactttaaagtgtagtatctgttatagtggcactgcctgaagaccctgaaatgagacttggatgaagggcaataaagcagcatagaggctcatgttaatattgtttgtctgaggttagtaattgggttctactgatgagttgtgtgaagacaaagtgagaatcccagctagtattgtaaatcttacattgttggaacaagaagcaatcctaacaaatattgatcctctccgtgcccagaggcgaggagggaagcagcgaactgcagagcactggcctgtttcaatagcaccaattaccttagtgaaaccagcgctcggcatgaaatcccagggtggccgcaaacgatgaattagccatgattaggctttttagatggatccccccaaaatcatgccagcttaacattctgtctcaattatccttgtggtcctaaaaacatattttgtgtgaagtgataccttccagtggtgaggggccctggacctgtgtgggaaccagatgcaaatatatggccagctgctgccttcaacacagaggggctggagtatgtgcacttgagagtgaccactggacagatgcagctttccactctgaattcactgaacaccccatatttggggacacataccccacaagcatttgactttgttgttgtttttggttgtgttgtgttctgttttccctatttgtcgtgaattatgtcctaaagatccttggagagatgttctccaggggagaaaaggcatatctgctctgtgattttggggggctggcttcctgttcatttttaatgtgaagatctgctaaaggtctgtgctcatcttgtttggatacacagtctccttcctgggaatcttccctgagttctcactgggttgcattttggacccatgggaaagagagagtgttgataaaacctagagaggtcacattccactttgttacttcctaggagttcgcagcttttctctcctccattacctttggctgtgagtgtgcagtcagtactctcagaggtcattcctcaggccagatccggactttgggctggggtgaactaggtaggtatttggctctcaggcttcctagtccccatcctctgtacagcatcaaccttgtgcacactgcccagccaaatggctttggctgggagaagagccttccctgggggacttcaaagcatgtatttggtctttgatatgacactgtgacatgtttgtaccaacacacgtgcctttagcagaagaaagataacatcagaccccccaaatctggcagagggtgagcaagagtttggatgaagagaactatgcaccttctgggactaaaatgggagagggcacattttcaggattccacgacccagtcattaattaggtgatgaattcaacagatatttattgagtacctaacttaattctggatacacagttgagtaagatggagtttacattctagtagtgggaggtagcgatggtgatggaatataaacaaaataggggcaatttctgatgtaaactgaaaaatacagaaggcattattggggcagtaagcggctgggggtgggaagggcgtgttgataaccaggtggactgaaaggcctttgttctcctcatactacacacctggcatctggagccacctgtcccctcatgcatctgtgcccagtcttctttctggtggttgctctcacactgttctgaggacagctgaagtgccctggaccccatgtgtctgttcattttccaaggctcaggtaaaaagccgtgccttccacgaagccattctggtttccaccaactaaaagtgagagtttgcaccctgagttcctgtgtaacctcctatctctgttccacattggcacttggcactttctgtcttgtgttagagtagctttgcgtcccatctcatcgccactccttgcctgtgagttccttaagtacaggaactatgtacctataatatcttatccctgatatactcagcagtgtcttgtgcttagtaggtgcttcataaatattcattaaataaaataattacagagaaaagctagggaaatttatggggtgtgtgtgtgtgtgcgcgcgcgtgtgtgtgtgttgagggggtgtttgaaatagtctggggtttgatctaatacatagaaatgcttccatgaaatagaaatgccttacagttgtgtgtagctatttcactgagtgggtttgttatatctgaatggactagtgatgtctgcctgcctctctgggtaacaaacacattttggagggattgttaacttgaaggttgtaataaaatctttaccactctgaacagctagcattggtgtctgctaagggggaacaaaggcaaaacgtagttctgttggtgaaaatagtttgactgtgtttaaaaactaatcattctgcaaatatcaacaagctcagcagatgcaagctagccaccttatagtttaaatggagcccttcacgctgtattggaaatgccgccgcctccagcccaccctatactccacaggccagctcctgctcttctggccaaggaaaggcgagtaagcaagtctattgcccgttggcctcctgagacacctctgaggattaaataactaatgactgtaaagtgctctgtgaaaagagagtgctctataaagtgttattgttggggctgttaaaaatggaaaacgacttttaatttagaaagagaacactcagcataaggaggggtggctataaagcttttatcaccactttgctttcggaggcttcttagctgttggtgttggcgccatggtttgcttgcccaggggttctgtcaccgttcatggggtttaggaaagatgccagcatctcactggcatggtgccatcctgatccccttcctgcattgtaacctcgtgggcagatctgcgacttgattggcttgggttgcctaacattgattagaatttcctaagagcgagccacctggaatgtagagtatcctgtgatctggtagcttcaggaagcccccaaagcagccatgcagaccacaaaccacttgtaaagattggggactgatgacaatcatgccatgtggacagtatccaggccctccttccatctcttgaggaataggactcagctcctctttctgttcaatgaggatattgagtttttatcctaaattcagaatttcaccaactccttctaggctccttgttcatgtcctactctctccatgtcacatttatgtggttgggaggtttaaaatatagtgttatacctctgcagtctgtattattattttacatattatacattttgtgtggatttgtaatcacagcgtgtagggtttgcttgggcaggttctcatttctaacatgtcatcctgccagtgggatggaggctctctggtcttcttcttctttggctcctctgactccaaacacttcaacacctacccttcctcagcgacgtgcagccccttcaagaagagagcccataaactcagtgtttatcatacaaatgtggtgatgtgtttgcatttttatgacccagctaagtggtgagtattcatttgtgccacctcaccccagatgcccatccagaggctgagctgtttatcatgctcatctctttcccaaagcctgaacaaggagcttgggaccactataaacatgttccctttcaataaagaggaaattattatcatatattttggtaataaccaataacatttcaaattacttacatttatggcttataatcaagcttatgcttaacctctaatcctcatgaagctggtgatgatgggctcggtagttaaccacttgcgggaagttaagggcaggtagaaatccacctgaccagtaattaaccagagaagcaacccatttctgcagttgagattataaacactgtgcttggtttatgtttaattggcaacaagtgaggtgaaccccattagttttgcagtgatgccctggaggatttggcctggtcaacttctcatcaattaatgtgctgatgagggatgctggttgctgcacactgggtctttgggttcctggtctttgtttctttagctgagcatttgaggagattgcttggaacatagttcatggctggcaattgaaggatcacagagacattgctctctctgtaactatgtgttctgattgcggttttcagtagtcttttgtttgaagtcctatcatccatgagtctggatttgtgtgggatatgaactactgtgatgctacaagtcatgtacttagattggcttttgagttgaccattcatttggagaggcttatataaagaaatgggccactttgtggtcaggccatttttgtctccgagtaggttaggaacagggatccaagggagtctggttccaggatggatgtttcttaactgttagatgaagttaaagggttctaaattggatggcttagcaaaagcacccactgatgttttcagcaaaaaaaaaaaaaaaaggactatgagatagaatcttccagagtccactcttgtttcactgctttgaggattatacctttaagcacattttaacttctaaatcatcccaccaggaatctcctatgacactcatggaggagctttataaacaacttagtcatcccaacaacctgtgatgaaagtactattctcccaccattttacagatgagaaaacagaagctcagagagcttcagtgatttgtcctaggcaaaacatctaaaaggtacacagccagaaataattagttttgtctaatatcaaaactcatgctcttaactgctgtactttattcttacttttatgtcattagaaagaaaaatgtcccaagcaagtggaattatcatggatttcctctctgttatagaaccaagaatgtgaattgatctcctgtgatatgttagctgctgtatttgggactcagtggcatattgggagatattgacatattaatccaaatcaaacagttcatttttggatgataaactattagagattatttgctcagtttattagcaccagtggattagagattggccatggttgcttagcttcatgaaatagtagggctgaaaggagctttgggtagttatctagctcaattcaacacttattcaacaattatttattgaggacctgctatatgctcatgctgcatgtggttgtatgctctgctctgctgtctcacatacacttataatcatgtactacaatgttaacattttgcttaaatcgctatatatctttgaaagaaattgaaagaagtgagctttacatgttaccccatatttgtcttttccactgatcttcattcctttttgtagaagagaaatttcatctggtaatatttctttccagcctgaataatttctttgaatattttttcttttatcagctttctggcaacaaattctgtttttgtccatccaaagttgtctttatgttgccttcattttcgaagaatattttcattggatataaaattctgacttgatttttgttgttttagcagtttacagaggccattccatcatctctggcctccattgtttcttatgggaagtcaattgtcactatttaatcattgttcccacatgaagtatcatttttctttgcttttaatattttctccttatctttgattttcagaattcagaggttaatattcataggtatgattttctttgattttgtgctatggatttctgtaagtttcttctatctgcgtgtttaagctttttgtttttaccaaatttgtgggggttttttgccattgatcttcatatatatttttttctgctccattctatttttttctcctactgagactctaattgcatgtatgttagaccatttaaaatactctcataggtcacagtgtctctgtttactgtttctaaaatcctttttttctgtatccttctggttagataatttctattaatctaccttcaaggtcactgaacttttcccatttctgttctcctgttaaggtcaaatcatgtgtgtgtctgtgtatatacacatatatatctatatgtatatatatataaaataaaatatatatgtatattttattataaatattgtgctttttagtttccacattttctttggttccttttaaaattctagttctctaatgagaattcccttctatccatctgttcattcattataatcatcttttcccttaagaccttgttcatgcttattacagctactttaaagcatttgagtcttaattacaaaatctgggttatctcaatgttaatatctactggcttttaaaaaaaactcttgactatgggtcacattgccctgtttcctattcttatgttgtctagtaatttattgttgtgtcctggacattgtagacaatacattgtatagacactgatagattgcaatttctggtattacctttccctcctccccactttttaaaaagcatgctgagattttgttctagcaggcagctaacttggctggactcaaattactaattgagtctctcatgtggaaagtagcccctgaaatctgtggtcagttctttcagacttccagttgttacttttcactctgtcttgtaatcttcccagcatatgtgcagtttagggtcatctcaggatttagttgtaggattttgcagactttgtagccttaccctttgttgttctcttctttctgggatcactcccttcactttccaactgttctgccagtggcaaaattcatccttaaccacccaagaagaagcagaaaggtgacttcctgcttgcattttagccactccatcttgcagacttctgttaagggccagcttccatctagcttctgtctgcttttggtttctttccggtacccacatgtagtagtttttagaatattttgtccaaattttataattttcatcaatgggagggtttgtttaatataagctactctatcattactggaagttgaactttagatcttctcattgtttaagagaagacggaaatatatagatttttctgtgaaatctcttgattatttactctgggcagctacattgatatttaaaacaccttgtgtagggaaaaaaatcatgcctatgggctaaatatggcccctagaccctcagtttgcaaaatttgatctagttcagcttgccattttagagatggggaaataagttcagagaggggatgtgacttctctgaggccatctggtatatcattgcagattttcaactagaactaaggtttctgactttcagctatatatctcttttgttaggccaagttattgtccctttctctgtctgctagaataggcaactgctcagatgcactggctaggattcccatgggagacatcagagaataacccctgcaaagagtgggaaagcagtaagaccagctggagaaggagcaccatcgtgggccattactggactgcttttttctcttccacttggcccacttgatatttggggcactgtgaggacaggcagacagctgcctggtggactgactcagtcctcctgaatctagctctcttccagtcattcttatgtttaaggttaccaattctccgctgtgcccatgtgagctatttgatgttctcatccaaagcactgtcacgctagataacttttttcctgaactctgtcctgtcaccaaatgtcactgtgcccctgtgcagggagacatggagcatctgactgcacatgggccttgggatgcttctctcataaatggcagatttaggaccagacaaggaattggtgcaccagccataaatcctgagaagaataatgccagattcatctggctgctggcgtttgatttgtgggtgtgtgaaaggtcgcacaacctcttagaggagtatggtggggaaaatatggttcggattgcccatcctagctccttcttgggctttggatgctctacaagtaggcaaatggaaacagtaaatatttgggattccagatctggtcctttcccattttataacattagtaactttgtccttaaaccttagtttccctttctgggctcctttcatcttctatggtagttacatcccgcctgctacagactcctctcgtgttctcggccactcaccttaggcaggggtccactcttaggagaagatcttatgtcagccacaaacccccagtgcaacaacactgcagaactctaagaaacctttcaagacttctggttgaacaccttcacgtcacataggaggaactggggctgaaaggaacaggaagccactggaagcctgtagctggttaggggcagagacacatctggaactcagttttctaggccctgccccacccatccagtgcttttcttcacctcactggaaccattttgctttggcgtgaaattgtctaaaccattttatctggggtaaaaatcctctcggcctaagggtggacaatttgccccaccttctcttgcccttaatcctagtgtggtactagttttaactgtatgaaattgccaatatctgaccagtcttgacctacaaaaatgtcagttttgtgcggttcaacctaattctggcctttttctttgggtgagtgttgatttgggggatgagttggctcaggtgaccggaacatggtgctgatgagctgagatcacaggtcagaggactgtgtagctttccaagcttgtctgtttccccatgctagttcgcaagcctcacttcaggcagccatcctgacagcagtgctcccattgctgggctccggatattcatgtaggcaggtgcccagagtgcgaggaggcccatgtccattccatgccactgcagtagaagggaaggggagggacccttgggtactgatgagcctgactttgagtcctgggtctaccccttttagctgggtgaccttgggcaagttcttaagttctctggtttttagttttctccttttaaaatgagaataaaaagattttcttcatgatttgtgaaagttaagtggcacgatatgcaaaagtacttggtcagtgcttggcacatagtaggggctctataaacagttatttccgaaaacacacacatacttcacggtaccagagtgctgagcctttgactttgggcagcactttgcaccaattcatagatctctcccctttctgcctgtctcttctgaatcttagagctcgttgtttcaatgttcttgctcgattattggattctgtagataaagttcgtcctcacagggagactgtatttttgttgagggcagtgatattatttgggacccccactattacttcttcagccttaggtccatagaagggccttgaatgaaataaattgttgaataaaacaagcttctttgcagacactcacatgcccactgtataatccagtagagacctccccagcagtgtttgcataatgttatacgttccagccccacatttaatggttggtgattgtgagggttaaaggtggcttttctcaaattgtagactggctcttagagtctgacaccagcactctatgtcctttgaggggagaattctccttccacccatagattatcagagaatcccagccaagttccaattgccctgtgataatgcagtactttgttcccgagcaggttaggaactgatatccccattatgtggcatatcatgaaatgaatgttattgttaagtgtaaggacagggcatattagtggtatcttttattacgcagtcttcattataaaagaacagctattgctaaagtagtccccatttgataggtagtgggacattgttcttgtgttgttggtgctgattaaggctgggataatgcactgttcctgcctgttacgtccatcaggaaacaaggccgaccaaggtaaaatagatgagcgtatgttggcgacagattaaaaagactagtgtaaagtccattaataattctcatatttaggatttggtttctactgtacttactgaatctgcaacatttaatctcttctatgtgagaccagctgagagaaccttttctcccccttctgagtgataggcctggattttccgagacagtgcatttgtctgtcaggacccatggctgctgtggtgatttacttgccatcagatgatgttggtgtccggttggtgatatagccttgctggatatggggaaatttgttacctttagctttgacaggaagataattgctgatggttaacagaactgagccaaatccattggtttttcagtaacacaagcataagactggctttgagaaccctgcttttccctgcatacacttcaattctaagcttttgtgtgtgtgtgtaaaatgtgtgtgtgtgcatgtgtgtgtttgtatcttgagggaaatgcaccagactccagattattctccttcttttaaaaaaaattgctgcagcgtactagcatgaggcctgaagaagtgtttgttcactctacaaagaaaagaccttaggtgagttggaagtgggtgtttaggaggggtgtcctggaataccagaagcagctggccacttgcaaaaaaggtttgtcgttagtagggcattgttttgttaggcatctctcctgagaatacataaatctgggcctccatcatgtagcttgtcaatttgtcttcacactgtgcaatcaagtgattggttcaacaatgccttgtaatgtttgagccttgagggcttctcagtaaaagtcttaaaatgttggaaagaaacttagaaagtctcaggggatagccatgtgcttcaaagagcagcgtgcaggttctggacctgggatgatgatgggctcacgtggttttcctaggcacaagggttgggggaaggccatggggtataattggaggagtcttaggaagaaatttagagaaggaatagaactatcctctagcccttcctctctcatcctttggccattacaatgaagggtccctgggaagccccaatattatgcttctctccttgggcaccctcgatttggagcttgtgatgatctacctcagtggcacaacaggctttgaaaacacccatatttacccatagggaagcttgctttttgaggaagccagagatgcaaccttctatctgcaggtactgtgtaccaagagcaccagttctcacctcccttttcttctgccccaaggaaaatttccattttgccccaagatgttgcgaagagggcatgaagtgtggatactaccaaggctgccatgtgctagtgtcatgacgttttcttggtgacaggaatactctttctgaagcccagagaactctaggtccttccagttttgcaggagagggtctctggaatcaccttggttccccaaagcagaaaatctagaagagtccttgccaagacggcaaaatgtgtgaggggaaccagatgttgccctccctgttcagccctgaatgtgggtggctgtggcctttggaggctggggtcaccccccttcctcattgctcacatctgtccagtgaccaggtactcataatcttttattaagagactcatcagctctgcccttctttccctctctgtagccactgcccagggccaatggcactcatcacttcctccctcaatgtttgcaatggcacctcagctagtttgtgccttcagcttccctgtccttgaatatatgctactcattgacttgaagcttacccttctaagaccctgagctgaccagagagctctgacagcagtttgctgtgtctctattgcttcctaccttatgtcatagacagctctgttcacacatgccccctctttccttccagactgcaccctgtttgagggccgactcagcattttgtgtttgttctgagatgttcattcctttcattcctgcttgtttagttctcttatcattcaaggcccaacatcagagccatcactcctgggagatgttttctctttctgctaattgaagtcctcttcggggacttgttatattattaatgacaatactttttgtgcacacctactagctggtaagtcccttgaagtccagggccctatggtgccctattcttcctccctatcacctggcattgccctctgcacacagtgatcactcaggaacctttaatgagtgaatgaatgaagctagagtgtgatgatctccttatggctcctggattgtttcttgctagtgcctggtaaatgacttagttttctatgttgatgtttcattgagaacctactgcgcacacatcagtggttagtcctggaaagcagggtaagatccatgtgccaccacttcctgattccatgcccaaggcagacatcactggtggccacagtgttcactctcagtgaggcccaatatcgcctgtgaacttggctccacgtgtcattcctggcagctgctacccatcattagttagtatttgaagtgtaactgtcctgccatccctggttcagctatgatgagaggtcctgagaaagctgacattgtcctttcccaagggaatttacagttcactaaggagattaagtaaatattttaaaagtacttagtatgtggaagatttaagtagtcacacaaggcactaagtggttcagagctaagcgagtggtggtgggcggtagcaggcagtaataatctggggagcttggaaagtgaggaatgctgagccactgcagtcagagccgacttcctggaggaggtggctttaacacctagaggaattgggagaacagtctgtggcaggaggagaaacagcccaagcagctcctcagaggaggcaggccaaagagggaagagctttagattcttttcttatggtcagggcaacctctagcaatggaaagcccagatgtctcaaagacctggacggcactgccatggcattctccttgatttgcgagctggtgcatagtcctgaagagtcccttttaaaattcttcactctgaggaatcacttaaaacaaatcatgattcttgaaatctgcctctaacccccaaatagttttttttccacggtgaagaactggaatatttctgtgtgtttgctttgctctccatgggtaacctctcttcctgcatgataaatacacatttgaaaatattgatttgctgctacccctttgaaaagcttaagaaggctgacctctgcctcagcgttctctgacttgaatttttcagactgaccaattgacccctggaaaggctgagaaacgttacctgcggtcctggagggactttctgggggacggaggccacggtggtggcggccacttggcaaatgcctgaaaggagggccttttaataaaatgcagtatgtccatggctcaaatctaatgacttttaaatagctcctgggaagaggaaagcctccatggtggagcccaggagtcaccccgggggaagtgccattttccagactcatctcagaaaccctggggtcccctcagccccaagtacatggggctgtgttgggcctcaaagtttgcttcttctcaacctcccaccccgaccccgccgattgctcctcgttttattttctttccttggttttaccacggtatgacctcgtgttgtattttttctgaatgacaatgaaagtaattgaaaatattgattggcagtacagttaagttgtcaacacaaccatttaatttgtcaggaggacttgttaaattgtcaaaaatcatataaaaaaactccttcagtcactgatgatatacattagagatgttcatgaatcaaatgggccattttggagataagtgttgaagaaaaattctgaaatgggtttcttcagatacgtttgtgttctctcccactctctctctctctgatcacacattacaaagaatattggaacgattttggcaaggcaaggtgagtgagggatacttttttgagtagaggcctcactaagggtatcatggcagaaataagatcatttatagcaattaaattagaagattctaatgcggatgccatcaagttatttattaggacaaacgggttgggaagttcctttcctccttatatgtaggatttaaaatatgtgtcttggaatatttttttcttacggaaattctttttttcttttttgagacagagtcttactctgtcacccaggctggagtgcagtggtgctctcggctcactgcaacctccgcctcccgggttcaagcaattctcatgcctcagtctcccaagtagctgggattacaggtgcacaccaccatgcccagctaccttttgtatttttagtagagatggggtttcaccatgttggccaggctggtcttgaactccagatctcaggttatccgcctgcctcagtctcccaaagttctgggattataggtgtgaaccactgcacccagcaggaaattgtctttttaaaaattatttaattttttaagagacagggtctcgttctgttgttcaggcttgagtgcaggggtgtgatcatggctcactgcagccttgacctcctgggctcaagccattctcccacctcagcctcctgagtagctgggaccacaggcacacaccaccatgcccagctaatcggtttttaaaattttttatagagatagcggtctcactatatagcccaggctggtcttgaactcctggcctcaagcgatccttctgcctcagcctcccaaattgctggaatttacaggtgtgagccaccatgcctagcaggaaattgtcttttaggggctcttggctgctgactctgccagccctgtgtgaggctgagtgggtaataccagcttcctgttcagatatgtggggccctgttgaaaccctcctgcattttcactgctgctagtaatttagttcctgaagggtctatgtgcccaaatgaaattggaagtagctttatttattttagattaatttaagaatagtgctatctgctaccccttggtcaaaatgagtcaagtcattcttgacattgttagtttttagctctatttaataaaataatgtattagggctcagaaatccaacttgattcagcttgagggaataaaggattttattggaaagctactcaggtcactcctatagttcacaggagggctggtgtggtaggcagaatactaagaatggcccccgcagtattccttgtcccctagtgcccagcctctgtaatgtgatgagatatcactgccctgattctgttgtgttacatggagtggtggatcttaaaaagggggattatccaggtgggccgaatctaatcacacaggatctgaaagcgcagaactttcttcacctggttgaagcagagaaagtcctagatattcaaagagagagagggatttgacatgctcttgctggcgtgacaatggaggggctcacgagaaggatcgggcagctcctagaagcagaaagtggatcacagccagcagccagcaaggagtcagagacatcagctgtacagctgcaaggaactgaattctgcctgccacctgaatgagctcagaaggcgatcttttcccccagcgtatctggttgagagcacagacatgtggggactaacaccttgattttggccttgtgataccctgagcatagaacccagctgaggggtggagcagttgtgtgcagtcctaggattggggttatgcacctgaccaaggtctatcccgatgataggcagccccccaccgtaagctcatatgcagccccaaaagaagggaatgcagttctgggaagataatataataaatgcttgctaaaagtcatactgcatctcatgttgctaaaatgcatgtttttcacattttatgactctgaaatgggggtgcatctttccaaagcatggtgacttctgaaagaaagctgctggccagggtctgccatgtttgtctctgcctatgcttgggcagccttggcagctgttcctggtggctcctctcaactgtaacccctagggtttcagtcagcaaaccactgaacggccatttgaggaaagattctaagtctagttattgtctgaaaaccttctgttgacatttcctggtaagattgagaaagtgctagtatcaaaacttgcagaacgcttgttggcggctgcagcagctatgctcttgagtgacagagaagatgatattttgtgtgagaaacacaaacatcgataaactctgagttgaaaattgattctgaaaagtcaggcagtgagtgggagaagttttgggaatgctttattccatgtatttcacctatgtatatttttatgaatgcacacaagtgataaaagtctgtgtctacattaatccaaaagagctattttaataagtataaaataaaaatgccaagtgattggaaagcattgtgtggcagtttaattgctttgtttttctcagtgttacataaaatcatgctgtattaaaatcaacggcacattagattcatataattttaaataaaacattttagtatattacacattggttatcttgtaagatagggatattttacttggaaaagtggagactggggttttggcattgtgatgggctgcaaaaattggtgtcttttaaaattcagaattgctgaggtgtctgttgattagactgtaagagaaaggactgaatgcttgatgcaggttgaaattgtgccaatcatgtgtcccagcctccatgctccacaaacatttactgccactctctgccacctgagatgcctctgggctctcacctggaatctgtgattaaacatgagttggttgggaggtgaggcattgagaccatgagtggttggggtaggtgtccttggaatttataacatggctttgctttgtttctggcccaaggtggtattctgctgtcacagaaagaacacaccagaccacattttcatggcatctttaccattacctagctgtgagactttgatctcaatatttacctgctttggcagtctctatttctgcattaatgtaacaaaagagctaaactatagtgcctcaaattttgtttctagcactaatattttgttttcaaaaaatgtgctcagtgtctcccttgttgcatttctttgacttctcatttctggtatacatttgttcgtatttttggagttcctgtggcttgctgagccctatgctgagttatgcatgggagaaaagctgaagatggtatccttatcctcagggagctcttccatggcatttcagagagaggatagatatctgaaaatgggagtatgtctttatttttaatatagcatgaaaaaagaaagtttattagttatctattgcaatgtaatacattactacaaaacctagtagcttaaaccaatttatatttattatctcctaatttctatgggcaagggatttagtagcaacttagataagtggttctagctcagggtctctaaagaaattgtagtcaagatatattgtcaggactgcagtcacctgaaggcttgactggagctagaggatatgcttccaaaatggctgacttgcacaaatgtttgcaggaactctcacttccttttgaaaatgggagtatttcaaagaccatgtgagtaagtagatagcagaatgaactgtgtggattattaggaaatacagtcttctggagagggttttgttttgtttagcagagaacaagctggaggatgagggttaaatggtctgtgaacttaaataaatcagcagcgcttattgtgtttgtctattggggtctctgaattgcctctcatttgtcctcattctgggcattcaaatggggctggtgtcagctacaaaacacataaggacctgtaggcaccgttttttgctctgggcttaaacacctctgaaactcaaaatgggaattggatgtctgagccccctttattctaccaccatcactgtacaagtgtggtccctgccatagctagttcagggtcctctaatgcccgtagtctttctctgtcctgaggtcatcatggggcccaggctgcttctacctggttgctctgtcgttctttaactggtcattcttgtctttgtggccaaagctggcttaccagcacagcatttgtgctgtatttcatgggaagaagggaggcagcatgaagcacagccagcttcctttttaaggatatgacatcaacttgcacacagcacttcactgatattccattagcttgatcttagtcacatggcttcacccagctgcaagggtagctgggagatgtagtctctaactgggctaccgtggacttttccccatgaagaagtgtgcaaggaggcagttacttgtctgccacaactgctaccactgaaatctttgctttgtttgccttcttttacactaagcaatgagttccttgcaactagcatttatacttttttaatggtcacagtgtttataatagaacttagttcatggtagatacttaagaagtgtttgctaaatgagggaaacaatccatgaatgagcgaagaaatgcactgatgatggcacacactatttggggcccttctttcttgtatcctaagaaatagtctttgtatttgagtacatttagctgaaccgttagtgggctatgctgagttcaacctgtaagaggatgcttggcttcatctgccatgtggtctttgaacccaggactggggagatgaaggaatatttcattaatccttgcaccatttagtctccttatcaaatggcccaggcctattctttgttacagacaacaatgaagggtgcctttaagaaatctccagtgagtaccgaggcattgcagattaggtcagtagaactgctgctaggttgagcatgatggatgagcaggagaatgagtttctgctgcacggtattgtgaaatcttttcattgtcaccaacgggcctatgaggaactgatgaatgagggagcaagtgtcagaaacgcccttccttgccccagtacagttttaatatctccctgagctacaggatgagtattgataaaagtaaagtttaaaaatagccacggagtgatgggtagccatgatttaaggagaacagcaatggggttagagagggttcattttcttgaaagtgcatgagcgggagagagtgagaggaggagagaagcaggagagctggactgtgaggggaaagagcaggaggcttttataagaagctaatgtgatgaggatgacgagggctttgatggatgagttagctccatctggtcgcagtatatgtaataaatagctgtgctcgggtttgacctctcccttaccagacacatctttctctttggggatatccaggagggagcttccattagagtaaagaacccgtcatgagccagagctgaggatgtttatgggcttgtgcagagggcaaaaaggagatggtatccaagttacaggtttataaactgaaaactgtagcctgtgcgccttgctgacgatggtgctggtgacagaaatgcatttccagggttacactgctacttatgtgaggaggagaaggatgggaggaggagggtggctgaggggtggccagcagccccaagggctgcttcaggtacatcctggtttcttgcttattgcataaacagggcgcctttgtcacaccttccctttgctgtgagcaaatgttaaattaagctggaattgaataggtctgtaactaggtatataattcttaactgggatggtttgggaatgcggtattccggtcaattcaattttccggttaccttgttagaaacattataaaatgtgtttgctcatattcctgccttagaaaattcacaagagtgaattgatcattgcaggcatttgtgttggttttggcatatcattttacacatcagtgattgttgccttcccctgaagatataaaatgtgtcctggcctggagcatcccctaagagttcaggttgaaaaaaaacctgcccactttctctaataagtgtagagttttgatttttaataattttttggataattgatgttttatggatttctattcaagaaatgaaggaaaagggaatagaatttgctactgggttgtatagctgagagtaagtttggagagtgtattagtccgttttcacattgctgataaagacatacccgagactcggtaatttataaagaaaaagaggtttaatggactcacagttccacatggctggggaggcctcacaatcgtggcagaaggtggaaggctgaaggtgaaaggcacatcgtacatggtggcagatgagagaaatgagaaccaagtgaaaggggtttccccatatacaaccatcagatctcgtgagacttactaccgcgagaacagtatgggagaagctgccctcatgatttaattatctcccaccgggtctctcccacaacacatggtaattatggaagctacaattcaagatgagatttgggtggagacacagccaaaccatatcagagagcaaatggatccgccttaagagtaagtggcagatctgagaaatcagcttgtttgtttctttgggatcaaaaggctcttagagaaaacctagttagaaggtcctcccgccccatttccccagtcttcatggaggagctgcttggatgccaggaccaggtccctggtgcagcaagcctgctgcaacattgccaagtgtgggagagggaccgggttttgggcagcaccaccttggccttcctccttcttgtgtgagaagctagggatgaatgtgtgaaagcttggagcctagcataccacatgtataagtcagagccatcagtccctactgtggtgactcatccccttcaagaatcagatcaaagctgtggactcttcatactggaagcaaagcacacatatgcacatgtgcgcgcacgtgcatgcacacacacacacacacacatacttctgtatataataacttcaaggggggtttgctgccaccctttgaattccttacaatattgagaactcagctaagtagtttagaaggcctctacgatatatatgtgtttgtgtgtgtttatatacacatatgtgtatgcattactgtacctatatgcacacacctacatatatatcacatatatgtatatatttgcttatctatgtgaatgactaatatcatccaactggcatccaactggttgatgctcagtattcagtatcaaaggaatcccaagaccctgtgtgcttatgagcatttcatttgttacatgtgcaatttaaaaacatttggtgcttctgtctagtttgaatgttacttataagctgtggcagaaattctccttttgcaaaaaatataagtggattaaggctactcaagtgggaccatccagtagaattctaacacaggtttagtttgtctttgctacattctgtcatcttcttccttctttcctaccctctgctactctggttcctaaatgcccccctcctggccagtgccctctctccacatcgtgtccacatgttgcttcatcttctctttagaactccagtttctgtttcataatcttagctatgtgagtggctattagctggatattgggaggaaatcagagctctagagctaattcatactaaagtgtgaataactgattacttcaaattccccatggataggcatatttagaagaggatatgtcttaacccaaatcaatctcaatctactgaatttgatcattgcggcaaaggaagaattttaagcagcaatgtttaaaaacaacaacaaaaaacccacaaatggctgcaggaaagaaaagagcttaggagacaaaggatgataaatgtgagtattgttcttcatgagagaatcacttggaaaggtttgaaggcagaaaccaacctcaggcactagggacagaaaagggagaaaactttatatgcagaatttcaccatccttctaactggaggtttccatgattgggaagaaattgattttaatcctttaatccttttttgttgattttttaaatttttatttatttattttagagatagagtctcactctgttgcccaggctggagtacagtggcatgatctcggctcactgcaacctctgtctccagggttcaagtgattcttctgcctcagcctcctgagtagctggaacttcaggcatgtgccaccacgcctggctaattttttttgtatttttagtagagactgggtttcaccgtgttagccaggatggtgtggatctcctgacctcgtgatccacctgcctcagcctcccgaagtgctgggataacaggtgtgagccaccacacccggcctggttttaatccaattttaagagataaacctagtctctaacctgaaaaggcccatctttctatcctagggacagatttgtcaaatctttgatagattttaggtgtttctgttgtgtaagaggatacctgatgggaaggaatactggagctcatatgaacaaagaaaagttgtaaatctctggaactctctctcccatatcttttctcttatgaaaataataaatgcttttccaagagaaagcagagagaagaaaaatatttctaatactcttgccagcctgcaaattaaaacactcttaatattttgatgtatttccttccagtattctactttttacatatagggtattttatatgctgcctcttgattttatagcacctgcattttccatataattacatattcctaatgaaaagtactttaatgactacctaatattctcgtagcaaggtgttgttttgttttactattattcaattcacaggtacatgtgttcccccacgggggttttggtttctttagtctaaagctctagaagtagaaataccaggttagagtatgaacatgtttgttgaagggtctctgagacctattgccacatcactttggcaagaggttattgcagtttactctgctattggagtgaagcctgaagcatcgactttgaaagacatcagagctcctacttctcagtcgaggggtatagtaagtcatccttgaaagtggaaaagagaaaaagatggggaaacggggactggggctgcttcataacagcccatcaggtgagtgctgactttaacactaatgctttcctctaaagttgcattaatttgctgggaaaccataacaaagtactgcacgttggatagcttgaacaacagaaatttactatcttacagttcaggaggctagaagcccgaattcaagatgtcagtcgggttacttccttctaggctgtgaaggagagtctgttccaggtctctctcctggcttctggtggtggctggcaatctttggcattccttggcttggagaatcatcaccctgatctctgcctccatcttcacctggcatctccccgtgtgcatgtctgtatccaaatctccccttggtgtaaggacatcagtcatattggattagaggcctgccctactccattatcatttcatcgtattacatctgcaatggccctaatttcaaataaggttacattctgaggtaccaggggttaggacttcaatacatgaatttcagggagacatgattccactcataacaaaagagacccactaggcactagggagtgagctactgcagagtggccccacaagcaagtcacttgtttctctgggcctggctttctgcctctcaaaaatgagggtgttggactagagcagtggcttgcaaagtggggtccccagcccagcagcatcagcatcacctgggaatgtgttagaaatgcacattctcaggccttaacttagcattactggatcacaaactctttggtgggggctcagcagttttgtgttttatcaagccctccaggtggttctggtgctgactgaagtttgagacctactggaccagatgaccctctgggtaagaattctgaaatgtcaacatctgaaacatgtgtgcacaggagttcactgccccatgcacatggcctgccatgagggatgcaagcctagtaaatgatcgcagccaattttttaaacgtaaatgataatctagtttttgtcctaggtgagtggctatgtgacaaactccaaagtttttacaagtccctactgttctttcagtgtgcaacctgtacctccagaaaaatacattcactcaaagtaatgtttattgatcaatgaactgtaccagaccctggacgctattccttttgcataagtgtgacttgtttttgctaagctttaacttgtcccctgtttatttctctttcctaaggcataagtcaaggccagcgagatggcttggcccacggacctagatttagaaacatcctgttattgatgtatggattatacatgaaggcctaatggagactgctgtggggttcagggaagaccaattagggaattaattcattagagcccagcatacatgttgctatatctatttacttatttaggttaatgtcttttgctgatcttcttacagccataagtccctgtcaatagttgataatgtacttgaatttccttcagactattaaaattttacatattggacatttatgacaggaaccaaagtttactttttgctttgacatcctgatatctagggtcttctgtatagtaataaagtaatccaagaatctgagccacacactggccaatcagttttctctgcatctgagatcaccaaatacacttcttttctagccattttacctgtatgaatgtgttggtaaccttgttataggacaaagctgtacatagaatattgcttatctcattcccgtatcatcaactgcaggataacatctgctttgtttctttccttcgttccctggtaagacaccttatttgcctctcattcttcatgattgtgttttgtcccttaatttttgatacaataaccaggggtccttgttgtcatgatgcccatgcagtctatgcaaaagaaagattattttagtgggaagatcatagatgtgggtggcagggagcttgggttccaacctccacttgttgactaacttggtgaatctgggaaggttacatcttcctctcttctttcaatctgagttgtgaggtggaatgagacctgttgtacctgcttttgagtgagggcaaaagagatgcaaaaatgaaattgtggagatggcagtgctttgaacaatacaaagtggtgcactgatgccaggaattctatgcatatccacacacatttgaaatttttgtccagttcagattaaagacaactttattattaccattaaatctgcttacagagcaaatatgcaaatatgtgtgtgcttaatggtggcaggcttgctttaatccttcttgctttggggttctgcattttattttctggtgatgcagacctggtaatgatcactactgatatttaccacattttattaatgtgatttttatgatcctgcaggagataattaggattgggtttgtttttttcacgttcatattatgaaatttcgagctacatagtgacatggtggggaggagggaaatagcacagagaaggaatgcgttacaaataaactcaacccagaaaccatgtttaacatggattaaaatgaatgtagccctgtgttcattatttatagctattatgcagaaaatatgttactggactctcaagaattggatgttaagaaatgtttggttcctccctttggaaagcatccaattaacacaccatccagaggagacagattggggggtcaaggtagacaggaaacattttctttgatttacttattttaaaacctttatttaatttctaccatttaataaaatcagacattagatgaattgaactaataaactgtctttatatcaatatgagagtgaatttgaggccaggctctgttggcatagccttatgttttgtttccttttaaaatctgttcttagactagtaggtttaagcaaagttttatacataagatgatcaaactggtggaattaggaggacagttctatgaccataaagcagatctctgcagaaggcgttacccccgtacatgcacagagaaggttctcagtaaactctcatgtatagaggctagataggatcttggttaagagtgcctgatccggagccagaagacatgcgtttgaagcctagtggttttgtttgtttgtttgtttttgttgttgttgttttgagatggggtctcactctgtcacccaggccggaatgcagtggtacaatctcggctcactgcaacctccaactctcaggttcaaacaattctacctcagcctcccaagtagctgggattacaggtgtgtgccaccacacctggctaatttttgtattttttggtggagatggggtttcgccatgttggcgaggctggtcttgaactcctgatctcaagtgatccactcaactcggcctcccaaagtgctgggattacaggtgtgagccactacacccagcctgaagcctagttttaacatgaactatttggcacccttaagcaagttactttagcctctttaagcctcagtttcctcatctgtaaaatggagaaaacaatagcacctaactctaagggctatagaaagaagtgaggcactgcagcatctgaagtatttggcacctggtacctaacaagctgtcaaatattaattattgttgcttatattactatactgttacaataattattagtaatcttactgagtaacaaacattacctgttgcataaactaggtaggggcagtgtggcagggaataagacaagtaaagagtttggattcataaccatttgaaatcaattctaaattatgagaatgtatctttagaaatatattttatgtttatggagcatgactagtttagaactgacatttaggacttctaaactttgtaaatgaggtatgcttagatgaatggcatcccaattccatgagtgggctctttacttctccgcactccactagtgaatttgaaggccactgtgaaaagaaaaaaaaaccaaaactctacttgttgggctctgtggtgctgttatggcttggcccggctcagtttcctttctcttcttttctggacaatttcaggaccatggcatcttgacttctctaaaaatatttatttagtaagtctttaggtaacttcaaactctagtcttgggcttagtgaaacagaaatccagaatcctagatttctccaaagtgagggtttgtggctgttgtacctgagctatggtgcccaatcatctgtcatccctggctccttgacactgggtttatacacattatagggaggcaatggagtgaagctcagtgaagcccaaacatcagccattcatgtagcaaccttttctgcttttgctgtattgcttcataccacctgtacccttatctccttaatatcttctgcaattctaatctagcatatcattgcttattaccttgtcttggcctaagaaataagatctggaaaatcccagggtgcaatgctagtttcatgtcttcctatcatccactaaagtagctacataattgtgaaaatttaaatgtttatctgtgtatcagcaaaagagcccttgtgtcccactgatgggatatatatattccatgttttgggagatgtgggtggacgagagcctgggtgtgaatcccagcatttctgctctctcccgctcactagctttgtgaccttaggcaggtttcttcatgactctgaatgtagtttcttcatctgtaaaatgagggtgaaaatacctcctactttatggtgtgattttgaggattcaacgaacccatacgcggaaagcacctagcaccgtgcttaggaaatggtcatttctgggtggtgggaacagcatgcagcaagtctgctccttggtcctctatcttgctgtcctacccagtacattgttcattccatgaaggcaggggtccttgttattcatcatttgggtaactacacagtgtctggaacctagaaggccctccaaaagttagctaacaaatgagtgaatccattaaattacagttgtcccttggtcacctggcatgggcaacagtgctttaggagcagtggacaaatacttgtggggctgaggggaatgtaggaaagagcagatccttagaagttagagattcttgagttcaaatcatggctctgctatttattggttttgtgaccttgggcaaattaccctgcctttcaggctatgcttaccttgtttatataatggagataatgccctgcgaggctattatgagatcaaacaagatagggaaggtacctccttagcacctggcacccagtagatatacacccaactaatagtatcccttagcatttgcaccccataggaggcaaggctgttgccttcacacagtgtgtgacaaagccagtgagttgttcagatcaggcatatggtagggactttgtaggaggctgagctccctttagactggggtagtcagtacaagtttccttgaggtgttggggtttgccctcgacttgcaggaggagtttcaggttttgtgcggtagagctgagctctccaatccctcgtccctcctttgtggcacttctagattttccagcctcaggcattttcaggtatgtctaattcacttggtctattgctgaactcccaattaaattactgtattctttaattacatagcatcttaaactgtagctttgaatttaattgaactttttcatgctccttgctccctagccaaacaatttgtacaaaaaaaaattgaattaacaatctgacttttttttgcattgattattataacattaagagagtcccaggagtttccaggctgtaaaaacctaaattgtataacattactcacaataacgcatatgttataatcgcaaagaacttacttaaaattcaatccactttggcatcattatcatgtatcaacataataaatgagtccttcagagcatggtaattataatttgataaatcatcagcagaaaattaactggatgtcaaaacattcattggagagggtgatgaatcggggatgattgtggtgatgaattgtgttaatctgcacagtatgaagccagcgaaatggctaagcagcccaagatggatggggcacagaaccggcaaggtcaggacacagagctgggagaggagggaggcggcgggcaggggtgggggaggagctgaggaggggaagaagaaaggaccagcagcttccctgggaggcccacgagttaaccctttccccacatcagtggagacagggccccgtgaagagcctgttcttgagggaggtcaggaggaacctgtaatgtgtcccgttccatttaagacccccttccactccctactactgcctcctgctaactctgtgggtattccttagattaaaggcgaagtgctgagtgaatgatgagaagcctagtaggcctgacagttttgcattaacctaaaaattttctgatggtggtgagggagggggcttgttggctctgcagtgggagtgctcgcagcatctctccacctggtctgtggtcttggtggacagggtcaagcaggctcaaaaggataggcctgtgaatcatgttagtggggagctcttgtgagccccactagagctgtaaggacagagggacccttccggaggagtggctgctcatagaagttgtggggctgatctgtgccccagcagcatggaaaagggaggcatttctcttcctctcaaaaatccacacaagcagctacagttccttggccgggagaccagcccatctttcaccaaggaagttttgcaagggctgtaccatggcaggcttctctctaaagcttcagtcatgagaggaggttctactaagctcttaagttccagagtgatagagggaaggctgcacattctagaatgttccctgtggccttgcatgctcaagtgcctctgtagcattaggggcttgccggatactttctaaaaaacagcattgccagagaatgtgggcaaaatacttatccaattaaactaggagccaccataatgtgcagggataagtcagcttaagggctaaaatctggggaaataagggccaaattgatgaagtggctatcattaaaaactgttgtttttcctctcattcctgtcccactagagattcatacccttaggtatcttttggagggtgaattagagcatggaatatgaaaaaagtgcagcaagtgagtggaaaaattgtttgaacatgaaaacaaacctagaaccttgagggtactatagctgtttatgtggctattgagtttggtaaatttgtaattaggtgagtatgggttttgtttctgttttatactgattgcttttagccctcagcccctcattaaaaataaccattaaacaattaaaaaaaacccttcaacttgggtaatataataaagcccaggcctttaaagaccaatggctttcctaagccacactgacagccactgttggctgttgcaagaaaggacttgtactctctggcttttctctttgcctcttgggtgaatctggtgcttccctagatggttgtctatgttgccttaatatctttaggggaaaatcccacaaagacacttggaggtttgtcctgtggtcatctggctctcagctgcttcttttctttgagtctaaagtctgttttccttgcttgttgctcgattgagcaactacttatgttgtcggtccagtaataataaccttaccaataatgagaatccctttgacatgtatttggcattactgttctcaaagaattttcacatgtgtttaatcatgttaacagccatttttgggttctctttcctcctaagcaaggagacagtttcagtcaaaaattctcccccactggcatgtacacctgatgtgatgggcatactgaggttcagcacagtggagctgagctggtaaagcttctggcttacatcaatttatgttcacaagctcacgcttattatgataattttgccatgtttccttttttcttcttggtacctttcatcagttttgacacctttagaagcatcagcccaatgctttaattttctctttctgaaagaaggatgatgcctttagtagcatcttaaactatgtgtcaaataggcttccctggactttttttaggaaactcaccaccatcagtgacattatttcttgaggaaattgagctctgagtcctcagacccaatatttaaatataatgtcttccaaaagttagcttgtacattgggatggtgatggactggggtgaaactttgctccaatgctgatatcatagacagtatttgggatatctactgtgtttatcaagggctctgtacaaatggaattgtctgagatagacctcaaagattgtgcatgctaccatgagattcaggttgaaagataaaatcaaccttgatcatgtggctggtttgacctttgccacttgatgaccccaagacacatctactttttttgaggtgtccaataggtagctctctggatacttgtatccacttctctctaatcaaacactgatcttccccctagtttcacctttaggggtagtgtgatttgtggaaaaggagtgggctggagactattagattgagctctggcctgaccaacagctagctttggggccttgggcccatctcttctcctgtgtgggccttagtctcctcacccataaaagaaagagatgaaacattcatgggatttcagacctttccatggtgccaccacacaggtgagctgtgatggggactctgagccctttacctccccttaagccccagcacttctacctttatctacttgtatctgcattctgcaaaggatttcatttgggggaaaagttctgctgctcaaacattcttgaaagccaccttcattttctctcccatctagttggtactttaattgcttgggtcccactgtgcatcatggtgctttctagcttgtgcattttatgaggccagcttatgggattgtattctagttgcccaaccctccttctctctcaggtacccctggggaccaaaagttaggagaaagctgggaaacttgttgaagagcttaggaagggttgaagatgggcaggcccagtgtgggcttggaagaggatgggcacagaggaccacatcctttttactgtgtcttcttattcctatccatcctaatctcagctccgtgtgagctgacttgcacaagaagctcttgagtcctaacttccataacatctaaagaagtagtggtaccttctatttgttcagtgtttaaaaatcttgaaaatactttcacagccattgttatattgggtattctaaataacctgagaaggtagaaagggcagtagttgttgccctgggtctagagctggggatgtgaaggcctggaggaggtgaccaatgagccctcctcagtgacagtaaatgtgaaaaccaggacccaggcttttcaatcctggtccaatactattccctttgctcttccatagtgagtggtttctcagcacccctgagtcagtactgccatgtagagatattggtgaaaaggagaagaaattcacattggtctgttttctccttcctttggacatttccttcttccctttctctccccatcaagaaaaatgtcttttgttcttggggtagctatagacagcctccccgtctgctgttttcccttctctcctctcgcagcaggaaaacagggtgattatggggccttctcttagcggaggtgttaagggtttatgtagtgcttgtcaatgaatggctaatggactcagttgggttgtttcaatgacagtttcccacaatctgatactaaagtggaagccttgagtgaagcttttatcactctttcaccaggctcatcaagaacttccttttcctctctggaaattgtatttcatgtggtatatttctaatccaagtgttacatcaatcagcaattcagtgtaggcttgtggttctcctggagcattttacaagcaaggatggggtttcttattctggccctcttggactcttggaaaaacactccaactgcaatttccttccatctattatgatctgtttttttagttgctattagaattattgggtatttcaagacattatcttaataaaggcattcctttctgggctgtgcttgacctgtgggtgagattgggaatctgtttcttctcatggttatagtgaagttagggttctcagaaaacccaacaaaatgggagcctttgaaacatgatctttttggccaacgacttctgtgtggttaaagggttgctggatgtcgtcagcctgtggatttccatctggagagtggtttgtttttaagaaaaccctccaaatgatcagtctttcatatttcagatgtcaaagaaagaaacaagacatttaaaataactaacactagaggaaatattggctggcaagaaagggggagtgagatctggctcttggatgtatcgcttcagctgttttctgaatgtttgacaaacacatggcttcgatgtgctagaatcatagcagcccagggatgatgactaatatggcattagttggttataagtccacttaagaattagcatctgaattcatgagctggtttcagtgaaaggaaagaaggagactttggagtctggattttggagtttgggattttttttttttaatgaatattttttaaagagcgagaaaacctctccttaaccccagggaagactatctagctgacattttcctctatggtgtcccaaggaaaaaacttgtccccaaatcctatcctattcatataaaagactgagattaaaatttgggttattttccccttctcattttaaaaattcatctgaagcgtttttgaaaaacaatacaaaaaacctctctctgcaactgtgacaggatatagcagctgtctgagaattttctctttttttttactgttatcttttctctctttaagaaaagagtcgtttcagaggcagccgtgacagctctgtcatttcactcacacctctaaatttctctttctgttgtcagtcagcagacagcaatctctggattctgatgggcctgagggatgtccaaatacatgagagatcggagagaggcctgcagcagtgtgcgtcagaagccgtcatcttctgcctttattcttagaggaattgtcaggagtttataaagttctcctgtgctgggatctccaagtctcctctgccaccatctacagcccacacaaataggcatgtgaggggctggggctggggctggggcttcctggaatgtcacttctgcaagttccagttaagaggttgtgttgagttcctctaccctgtgtgctacactggggaaattaagactatattgggagtaagtcctttcaggacaaaaccactttaacaacagcagcagcagcagcagcagcagcagcagcagcagcagcagcagcagcagctactcctgtttacgtgttcttatgttctaggcactgtgccaagtgtttcacatccactctccactcattttccagtagtcttgcagtaggtactatttttcatcccattttagtgatgaggcatctgaggctcagattcattaaataactcaagtaacttgcctaaggccatgcagcaagtaagtgacagagctgggattcaaactcaggactatgtgacactgttgcctcaaggccttaagccatgtgcagttctcatatgccatcattgtctttttttccactgtgtaaggagacacagaaatcataatgacctgctggacaggtgaggcctgtgcccttgtccttttttttttttttttgggacggagttttgctcttgtggctcaagctggagtgcaatggcatgatctccactcactgcaacctccacctcctgggttcaagcgattctcctgcctcagcctcccaagtagctgggattacaggcacctgccaccacgcctggctaattttttgtatttttaatagaaacagggtttcaccatgttagccaggctggtctcgaattcctgacctcaggtgatccacccgccttggcctcccaaagtgctgggattacaggtgtgagccatcatgcctggcggccctcatcctttatgcagtattatggcagctgaattaagatgaataatgacagcaccgtgacttgggggcggtggggtagtgggggtcagaagtaccccaggaggtggaggagaaaggccacctgaactcaaagggaaaagttctatagttgaaagcaacctggatttagagtgaatctctacaaaaggggccccaaaatgcctgaccatgtgagcttgatataggtcttttgtggagccaaacttacctattggtctgagctctcctgtcagggcttggcacatagtttgaacaaccccagtagtcgtcttatagatgttggcaaaactacaaacaacacatttttcacttttaaaggggccagttttgcatcttctatctgtggtattccattgtccccagttttcttcttctttcttctgttaatttcccctgcagatatagcatctctgccatccacaaatgtgtcttggttccacctaactgttccctggggcaacatggaggggaggcaaacacaccttgctgagcctgactttgaccatgactcatggtgttcaggcccaaagcattcaggggatgagctacacagcaaagtgggatgctcaacattgctacctccaaaatatcattgttagtcatttcctttctggagttagactgcttgagtgcaaatcctgattctacctcttagtaaacctgtggccatttgggtggttattgaacttctctgtacctttgtttctttgtctgtaaaatgaggatagcagcacctaactcatagggttgctgttattgataatcatgattattgcttttatagccttacactaagggccaggcctattctaagagtttcacattcatgaactcattcaatcctcccagcagctcaatgaggtaagtattgctttttcctcattttgccaatgaggaaactgagttgtagaaaggttaagttatttgccaaaagtcagacaggtagtgagcaatggaacagagattcaaaaggaaggattctatgctcctaactgccatcctgtcccctaaaatttcatacctacaacatgcttggcataatacctggcacatagtgagagtttactaaatatataccatagataataattgcagtattattaacatgatgaggattaatgcaaggcactgtattagctgctgataataatgatgcacaatccccaaaaagttcacttgtgtatttaaaaaccaatgaggaagatggatgctttaatgagcgatgaccaccaagtatgtacaagctatgacagatgatctacagatgctatggaaggaccagcatttctttaaataaaaactactggtaactttcatcttaggtcaggcattgtactaagtcctttgggacggagttattttactgaatcctgcatggtagatgctgtaccataattatcccattctgtagacactgaggactggagaagtaacttgtctaggtcacgcagctctagggggctgaaggccctgggctctaagccactgtcctactgcccaacttgcctgagtgcctctacactgatggttgtttcccaggacttcctgatttttttctgaaggatggaaacaaagacgacccaataggagtgaggtcattacctccctcccattctcccttcagcaccagatctccaggagatggttcagtaaaacagcagtgaattggatagaggaatcgtctctgtggagtgactttccttgtttctttggggtggaccattctgggctttcctcctttacacatgtgctcatgtgacactctttgtggagtgccagggactgtgtccttcgaggacagattgggtaccctgttttctgtggccttccatgaaaactgcccatggcatgctctcctttctttgggccttgaactctgaacgatgcacagaggcacttctgtcacatcttcctttgattctatgttgtgtgtattaggctgctgtgactatctctaaagttcttttagaatagaaatcatgtctgctcaatattctacagcatctgtctcaggctgatgagcatcccaggcctctccaaaatcagagtcattttttctttctttctttccttcaccaccgtttccaattcatcacagagtcctgtcagctctaattctaaaatgtttcctgaatctcttccaccaccaccctgggccaagccaccattacatatttctgggacaacagtagtagcttccaaactgctctcttccttttcttcttttcttcctacaatctatttgccacatggcagccagagtgggcgttcaaattgtcaatcagctcctgtcactctcttgctgaattccctccagcagttacctgttgcacttggtgtaaaatccaaagtccttccatggcctacaaggcctggtctggtctggtcctatcaacgtctcccacttcatccctgcagaactctctctactctgtacatgccaggccccttggccttgtgtggtcactcaaaaagaacaaacctattcattcgttcattcatcttagaatctttaacaagctattccttttgtatacaacattcttggttaagttggtcccttcttatcttttaggtctcaactcaaatattgccttctcgaacactcatataacccacttataactggcagtctctctctattctgttgcttttttgttttcttcagatcacgtattattatcttcacaagtgctgtttattcatttgcctaaatgtgtattgtctgtctacccccagtagagtataaactccatgagccagggccttcacctaccttgttctttcaatcctatgccccctgcacctggcagaggggctgaaccataatgccagctaataactaataagcagttaatatttgtcaaagtattactatttgccaggcattgtcccaagcccttcacatatattaagccatttagtgtttacaatgaccacaggatgtggatattattattattcccattttactgatgaggaaactgaggtatggagggtttatgaatgcagtagctcaagggcatacagctagtaagtggcagagtctggattcaaggctccagagcatgtgttcctaatcgccacattacaatgcctctctagtagatactgaataaacccttgttgggtgaattaatgaatagaagatgctcagtagagctttgttgggtaaacacaatcatggattattgtggaaatgtcttaggcctgaacattgtcaacctccaagagcagagggcatggcactgtctacgtgggtatgaaatgccccataaccgtaaatggggtctgctcacaccacatttgctatttatactttatactagatagagccctctagctcgatggttcttttcttcccttttttttttttttccttttttaaagagaagagaattgtgggaaatattttgttttccctgggagccagactatgtatttacttcaagttttattaaatgagttataaattttcccagcaatttactcatagctcaagaggtttaatttgcatgtgttgccttttacaatatgcttttcgtaatgttgcagatgcttcttccccagcttcagtaaacaacaggcactccgccaggtttttgactgaacatgtgccaggcctgggaaatatgagttaactccatggtgactgttgggggccacacgtccccctctgtccagggcatctggggagctgagtcgaattcctgaggggcaggagcaaagattttctgaatcttctttttggacatctttttaatatttttttccacacgcaaaataaataaataaacagacatttctgcctaagtatcaggtttgcactggtcctaattagaaagtagtgttaataggatgacagaaagcatttgctagggcccccagggtgatctctagagaggctaaagtcactttagcctttggggagctgcccacggcctatgatggtgaagccctttgagcttcgaagaagccagtccctctgagggtccaggtctgatgcctgtttcatttcaggtagagagcctcagggttgagaactcatcttctggtgtcacactgtcgggttgagttctggctctgccacttattagtcgtgtgaccttggacaaggtacttaacctctctgtgcctcagtttccgcatctgtggagataatggtcataatggtccctgtcttgtaagtttgttgggggaattaaatggaatactgcatataaagcgtttggaggagagtggtttataaatggacacataaatggcatgctgattgtcccagggctattcagttcattggctacaacttaggggacagatcctctcagtgagttattcctggttggagatggagggcactggagcaagggatggatggtgtgttcattagaatgaggcttagctgcatgtagcagaagagctcaagttaacagtgacttagcattgtagagatttatttctctcacataaaaggagtatggaagtattgcagggctggtgtgataatttcatggtgtcatgaggaaccctggttccctctctttgtagctctgacattcttagcatattttctcatgattcaagatggcagcttgtgctcttgtcattctgtgcgcattcctccctcaagaagcagggaggaggaaggaacaaacaggagtctcattacctcttaaggaaacttccagcaagtcccacgtaagacattctttgacatctcattggccagagtttagtcacagagccacagctagctgaaaggaaaatggaatcgtttagcttggcagccacatgccaaataaaaatccaggttctgttacaaagcaggaggtggagaatgggtgtggacgcagtgaactatcagtgagtttccagtattgtcctgtggttttgtgacttgaggttgaaggaattcccaggtacataaagcagtattaaattttgtttcctagatgattttaggtggcacaaatacattttttatttgaataatcttataattttttgtatgcaaccatattataattacatatcaaacccaggatttcacagatctcctacagtgtgatacaatgttataatgtttttctttaagtctaaatttaactgcatcaatgtttaaaaaattaagtaaatgccggcatatagagatgagccaggcaatctgtgcagtggctaaatgtgggtcctggggcctgagtttgaatctgtaacctgccacttattggccaaatgaccttggactttccatgcatcactttgcttatctgtaaaatggcattaataatagtacccatctcacagagttgtgataaggaccaaatgggttagtacttataaagctctaagaatagtgccaggcatgtgatgagtagcccgtgaacattagtcattgttcttattgttattatttctgttgttattgttattattatggcttatattactgctattattaataataatgattacaatagatgacatttgaatagagcagaaattacaagggtggtacatgcgtgactgaaattagggaaacactggcttagaggagtgagattggcagttaatcaggagagtcttagacacagctataaataatgactttattaacaattaaaactagtgctttatgtttaaagtggctccatatatgataataacattgattagagtttattgaacatggtgccaggtaccatggggtatgctttaaatatattacttttaatttttccagtgctgtaagctaagtgttctttttattctatagatggagaaacttagtctaggatagggttaagtaattttcccaacatcccgtggggaccagcatcaaggtccctgctgataaacgcatcttgtttatgtcctttttggtgccctttcttcccttttccccttctctgtttggatgtcaaggaccccttcattccactcaggaccctctgatttcccctcctccccatgtttcttcccacaccccaattaccagctagtccatatgtgccagctgtttcccaggtcccttcccactctcagaactgccctgtccatcatctgtgttcctgcaggacacaacaggcaaaagctagtctaatgaactaatctatgaaaatggacattaatagactaatatgtagccctctctgggtcatttattttagaatgggcttgttgacaaggttttgtttttttcttctgaataatttacttttctctctctttcttcttttaatagactttattttttagagtacttatagttcacagcaaaaattgaacagaaggtacagcaacttcccagatacccactgtcctcacactggcatgtcctctctcactctcaacatggacttgaggtcttcactcaaagggataattcgtgatggagattaaaggcagcaaacagttcagtagccttgtgggtctgtcctagaatgtctcctaggttattctttaaggttttttaattgctgtatcataggatcctgacaaaaatgggacactgagatgatgaccaaagggatcaagcacactggtgagtgatcagtcaagggccctgctcccccttctccagcacccagccctgtgtctggcagatggagagcacgcagtcaatactgttgaatacatgaatcgcctaccaggggcccttcggatatgcagggaatggaaggtcctttaaggaatgggacagtgacttacagtgggtaaggtttggttgggcctcgtgaacttgatagatttttttggcaggggggctataatgttctgtcatgcaggtcagcttgctgtcatcctggacccgtgcgtgtctggctaagtgtgaactgaacatgagcagcatgatgcagggattaggggacattcatcttccactctttctctttggagctggaggctcaatgtgttactctcatgatgtcacaaagcaactgatgtcttactacatcctgaaagaattatttcctcttttactcttcttacaaattgtacctcatgatccattgaatttcactttcctatttttccaacatttctcattttctgccctttttatcctctctctcagaccattgggggaaggaagaaatgttgcttagcaaccagaatgaaactagtcaatactgcttctaatattaaccctttggtaacgtgtgtgcgtcccaatccatgtgttatagaactctcccctagcatgttttaaactagaacttcatctaaagttggcagctcaactttatgtcaaatcacaaacatcaaggatatatttgtgggttgttataaatgttagcaagttccagtgttataagttatacacattgtctgcttattaaagtggttcacttttacattcttaacttttgaaatttgctgtgactatttcacatgttactttcactttttgaacaaaatagtttctttgctggcttggtgtgtgtctgtgtgtctgctggtttgctttttagacatttaagtccatttgtctgacaattggaagatatgttttctgggttgtatcattcattcatctaatgtttattgggctctactctctgccaggtgccatgcagggcaccgtggagtattgctgacttgggcaaacactgcagaggttgagcagacttggtttctgtatgcatcttttcatcagcaaagactctttttcccttttcatcttcatctattgaaataacatataacagggtgggttttcagatgcaatagttactcttctactggaatggtttctttggctttgattggacaatattatccatacattttaagctctttgagagtgagtgggccgggcacggtggctcatgcctgtaatcccagcactttgggaggctgaggcgggcagatcacgaggtcaagagatcgagaccatcctggccaacttggtgaaaccccagctctactaaaaatacgaacattagctgggaatggtggtgggcatctgtaatcccaggtactgaggaggctgaggcaggagaatcactcgaacgtgggaagtggaggttgcagtgagccgagaccacaccactgcactccggcctggcgacagagcaagactccatctcaaaaaaaaaaaaaaaaaagtgagtgagtgataggatggaacaaaaagataaatattggccagctcctctttcatacaccaggtacagctggtgcacacacacagttaaagtttgggagtgttgatttgcccgacataaaatcatgttggtgaagttggcctccagtgtttctcttcttacatatgtgcccccctttttgctacaggtgacctgtcaaatctcccctgatatccagcactctcatgccagtgaatgccaccctcaactgggggaaacagtgaactgatctcttcttttccttagggcattttttactttattgaagactctctacaaacacagtgcctttgggggtgaaccagaatttactgtggtactctacacagacagtaggctgagtgaaagctgaactgattggggttttcagattgcctctgtcttctctcacttggaaaggggcgattcccccttacattccctctcacttctggggtgcctagtgggtgatatggttgaccatccttggaccccgcattgccttgcagggtaatgccagttgggttactcacattctctgggtccccagagttcccatacacgagaccattgtggagttgtgggggttgtgtggattccccctgttagcttgagtggccagtattccacaatgcttgggcttggtctctgtgaattggttgggtggcaaaaagtatctacaatgactagattctgtaaagcaagctaaaggtgaagctggccttaatgattttagcttatttgttatctaaaagatagtggtgacctaggactcatcaaggtgtggctttgaactggagtttggtagatgtcttcaaaaaggcatccaaaacacctgagattattattacatggtacttgggttcttgccttactttattcagaacagaaaaggagagagaacttagagacacaggaccgggcatgagcttaattctagcagcttctattgttgagcacccactatgtggcaggcattgttctagacaggtctattgcatacgttatcttccagcctttccagcagcctcgcaaggagcacattcatatccctgttttgtgggtgaaaaaactgggattcaagagagggtaaatatcttgctcaaggtcacatagcccacatggaccaggcagggatgtaaatgtagatagggtctgactctgcatcctgtgcattctctgcaggaccacattgcctcctttgcaagtcaacctccacttgaaggcaggggggagctcgggttgtagtaaacaatcctagatgtgagtaatgtgggcatccagccatcgaagcctgccaggacagtttttaccatgtgaaagcacttagttgttcagtaggtcccattgatcagctaaaaccatagcaggaacaaggaaagggctacaggagccaaataaaaatttcacattcactaacttggaaagtctttcttcatttctcatttactgcattgctgtatatctttccatctcttctctcgaaacatgatcccagtttactttgaagtggctgagtgtggcgggggttctgtgagggagaggtgattctgacgatgatgatggtcttacctgtcattgaatccttcacatatatgtgtgtatatatgtatacacatgcatacgtaatatccccaagtcattttcatttttccttcattagctctcacttacaagttatacattttcaaatataatatgcgtctatgtatgtgaataggtatgtgtatatgtgtgcatatacatacgcgtacatgtacgtctccaatgcttttcttttctttttgatacagagtcttgctctgtcgcccaggctggagtgcagtggcacaatcttggctaactgcaacctctgcctccccagttctagcgattctcatgtctcagcctcctcagtaggtgggattacaggcatccaccaccatgcctggttaatttttgtatttttagtagagatggggtttcacgatgttggtcaggttggtctcaaactcctgacctcaagtggtccacctgccttggcctcccaaagtgctgggattacaggtgtgagttaccacgcccggcccccagtgtgtttttatttgtcctgagtttcctttcctcctcacaatgctgctccccatgcagggagccggccaggcagctctagggcagggggagtgaacagggaaggaactagccgtgcaccacaaggtcgtgtgagaatgtcagtgtctgggcatatcacatggcaagtctttccttcaacgacatcatgatttacctgggttcttgctgagctaatctccctgcagcaagaggacactaagtactggccgtatggctggagaaagctgccctgggtcctgcaaggccaggctgcctggaattcttggggatctgtgccctgcggggaggatatccaaaccagcaggtggaggaggagaaagagacaagagctcaggcctacgcagagcttccctgctggggcctggtctgctgagtgggaaggaacagtcaaggccatggagccgtcaacttctctgccctgtgtcctcctggaagggaaagggaaggcctgccagggcctgcagagacaagcagccatgtggctggtcacggtccaagggaacgtgtcccactcacagggcctaaagcgggaagaacacctccttcatgctgcatgagcaggagcagatagtgtttacctcttttgtccgtggccctgtgtgggggaccaagggaccgcatcatcctacataagatcagcgcatgtcacagccaggcagagggctcacgtggcatgccaaccaaattgccctttcattggcaatgctgaaagtgaaggccatgattctcaattcctggggatgcgttttgcattttgaaactcagatttcaggaggagctgctgcatttttctgttcaaacccccagtctgagagaagtgggctcaagaacgtaagctgttggactcttcctcaccctctgctcaaaaggcattcttaatgagcctcaattcagaaaatgaagtgtccaagtccaaggcctgaaaacctgatgcattatagtaggatgaatattttgtctaattatttgtattaatacaacagcagcctaggtacataggctttatatgaacttatctgtggctgaactccttgtctcccagatgaggagagcctagatagtggtcttttgtgagaaatggcttgttggagggagcgggtgtgagcagttagcagaacttctcatatttatttttttctgactttgagggagaattctgagaaacgatggaaatgggaaaggaagtgagtaggaaaagtaaagggaaatgtataaaaatgaaggagagaaagtaaataagaggaagtattagagataccaaccatggcatccagcgttttccatgttctgttaatcagaatctcagcttaaattagcataagcaaaaaggaaatttattagttcacatgtctgagaaactgaggagtggataagactccaggcctgactagagccacaggctcaaataacacagttgctgccatctctctcctgccacctcacagctctacttccctgctgctgacacccaggtaaacttcccctaagggaggcaacgtggctgtgaactccacaaggctttcatattctcttctcatcaacctcagtcaaaaaagagagatttcctctcaccagcagttccacaagatcccagactgggtcttccagtccctgattgggccacatacccaccaacctcagcagtctgtgagagatgacaccctggttggccagtcagtttctgtgcctgcctggagcctaggtggagttggctccacagaactcagagatggagggaggtgggaggagtttccctggggcacatcagggtacttgtacaggaggatgtgaatgcacactgggcaggaaaagacccgccaaaggaagatgcgatgaagcgaaaaggggtcctggagaagagctgttgatgtgatggttcaatgaagatggagaaacaaggaaaatcaaacctgtgcattgctttgggtggccagactggatgataaagccaacatggtagaaaggctcttgtatcaacaggagttggtcaagatgttttctagacagcattttaaattcagagcatcccttttattgtaggctttagaatgaaggaatgtggttgtttgggcctatggatcttaaccattgctagaacctattattttggagagctctgagagttagtgaggagagagtcatgagctggaataaacatgttttgagtacctactatttaacagacaccagtggtttaaagatcaataagatatggtttctgccttctggcggaggtatgggtaatataacaactacaatctcgtgaaactctcatattctctgatgaaaaggaaatattttcttcctccaggactaagttactcaggctgtgcttcctggaataccaggattgacttaggtgtttcgtgggaaaacaaaaacagaaacaacaatttgtgtcttgacagattaaaagatgttgtaccttctttccactgggggagggaggattggcatttgcaatgctcgttgtcatatgaatggctccaagaagtttggcaataatgaaagcttttagatgttgtttaacctggcattacaactagcttatgtgatgatggtgtacttctttcatgacactagtatagtattgaacatggttcataaaacagagcccacagaattagccacatcttcatggatttgcacatgcagagccatctggaaagacctgttacccagtctagtcttggatgttgtaagggacctattgagtgtttccccaggcctaggccacgcttctcaccacacccagcttcctgagaggtttataacgcagatcagataacaccagcttctcctgtcttttgcctctttgggttttctcctcaagaactagtcacagtaattctgttctttggagtctgggaagactgactgagattcactttactggtatcatcatctactggtggtacccaagatgattttggaggtgcatagctacatcattaattgtgtgaagaaatgctttttccctctcagttctcctttctgtccttttggccacaatgaggagaaagtcttagtttggagctgctgtgtctttaatgtttctattacgtgtggatttttttttttaagagagcagccctcaggctcaaagccttcagtaggtcactatgtctgaactacatttttaaattattttgttttcactgtacatatttctctgaatactttttacttatgactgtaggcaccttctgcttatgacagatgatcctggtctttatgatagttgtataaaattccctttaaaaataaatataaggaggagtgggtcaacttagatcaaggtttcttaatcttggcactaatgatattttgaaccagataattctttgttgtggagagttatcctgagcactgcaggttacttatcagtgtccctggcttctacccagcagaagctgcccccaccaaagttgtgacaacacagaacatttccagacataagtatccctatagcatgaatgccccaagtagtgtaaaccaccagtttaaagcagagtgatatagaagtgtagcaatagttgtgaaggtcgtgtggatgaccagatttgaatcctgtattatggttagtgggctggactgccactggctgccataagagctgggcaccttcaccccaccccatcaccctctccacttcgaagtctttccagatggctctgtgtgggcaaatcagtgaaaatctgtggtctctgtgggttgttggtaagagaatgagctttggaccctgttgcatttggggctgtccattcttttgcagaagcagcagaagtccagggagggagcactgggcagcccagccccatgacaaatgccaagtcaccagaaatcaaaagaggaatgctgagtcataatttccttcattcaggaattagcatgtgcttttgagattttgaactacagtgcaatgcagagctggtgaatgagcaaggtttaaatattcatttggcattagcatctgtgaggatggccagatactttcattaattggattcaggttatatgtgtttcgtttaaaagcagctgcgatcactaatggaatgacctctgtgtcactttccattctgaagcaggaggcacgatagctcctcttaggatgttgtgtttgccacttgcgctgacaccaaatgctggtaaaatatggttgctccccgctttaaaaacaaaattttgttttcatttttaataaagagacagatcccaggcttgaaaggcatgggacactgggcagctatactgatggctgcaaaggtgtgggatttgggagaagtcagttttctctttcctatccaccacccttcttcctccctccagcctccaccaccttgaaggccgtgagtccgaacaggggacccagagacaggtctgggtgtccaggtggttccccattctacattcagcatggggctcacctgccacccactcttgcctccatgtcccacccccaacatgcacacatgcctctctaggcttaattttgagcatttagaaaaacataagaccacccccacccccagctctcttttcatttctccctttcccaccaagattcacgcagaccggaacagagtctttcaatgacaatatactattatgttagtataataataatacatttgtttgctcttattcctagcagagcagccacggagtgctctgttaaaatgttagatgagaccctgttactcctctgctaagaaatctcctgaaggcccaagtgctcccaaggcccaggagaccttgccctccccttggcccctgacctctgccctcaagcctcctccctggccctggctccctccatgccagtgggtgcggcctgtccttgcagctcctcggacctattggatgtctttttccttgatgttccttctatttctatttcagtatctctttcttcctttgcatctttgcttaaaagatgtgtcctttgcacagtcttccctgttgagaatgaccccttctcccaccccagctacctctgcttcttgctttctctctacagcctcagagtcctccacgacactctgcagccctcatttcccatgcaggttgcatgccttccattgcgggaatccaactccacaagggctggggtcccatccgttgtagtcattggggtatccctggcatctgacacacagggatgctcaataaatgttggtgagtaaatgactgactgttactatgactgtattagtccatgctaattgcattgctataaagaaatgcctgagattgggtaatttataaagaggattaatggttctgcaggctgcacaggaagtgtactggcttctgcttctggggagacctcaggaagcttttactcatggccgaaggcaaagagggcgctggcacttcatgtggctggaggaggagggagagaagggggaggtgccacacatgtttaaacaaccagatctcacaagaattaattatcaaccacagctccaaaggggatggtgttaaaccatgagaaaccacccccatgatccagtcacctcccaccaggcccatctccaatgttggggatcacaatttgacacgagattttgtggggacacagatccaaactgtatcaatgactgatagtaacagcagcagagggtgtcatgggttacagagtgcctctgtgtgcattttcttgctttcctcaccacaaccccatgaggtaggctaggaaggttttattatcccactttgcagatgagaaaggtgaagcccaaagatagccaggggtctgttcaagttcaaacagctagcaacagtgaacttgaacttatttcttctgtcccctgggctgtttatctttgatatctgacatggctgattcaggcttctagaattctagggcagctgcaggtgaccccagtaggctgaagttaggagacctaggtaaacgagtgtcatggtgaaatcccccccgctcctgagaccccacaggctcctcccagacaggccggcctccttaggccttgggtataattagcctagaggtctccggccttgatacaataactggtaagaagctatccattctgccgttcattaagacaggtgacacaagatgaaatattttaggtaaatcatctggcctaatttagaaaggctctgtagggctagagcctttgatttatcggggagaggtatctgttatcagagcgtctcacacacggacttatttattatccagaatctgtttttaatttcagagattgtttacctaaactgctgcgtgtcagattccaggatggatttctgcttagcatttaattttagatacttgccatggtggacagaaaaaaatgggcctccagaatttgtagtttcattatgaatcttacccttggcagcccctaccagtagtttgtctttgaaatctccttggtacttgttaaccctgctctgctgtgaaagagatatggtttatttattggactttgcccatttatgaaaaagtacagaaattattaatggtttagtagctattaatgcattacttgggtggaattcaaattctaatatttatggtaaacccctttataatgaaacgggcagagaatcagctctcttgctccttaaatttggaaggctctggatgccattggaatggctccctgtgaaatatgagcccttctggcattatatttacacccataaataaaaaataagtactttgggttggaggagaaataattaagaatatttgtgtagataataaagaggaaatggtccagtttggttaagtgtgtgtttaggaaatgccaggggctgctgggactcgaatgagggatgggaaagatcagggctggaggactgtgggtgtggaggacttctggggacttgcaggaagggaagccttgtggaggccatcgtgggaccatagtaagatgtgtggatctgggaggcttgtttggattccaagtcttccctaagttagtacagctctttgatagcagttgaacttccctggacctcagcctcctcctccataaagtgaaggtgatatctcacaaaattgtcaagatggtaaacagtgtagacttagaattgtaataaataatctacagatctctgtatatgaggcctaaagagagaactcgggtatggcaagcatctcagagcaggattggaaaatacatatacatatgtatgtacatatacacacatatagagatacatgtatttttggtgtgtgtgcataattgctggctgtcgagtggaagatagggaatatagaatgggtatgaaatgaccttaatatggacattttaaaaaatacggtctcagaatacaataaaatgcattgagtacctcttacccaccagggctcttctgcccgtggaatctgttattgggttaatgttccctgatctttttctagtccaactgagcttctttctgacctcttcctgttagaagctaaagggtttggttgaatctctacatctgtaagcatctggtaatcagctgtaaaatcaacatgtcataacaggaaggaatctcaaggagcatcttgtttagggatggcaaatacattttattgcatatgaaagctatatagtggtggcttctagaagtgctgaattgagaaaaattctgacccatagccgtgtttagcaggaaagatgcgtgactgatgagtggtacctactagagttgatgagtgggaagtagtgatgttgtgtctcacatcctctcatagtttttgtttgtttgtttgttttaagaaggaaactaaaacctagcacagtcaactggccaagctcacagagttaaatctctggcttccaattcaagtgatactgaggccacaccacactggtgtggttactacagacctcctaggaggacagcagtcagctgcccctgacttaacagagtaccacttcaagtggacatagtgtttgacatctccttgacgtgtctgatggccttcacagagagccaagaagccaaggcccaagagactatttggatcgatgatgattgtgttaatgataacccatttatttagtatttctatgtccctggtcctataccatgcctttgatgcttgttttctcatttaattacaacaatcttatcagtgggtgacaatctcttcattatgcacatgaggaaaaaggggtccagataggttaaactctgcagagtcacaagctagcaagtctcaaagtctcacagactccagagcatgtgtttttaatcactggacatctcctttgtgcttgtgaatggtgccatccctagaggtagcatagatgcatcctccgagtaccatgaagaaagatgtacatgtaaagtagcaaaggaagctggggtcagtgggtggtcgatgctcctgacagacaacatttaggcgtcggggaagaatgtccttgccatctcatacagagtttccctatttctgtgtgtgctgccgtgactccagcaagagttggatggaattggggagatcaagtctccagttctttatttctgctccctgtagctaattgcataatgactcataaaagttaaatttctggtgagcatgtctgccatgctgttttgctaacgggcatggacgtttcctgacttcagaagaaaatgagccctgatgctggagaaagggacaacctttccccctaacaaattttgcctctcttgtccctaagttatgaggagcctgagtagacagtctcattctgggagctctgggctcctccccatggtgctccaggggctggtggctggcttgcattgagcctgtttactgtgtggtgaaggcagaagacctggtcattgtattcctaattttacctgagttaactatagccagataacacaggtcttggactcaggtccaaattcattcatccaccaggcttatcctttgtctgcctattggcttttaaatattcaggttacagggtataatcttaacatttaggttaactgtcaaataaaaataaaaataaaaataaaaatgaaaattaataaggtggaaaaaaagaagagagtgtctttatttacaacttttattggagctggtggaagggctccctctcagcccttgtgattcctgtctagaaaatgggctcttctctgcatggtgcagtcagcaaactactggtctcctcctgggctgggtgtgggttgctgccctgcctgggtcacatagaaggaagctcaggaaattctttgatccaaagctacttttctgtcctaggaaaggggtcccagaaggatttcacttctccccaagatagcaatgagaattgctctcattgctgctgatgatgatggaggaggaggaggaggatactatgttagcatttgagtagaatcatcataacctggcaggcattgttctaagtaattaacataattcttcaatagacttgaagttgctgttattgttatccccattttgcagttaaacaatagcttggcccgcttggtggctcacatctgtaatcccagcactttgggaggctgaggctggcagatcacttgaggtcagcagttcaagaccagcctggccaatgtggcaaaactccatctctactaaaaatacaaaacttagccaggcgtgatggtgggtgcctgtaatcccagctacttgagaggctgaggcaggagagtctcttgaacccaggaggcagaggttccagcaagctgagatcatgccactgcactccagcctgggtgacagagcgagacttcatctcaaaaaaaaaaaaagaaaccatgactcatttattccctcagggtcatattattggtacgtggtggagctggcctgagaatagagtctgtgcttggtgactggaagagtgtcttaggagaggaacacttccctttccctgtcagtctccagatgcttactctcctcttcttggagattgttttctttttgatcaaaattaaatccagaagagagagggaaaatcctgatggagcatctttgcaggccccttttatcagggcttttctctggcttcatctacctgcctgctccacaggccccaatccctcacctaaacccctaaggcctatctattctttgtctgtcatgaacagttctccaaatctttattcaccctaagttatagatgaatgacagaagatgaatgtgtttcttgtcccagcaatatttgtattttcattgtagtcgaagaagtgaagatggaatttcaggtgcaactgaccaggtgctgcttcccactctatggtctttatatatccaagctaacctgagatgcaaagctaggaattcacttaaactgtctgccattccatctgtttggacttgtctacaagccaatcaggaagacatatgaaaggtgaacagaggcagcattttagctccttctgcaccctaggattgtacagtgccacagtctccagtagcatgctctgaacatgatcactgtatcactcttccagatggaaggtgatcctgcaatcagtgggctttgcttagcacagtgtaggctacagtcagaaacctgactctgcgagaacattccttaggtgccgggagcaggagagggaggctggacactccatgttgcctgaggccaccaccctttggactaagagacagaaagaaaatcgcgctcacctctggaaagaccaagtcgttgatgtcctgcttcccctcttcagggctgttctacctataaggccatctcctgaagtcaccgtgttttttatataacattttgtccttttagaaattatcctgacgcatgtcaagagctttcacaccgaaaaaatatgtcacattagcttccaagtttctgattgtctaaataacgcagcaactcaacatacagctgtctggcattttgacagtacaataacccataattcttcctgccactcaacacttcaaggttagcattttgtagtttgctctcaaggagtagtcatttaaattttcaagagcaaagaaatgaatgtggctgcttcatacctctcttttgatctttctttatctgggtggtttttccatttatattttccattatatattttggaatgcttatatttgggtgtaaacttttcttggagagttagaatgttgtatcccattctccagatagatgggaataaaaatgagacatatctgctgagcttcagagggcagctgccctgtgagcagttcccaagcatttgcagtggagtaaagcaagaaggaactagtaggcgtatggagtagtttatgactctttcctgcctcctttcagaaggcaggtgaagtacttgcagctgcattctgaggaaggtggagtttccagtttctaccttctcttgagagaaccccacttgcttggtccaacctccatccttgagtctcaaggatgagtcttggaaacccaattaacatctttgacttagctgctggtttctgaattgtcctaactggcttggttgcaactggtcatctttgtaggcacattactacccctaggtgggaaactgggttataaatctggctttcattaattacctctgtaaacttgaccaagtcaacagttttcctctttgaacttctttccttatttctaaaatgaaattactagctcttgccatacctgccactctaggcttatatagctgggataagaagaaacaataaggataaatgtgccttgaattattgagagccatgctatctcaatattagacattattgtgaagtttttctttcaacccactgccagtttttatcccggatctaccttcctgcctgcagtaatttagtggcttattgtgatgtgtgggtcactttctgagacaaagagagtcaatataatgccttctgccatgaacaggctttatttagtggcctttcttggactgtgttcaagagtaaactcttggatcttaggcaccctgaggatatctcagggtttaaaattcctgagataaaataattaagttttagatccataactgactgacagactcaatgaatgtgctttgcctgggaaaagcctaacctctccaaactcaccaacccatgtttaagcccatgaagttaagcacaatttaaaagcctgaatgtgtgtgtaaaaagaatcactgtgtttataggcaatctgtttacactttgaaagccattagagtgatagtgataaaaatttaccagtttgggtcctaaaatctctaaaacataatttgtttgttgaggcctattggaattgatgaagaagagaattaactcttcttcggcatccctgggactcactctgacaagtctgagaggggctggaaattatagaagatttgaatctaggttcatggggagttttgaacgtgtggaatttctttggttcgttgcttttggtgaggaggaatccaggtcaattttcccctatttattaaaggttttatgacccctcttcttcagaattggcaatttcatttgctgtgcatttgctacttctaactggagagtttgaagtctggtgcaatctacttgtataagatgctggagtatcacagtcccatgctacaaatagcctgggctaggaggagaacaacttgatggggtttaccacaaatgtttcgatactagcaataacacagtcacttgaattgcatatcattctatactcttcaaagcatgttgcatctgttaacatagctgatctcagaatagtgccacgaagcaggaaggactatgatttctaaaattacgtgttttttttgtttgtttggtgtttttttttttttttgagacggagtctcggtctgtcgtccaggctggagtgcagtggcgtcatcttggctcactgcaagctccgcctcctgggttcacgccattctcctgcctcagcctcccgagtagctgagactacaggcgcccgccaccatgcccggctaattttttgtacttttagtagagacggggtttcaccgtgttagccaggatggtctcaatctcctgacctcatgatccacccgcctcgccctcccaaagtgctgggattacaggcatgagccaccgtgcctggccaaaattttgtttttaaggattttttcctgactatgaaaataatgcatattcattatagaaattttggaaaatactgagaatcataaagaaggaaattaaggttgcctgtaattccccacttcccagaaataaccacttaaaaccttctggaatatatccccccgacacacatactcctttctgtatgtatttgcacagatacctgtagattagatttttaaatttgagatccttctataaagatactatattgttctaggcctttcacttataaacatttacccatgttataaatagttcttgaaaccccactatttaatagctgaatagttttctgtttgaagagaggattataatattgttgagtaactaggttattttcagttgttccttattctactcggtatcatgaagtatgttccaggacatacatctattttttttttttttcattttaaacacagctctgattatatcctaaagacaaactcttagagatggaatggctaagatgtttctgtctagttttcgaggactattatgtaaagtgatagaaagtcagggattttatccaaatttgatggtgggaaaactgaagatcagagagttacacttacttgcctcagggtgcagagtggagcagccaggtggccccatggaggcactcaccttgctggcactcttaccacctgggaggtgaggacagcaccttggcaaagctaagctaggttacagtgtggccattgtgggctctcttcacagcccctatttgactgtggtttgtgatactgatggagattaacgaaattgtcattctgcttcacgtcactgcttctcagagctttctgggcttttcctctccccctctctccccaactcagtgctctctcagagtggctgcagcccatctgcctggcatgtttgcttgcctttctttttaacctaaaacattttggaggatgcctatcaagttccacaccctgtgttggctgcaaggggtacaaagatgcgttaattcagtcctgaccctcaaatgtcatctaggatgagaatgcgaacaggtaactgtggtgaagtatgaagaagacataatcctggggctgtggaagaatcagaagtgtcccgtttgtaaagcatatcatgctgttcctggtgcatgacaaacctctagtctgctgcctcagtggacccctttgtattcctattctatagtatttgttttgaccagacttatccccaaaagtcttctcacttttgctcctttttgctccttgtctgctttgacttacttcccattgtttttgtacgcagtgggcacctaataagtaatcgatggtgtggcctcatcacctggcctctgggtacctctatcctggccctattcttgctacttgtaagttcccaggaatttgcacctgtccctgagtctcattttccttatttgtaatattaagggaagaaaacccaaataactgctaatgaaaataatagcaagcatgtattgagccttattatgcaccatgtactgttgtaagaactttacacatattagcttattaaagcacacgtcttcgtggggttagggttactgttgtcccatttctcaggtgacgatccagggcccaaggccacatagccgggtggtgggaccatgaggcaggcagacattagagattactctcttgacattgtcctctactttcttaggacccttgccttacattgtacttggaatggcaaaacacttgtggtgtaatttgggagttcaatatggttagtttgggagagcagaagctctcttgagttaataatgtattgcagagcaggcatggggacgtctaggaccttggctgttccctccccaaagctatagaacatcacagaaccagggaactgtggggctgggagagacctctgaggaagagctcctttttcaaccatccattcacttgctcactcaccaacatcttgagcacatgctatttgaaagtcattatactacatgttgctcttgctatggagactaaaaacaggtatgacttctgctctcaggaaactcacaacccagaaagccgggaaatagcatgtcacacagctggtgggactgttgggagagaaagcagtaaggatgaaaatgttttcagttgaaatgcctaattctctctagacttccaggaaggggcctgacaattttggcacaaggactaccttctttccagtgcgtggctcatgtccctgggtctggcaagtccagaattagtagtagagaactcttgtccaaagcactaatttggaggctgagatttattgttgtcacagcacctggcttacaaaaataagctttgtcataatggaggaagaaaagggaggaaaataaagccaggttttagatcagttgcagaatttttttcccctgtctattgaagtttatagtaagtcaaaatgcctggtacccagattgatttgaatgaaaaaaatagatatacatatatatgcatgcttgaacaatgtcaggcttccaatgtgcctctagttcctctgtaagtccccaatctaggagtttcttctgtagcttgattccagcaagaacaggcgctgcttcagtattcatttcagtggcgttgacaatactgacaatataattgacctaaaaagttctggatttcctgttaatgcactttagaaatgtacatcaactaccaaaaaaaattcatttctatctacatttcacttgatttccattttcaagagagaggcttcatcattattattctatttgaatagcactgatatcttgaaggatggaaggagatttctattgtatgcgggagtactttatttcgatattttctttgtctgattatacatgataaacacacattagtgacatttcgtgcatgtttggaagataaatggggatatctctttaaaccattcctgacacttgctaacctgtgagcttaatggcattttctctttgattcaataatttgtctgtcaaaaaaaagctgggctgacattctccttgttgtgggattgaaatggaaagaaatctcttctcttgaagataattttttttttaaattgaggggaacattttaggataaaaatgtttttgaaattatttgggtttttggtgatggaggtggaggacgggggctgggaggatggcgctgatgaatgcgagagccctgacattatatgtgtggcaagtcatcttaaaagggggcccattacctccatctgcaagtcctcttgaaataattagggaacgtgtgaaatcttgcaaatgaagatggctcctactgcggtgtctcctgggagccatcagcctccctcccggtggaggtggtcgggtggggtgtgcatctgtgtgcacaggcatagctctgactccatgcacctgtcttagttcccctggatgatggagaagtcccctgaacaatggtgagagggaaggcagtcccagcctcatgctggagaggctccaaatccagatgcctgttttatctttggagattttggagcagcctcattcaggggctgtggtgaatgtgaatcgagtggtgaacctcgagtttaggaagacatatggtgggctgcaggtgaggcttattgctcatgagggaggcctgtgcatctgtgagaaaggtggcctcacatgttgggaatgagggaccatttcagagctgtatcatgtgaccccaggatgtgttgctagcctgtctcctggggcccctccgtgccctgcatttgagggtttcttggaagtctgattacgtaaagttgatgtgaataggcagggagcagaatggaagaggatgcttggtgttgagagtctgcttccctcccttcccgcttctccaccataaggggtcttcacatgcaccattagaaaacaaggacttattaggccccctcacgttgattcattcaacaccttgtatgtgtgccaggcacagttctaggccccggggaggcaccccaagtcatataacttgcccatagtgaagtcaggaataaaacccaggtttcttgattcctgatctgatgcttttctggcacaccaccctgccttcctggagaccccatctcctgcaggagcctgaaattctttcgcattgtctggttgttcttccttatggcttccggttcccctgtctgagaacgcaggtcagtcatttcatgctgggttaccctagcaaaacacaacaaacacaaacaaataaaaatgaagtcatcaaccatcacatgtgttttcccaggctggatttcccactagcaaatagggcccttcaaaacctttgaacatcctgagcactgttactttagaagccccatcacacagcgtatcaaagatattaaaattaacccccatctcatattaaacatgatttatgaagtttcaatgtgaaattttggggatggattttaaaaatcatttttatagttttgaagtttaagagtaaattcattatggcttaaactttgttatatttaactgtaaagcttgagttgatttgcacttaactgactgatgaatataatgtttctttctgttgaaatttaatgaaatatttatttaatttattattttcatttattatattattatttatttaatgaaacatttattaatcttagttttgcaatttttatttcacattttagagccatttattttcagatatcaaacatttcattggcctttaatgagtttagaggagagcccttgacgctatgcttgtagctcctcatggatgaaaggccctgaaaacagacctctttgcagctacccacccaaaaccaaattgtatactgcaacatttgctgcccttggagaaccccaaatgggcttgttggaaaacctcttctaaaatccctgggactggcctgagtgtcatggaagtgaccctgagggctcaagaagaactgccgtttctacttgccatggtgtcttactcagcttgggctgccataaaaaaatactgcagaccaggtggcttaaacacagacatttgtttctcacagttctggagtctggaagtccaagatcaagagccagctctgtttctggtgaagacttttcccagcttgcagatggctgcttttttgctgggtcctcacaccctcacatggtagagacagcacaccctgttcactcttcttctgagggcaccagtcccatgatgagggtctcacccatgtgacctcatctaaccccaattctctccaaatactgcaacttcaaatactacttatacaaaggttccacttcaaactactgtcacattgagggctagggattcaatatatgaatttgaggaggttgcggggtggggcacaaaccttcactccctaacatacagtgtggtggaaacacccaggcctcagagtctgtggctgtgggtttcacatcccaggcccaccacttttagcagtggttagcctccgaacttcagttcctacatctgtaaaatggggatggtaatcaatctgtagggttgctatttgcattagaagtaatgtttataaagggtccagcacccagtaggtacctcttctcattgtaatttacccagtcatgtgagggcatctttaatgaaatgaaacagcagctgttatgtgtggagttacaacaaagagacacacacacagagcagggagacaggccaggagcatgtctggaggcaagaaaacaggtaaggtccttggcattgaggcaaggaggggctcctacaaaaaaagtttttttcctacatttctgggaagtctcaggctttcagggaactcctcaggttgtgccagactgcaaagagtgggctgagaggcccagccttctgggcctggggatgattcaggaatgaaagatccccaagttgggaagactcagcttgagggtttttcaccagaaaacaatctgcagtttatttatttatttatttttgccatttccagaatggaaaacacaaacggaaatgatgagttttataaatataggagttttgtgcctgggatggaggtggggcgttggtatttatgtgcaaatagccctagattctgcagattaccagtatctggggaaggaacaaatgcccagcatttagaaagccatcagaacagggagcgccacccctggctgcgagaattggtgggcagtgatatggcaaccctctttcctgagtactccaccattagacgggattggtgggtggaaaatcagaggccatgagtagtctcccaaatccttccacttgagtcagcctgcagccaattaaccttcctgaccgactcaaggcaagcctagaccacagtggaaggaacgtcccctggcccaccctctctctctaccatcctctctcccttccttctgccactcaagtgagtgctcagtgtgtatcaggcactatcctaggtgcttgcattaaatccatgggcaaaatggaaaaatttataatagacattaaacaataaatatgtctcataaagacgttacacgttggagggcaaaaaatgctatggaaaaaagaaaaagagagcaggtaataaaattagtagtcccgggtggaagtggcaggacaggttgcagtattgaacagggtggtcaggagaggcagcattaggaaggtgagatgagtaaatggcaggtaagtcagttgagggtgttgaaggacaaaaagattataaaatgaactgtctctgagctcatagtgtctgatagggggaggaagaagccagtcaacattggaatgcctggaatatcatttcttcctaacaaatctgagcaatgtggcttagggagatgaagaatacctgtgcctgccagtccttaatcttatgtggctcatggtaccgctaggcagtgcttggtatcagatggagattgggacctgggtataaagccagagttctctagcccaggtggggtttttgggtttctaatggctcaaaacgtttgttggatgaatgacatgagtggttaaatgaaaaactgagtgaataaattcatcaatgagcaaatgaatgaacaatgaatgaataaagactgattaaaattcttatctgtattaagaatagataatttacaagttcacaccataagttactagttgcacatttagcttcagtagtaatttttaaggtgctttgctatatttaaaatatataggcatttacaccattgagtaaattttcaaatgtagtgaaaaattatccaattttaaatatgtttaggtattatggtatagtccgaacttagattttcacttatagctgtaatcaaagtagaccatattttctgaaccagcagatgactttgcctcctatgtagagtgagagcagactgcttgataagcttgtgaatcacagtttcttgcttatggataattgctgctcttagtcttgagacatgacatagagattgacgcagagtaaactgctggtctgctggttactaaactttgcatattttcagaaagacctggggaaacttacagaaagagcggcagacagtgtcaggcaggccacagactggccacccccaggtctactttatcagaagtttcaggtatggtctccaatgtctgcagtttaaaattgtttctcaggtgattttgttgtcgatagtgtaggggattaaggaaccactgcaccaaagccaactttgagagcaggaggtatgtccttttcttttaatttttttttttttttttttgagacggagtctcactctgtggcccaggctagagtgcagtggcgtgatcttggctcactgcaagctccgcctcccaggttcatgccattctcctgcttcagcctcccgagtagctgggactacaggcgcctgccaccacacctggttaattttttgtatttttagtagaggcagggtttcaccttgttagccaggatggtctcgatctcctgaccttgtgatccacccacctcggcctcccaaagtgctgggattacaggtgtgagccaccatgcctggccttaaaatttttactttattagtgtctatcaataaatggataagtgtaaatcctaattgcaggaagccaaatgagacagatttatccccctccaacaaggtagcatttcagtcttctttctttctctgtctctctttttcttattttgtttatcttctccctaaacataggacttctctgtatgtattactgtactatgtgctttctctttacaattctgatacattatgcatgtctttcaatacatattaaagctacatgatattccagaatgtggaagtgatccatcctttcaacttgttgaaattcattgatttactcaagtgcttccctcatagaaaaatgttgataaacctttgctgactgaataaatgaagagaacatagctatcttgtaccatccaccccacgtcagtttcccataggaagtttggggttaaaatcaagccagtttccttggcacatgtagttccagctacttgtgaggctgagacgggaggagcacttgagcccaggagtttgaggctgcagtgagctatgattgtgccactgcactccagcctgggtaacagagtcctatctctaaaaataaataagtaaatacctaaaaaaaataaataaatgggccaggcgcggtggctcacacctgaaatcccagcactttgggaggccaaggcaggcagattacgaggtcaggagatcgagatcaacttggctaacacagtgaaacccagtctctactaaaaatacaaaaaattagccgagcttggtggcgggcgcctgtagtcccagctacttgggagactgaggcaggagaatggcgtgaacccgggaggcggagcttgcagtgagccgagatggtgccactgcactccagcctgggtgcagtgcgagactccatcttaaataaataaataaataaataaataaataaatgaaccagctgagacttagttcttcttaggaaggttctaggctgtggtgagaacccctctaatgcaggggttcaggcaggcttgaaatggagtcgctgtttcacaaagggaaagagaacagatccgccaatgagaaaagttgatggggcagaggcctcaggcaaggtccagaccctgtcttcagagtctgtgaacatttaaggagctaagactttctttatcttcctggagtgtccacccactaatatagggcaggttatggtgaggactgtgaaagacccaagagccctggagctccctgtgcggcggctgagggtgttcagaggagtgagggtttgaactgagttcagaaggagagtcagcctgagctccgctgagcaaaggctctgggtgactctgccgcttacctggagagaaccgttttgcctctgtccggccatgtgaagaccggctggctagtgtagggggctcttggaaaccaggtgggtaagaaaccaagtaaactaactattctgttgtttctccaagaggagaaacagcagccacaaaaacctcagccctctgcagagcgaagctccaagagcccctttcacagacacataaatatttaataatcatctgtctacaaccaatctaggggaaaaaaatctttaaatagactgctcgaaaggccaaaacctgaattttaattgaggtactttgaattactcccattagtcagtcgctctgactttttcttagtgagggctggattgtttttgaaaggggaatcgaaattattagcagcccttaaaaaaagaaaaaacctgctgatcctactaaataataaactaggcttctttttaaaaagacgtggctttctaggcttcaagcaagaggggaaagtaagatgagccccacattttagagatgcaatttgaaaagcaagcgttaagggcattcagatgcctggctaagcagttcctcggcaaagcacttctgcaatgctccctggtcctgctaaagtttgcaggatggagaaggcgtgtgtgtgtgtgtgtgtgtgtgtgtgtgtgtgtgtgtgtgtgtgtgtgcgcgtgtgtgtttatatatttattttccgtctctctgccccctgggcctgcagtcttctgtagccgatgtaacaatcctcctggatgaacctcttgtatctcatgctagccaatttcgacagtctaaagtgctcaaattgagccattttgttctctgtaaaataaacctcaggccattatgcgtggtttttcattcacccgcctccttgtcacccttcccttggcccctctctgcccaccctcccctccttccccattctctcctcttgctccccctctgacgaatgggagggaagcagacatcctttaggagaccgctgttttcagtccaggcatgtcaacttcactctggcacaatttgctttgagatctgtggcatggagcagggctacagggtcaccccccaaccataattgatcttgcttattcatctgcttcctgcgtattgccctctccccatgctggcctttgtttggataaattgttggaagatttactgtggtgctgaaagccacctgccctggtgtccccaccacctcttccagggtgagacgatagagtggcacttagggaagaaagttctcccttctccccgccatcccaaacctagaggacatctcctggcatcacaattcaggcaatttccagactaatttactatggaatcacttttcacggcccttgtgcaccggtatgagaaatgttaattggtgtgtgagcctgagatgctcttccaaaggatttatcgtcagaatcagaggaggggaaggggagccgaggccgtctttgtgatggcttggaggctgcactcactcgcttcagattatttttaaaaccaatggtcatgatggatctgaatccagtaatttattcgattttgggtcattaacccttgttctgcttatggcagcaaatgacttcatcgtcagagatgatgagtgttccgaactgtggggatacttggctctctcgagctctcatctgaaaatcaattttaagcaagtggcaggcattagaaatcctctctgcttataggtttctgcagcattgcctctaggatttgaagaagcagggagggcgggggccggggagaagcctctggaaaactcccattgccggggtgtttgcgttggggtggctaatgtcctaagaaggctacacaatagactgtcaaaatggttctttcagagtggggcatggatcacagtttagaaatgggggaaaaggaaggaaaggagcaggcctccatggagtgatcctgcctgtagactgaataaaatagcttgaaatcattgttttgattcccattgactgaaggctggaggggctttactggttaagcttttaaagccgcagcagtttaaacacttttttttttgccttttttgcctgctgcaccctttctccagttgactttgaaacacattaactcatctttggaaaaacaaaaaacaaacactgtttgccttcaattccgaggctggcttctctcttgaggtgttatataaataggtggcatcatccagcatcactgtgcagggcacaggggactggcgtggccagtgccaacctgcctcccaccgggtacacactcccatggctgtccacactgcagtcctctgccatgctggacaaactggctggcagtgtttcggatcagagaatttcttccctgcctctgaagatggaagcaatgtttgatgggtgttggagagctctctgagaaagggcccatctttaagcactgcccatgtgagcctgtgttttccttaaacatagtcatgggagatcctttccactgctgactttttaagttgaaatatttagggagaaaatatgagttcttagaaacttttaagtggaagagatttagtaatgatttagccaatccccttatttttttgcagatgaagagcctatggcatagatatatcaagttccttgtccaaaatcacacatactgcagggagcagaagtgatcctgaacccaggtctcctgagcagtggagtacctggggtagggatggcagcaggttgctcaggtgcaggtaataagggactgcactgtctgcagggaatttacaaacaataacaaagcccctcactctgcttttaatgaccaccatgagctgattctcaacaatgtcagagctaaaaacacccctttctgccaaggtaggtgctcccactagccccctccccacctctttgggacccccactgcttctgactcccagttctgtgtttttctcactacactaagatgcatccctcatcaaatagcaaccaaacaaaaaaacaaccttatgttagaagttccctgcttcttttggaattaagtaaggaaaatagccttttgatgagctcacattagccaggaatggtgcagaaaagtgtgatgtcttaaaattcgaagctagggggcccctaaaaaagaagtgttgggatttgttggctctctccttgcctgcatccctctgacatgtgagtgtggattgcgggccaggagctcgcaaccttgctctaggtagattcgacagagccagggactctctgcgttaccttccaaacctaattctctcccatgtatcatcagagcctagggggaacctcccagtggtctgagggcctgaccagcttttatgtgtgtctctttgtggtcatctcggccagactggttgctatccaggtttttcttctcctccgcagccgctccctgaaatgggtgggtaaatatcccagtctgacttcagctgccgagtcatcagtcctgacagacggctgcctctttgccgagcaacccccctcactgcctcctcccccagcccctcatttcatcttccccctgtcagaactcaccctctggcagaaatcttttccgagagctaaatgtgagcctcaaagagatgccgtcaaggtatttttcataattttcaaaggtaatttccttccctctcccccacccgccttctctctgttataattatgtcttagcagctccccaaatcagcatagcagccaagttccctccccctgaaggtggccgccttttctcgcacaacagtcctgggaaaaggccttggagagcaaggctagggagccaaaggcttcctcaccattgcattgagaggcaagctggtggccttactgtcccgggatgaaggaagacttaaaatggctttgtgtcacttttggtctagagagtccactgtaccctgaggtatttccctaagtgccaggtccatgatggtgtttagggtactcttaatctaatttatatccttttttttttttttttgagacagtgtctcactctgtcgcccaggctggagtgcaatggttcaatctcaactcactgcaacctccgcctcccgagttcaagcaattctcctgcctcagcctcctgagtagctgggactacaggcgctcactaccatgcctggctaattttttgtatttttagtagagatggggtttcactgtgttaaccaggatggtctcgatctcctgacctcgtgatctgcccaccttggcctcccaaagtgctgggattacaggcgtgagccactgtgcccaggctatatccatatttttaagagtaggcaacatccattccaggacattctctgcagtttctttaccctcccactccccctctcatgcctccttactctctcaggaaggagccaaggaaagaattcctctttctccctgaatcctgacctctgtcacctctgaatcctgcctgtggctggccctcaacaggtggcctggccacaggaacgggaggaggactggcctgtctcaggccctctgcagagatgcaagcatggccagccctggctgaacggagatcctgagggtaaattatcttccactaggaatcctgagacttgacattcaaaaattctattcattgaaaacagactagccctgaaaacctggtttagtagataaaatctgtaaccacaagaggataaatcgagtttggcttgtttgtactggtctaacttaatatgatctcccttggagtttccagcatctagattttctagatcattaaatccattacttttcagtgttaacttttttttaggaggatggggtagagagtggatatattttttagtggcatcccacactaattgtgggagcgtcatcaaagctcattttgggtgtgaagtgactaatttctaagcccaggggttctgaaggaggattttcatccatttatcacaaaagaccccaacagccagtcaggaaaggggtctgctggctatagccactggtgtagtccacccagaagaatgaggagaggggccacttccaatcccctaaaaatactgaatgccaggatgaggggtgtgggaatgtggccatctcgtctcccgtacctctggatgctctacggggccatggagccattgctgtgagccagtgtgtgaccatgagcgagtgggccaccccctccatcctcagttcctccatgtgactagtggagcagatctcacctgcctctcagggtgagtgggcgaggcagacgagggctgcatgtgaggatcgtgtgcaagtcttaagtgctcatgaaagtagccatcaccatttccttaagattaacgcctccgagcctcagtcttcattgtttaggaaagggattctgtgtgattgagattttaacaccatgtgcccttcccctgtggagtggtggcatcttaaagagtgaatattttgttccagctctatcctccagggattggctttgggcaggtggggcaaaacatggggccaagttctttactctgaggggagatgcataggcacatccctgacttcccatgtctccagattgcatgggatggaaggaggagaccagaggtgagggcaagccatgctggatagtgtccttccctttgctcccttcccaaagtccaggataggaggaggaggagggagtgaggctggccgtagaactccagggcctatgtgagaagactgtcacactctagggttaggggcagggtctgagtgcagttcagggttgccaggttgtcagaatggcttggagaggagcagcagccttgcccaaagctggttcctggagcgcagttaagtaaagtcctgctgtcaacattgggcttctgtttaccggttgttcaagcccttggtctgcactgggttcctctcctcgatggaccactgtcttccaaccagagttttcagccactgcactttgtcatcagacatagctgcaggccacggtgcatctcagaagcccatgtcagggctatacttttgttccaggacagagctcacagcccagatacagcatgagagctttcatgtcccactcctatggtgaagagccaatgggaccctagtgcacttgttcatttcattgtgaatttgaatccatggctgtgtgtgtgtatcgggggttggggggtgctttcctccgagtcttttttaaactttaataagatggttctttaatttttggcattatcctttaaatacatagtccttttggctcttcccccgacccctgtaacccctccaaacaattataaagcataggaacaaagcgggctgggatgtaagttgtgcaactggtcagttcacaacgaggcagtgcgtgcatgcacacatatgcatgtatgtgcgtgtgacagacactgagttaaactcctcatcattaagtggtgtccttccttgggcaccagaagacactacacagtgtcttttcctgcataattggactgtcttttcatacaagctgaggcgcttctttcgggatataagcccatgcagtctcaacaggtcaggagcgatagtaaaaacctgttgtctggctttgtatttggaataatggagtcactaatctacttgatctggccaagtcagataaaggagaaagtgagggatgcctgtgcttcagagatggaatgtatttgtaaaagcgatttctttgcgggagggggagaagggggagacacataggaaaaaaagggagcaaagactgttggaaaccttttaattagtactaattacctcagcagaaaatgttggaagcttaaaggatttgtgtcagcaagtgaaagatcaaagattgctaggctcgcattttaatctgttggctataaaaaggagtgaggggggtggtaatgggacccaggagaatggctgcccaggtggcgctgtccttaatcccttctttactgctgcagccccaggcctagtcccaattacataataagatgatttaatttttttttttttttgctttgactttaactggatgtagaaaagaggaagggtcatttttctccccttcagtgaggatggggtggggcttctgatggtagacttggtagctgcacaatcccttgtttgatttccctaatcagcaaaatgacattttaatttcaaattaaaacaacaaccaccaacccacacacagaagagcgctctttaaggataaaagggtctgtgggtatacaaagaaagtgagggcctttggttggttgagctgtggttgggcatacctggggcaacaggtaaaatgtgttaatagaaagctccacttactgggttcatcaccatgacagttccttacaagtccagtagggcagggacagagggaggtgggggggaaggccgaggaagagtggagttgacaagccacaccacccatcttagaaggcctctgtgtttctctctgtcaccaccctattttctttcctttcagaatggattaggctggggcaagggctgttagcagaccccattggtgctctgcccatattcccttggcaatcaccattcttgtgcattgccaacctgatggcttccaactacagacacctgcaactctattctctggctgcttgaaccttctcagccctcaaccaatgactgatggcaggaggttggttaatatcccagctcccttgtccctaactgagatgtcactgagaagtgatccacattacatcccataccattctagagaagaagttggtggtcaactgctggtcagcccaatatggtctgctgtttctgtttaaaaaaaaaaagtatatatatatatatataattatatatatatatatataattatatatatatataattatatatatatggtaacattgttatgcctattcatttacatattgtctatgactgcttctacatggagctgagtcttaacagagatcatatgacccacaaatcctaatatatttactatctggctatttacataaaaagtttgctgatccctgaccttacggggttaaacccagctgcccttagcagtaacccacctcatactatatcctttattgacatctttccctttttaatctcactttctggtgttttgtgtgatcacttcccaaataaatgacttgctctcacatcctcacttcaagatctgtttctaggaactccagcttaacatcatatgcccatatacacaccaaaaggacagaatccctgcagatagtgctggttcatcccatttcttccagaagccaaggttgacaccatcagaaacataatgaaacaaaatagcagttcagcttggagaactcaaaaatgctttaacatactgcctctctgactgaaggatctgtgctcaagccattgaacctctttgttcaacaacttaggctccttctaaagcttaggctttaggagataggctgcaggaaaaatctagaaggaagcctgtatggtagaatggaggcccactggctctggatcagtgagcgtggctcagccctctggggtgtggcactttgtcttcatgggaggcgtgacctagagtggccaactattagaaggctagcctcctggctgcagcatctaaatatccactccctctaggaaaggctaccagagaaggtttcaggcccagacctcctgacgtttagcttatgtctcttcagaatcatatatgtaaatgtaaagcaactgccattcaaaatctgatgtacagtccctccttgtgtattgtcttcttgtatcttcagttagttaagtttgatacccatttatcatgaggccagagagggacttggttggaagattgaagaaatagatgccccggcactttgccaggtgtattagttatctattgctaagtatcaaattgccccccaatttagcagcatataacaacaaacattatttatcacacagcttctgtgggccaagagtttggatgcagctgaacccaaggtctctcacaagcctgtggttaaggcatggaacagggctgcagtcctgtcaaggcttcccagggaggatccctttccaagctcattcacgtgattgtgggtgggattcggttccacatgaaactaaggcctcactttcttgctggcagttggttggagacctacctcggctccttgccacatggacctctccataggacagctcatgacttggcaatgaacaagggagagagaaggagaggcccagaaagacagaagtcagtgtttttgtaatcttatcttagcagtgatatccatcacgtctgcaggattctgttcattagaagcaagtcgagaggtccagcccacactcaagtggaaggggttacagggctgtgactaccaggagggagggatcactgggagtcatcttagaagatgcctgacacaccatcagctatcaatctgaacatgccactatgctggtatcatttaataatgaggtacccacttagacagatttcattggctatctttaatcattaaatagtattagctactttagaataaaatctttctgaaacttctattaccaactcctctgttttcttaaagaggttacacaaaatgtacttttatgattttcaagtctcatctcagaatctacttctttgaaattgtcattcttggacttctagcctaaagtaatcactccctctgggttcttgtagcacttattttctatattgtttatgtggcatataatcatatattgctttgtgacagttctattgttatcttgagttactccttgaatcttgtattgtttaatttccacacgtcgacatcttgtctctccataagaattataaacaatttaagtgcagcagttgtctaatacttcagataaaagcaactgcaatggaggttttatttaaatatatgttgacttttttcctttgatgatgttgatttctgattcatgatggtgattcttttaaggctactaagaaaatagctttaaaagggtaaaatagtctaaaaaaggtatattactcattgcccttacattgggtggcccaaatactctgattttttttttttttagttttggtttatttattttggtaggtggttttgttttagtttttaatctgttttcctttagtgttaacataataaccattgcttttctcccttttctctattttggccaagaattgggactagattcttgaaatactgctttaaccgagttttctgactaaatgcttatgatcttctgtaacatcctgattttgtgacatcatcattgggactgagaggcagaggaaaaaggaacacacctttattgaacactgactttatgccaggcgttattcacttacctctaggttcatgactgtgtttcagagaatgaagatggattcaagtgtgaacttcagataaatagtgtgctgtacttttatagtctgaatgatggtcatcttacactaggaatcagaggccaggtcttaggaaaagagaataaaaataaatgggtttaaggaggttggatttgaccgccgcatcagtgctcagggtcctcagttcgtaatacctggctcacacagctgcttgggatgttgcctccttgtgaaaccacttccttaggcctggatgagaaccttggcatttcttataagaatagtagtaacttagaagttgtatatgggctgaattgtgatcttcttccaaattcatactttgaaaccctaacccccagtacctcagaaggtgaccttacatggaaataggattgttgtagatatcatcagttaagaagcgctcatactggagcagggtaggcccctatttcaatacgactggtgtccttgtaaaaagaatgccatgtgaagagatgcacacatgtgtggggcggacgccgcatgaaggccggagttaggctggagcagatcccgcgcgaaggccagagttaggctgggccagaagccacacgaaggctggagttaggctggggcagacgccatgtgaaggctggaggtaggctgcatgccaccagaagctaggagagaggtctggaacagaccctcccctagtgccttcagagggagcgtggccctactgataccttgatttcagctttgtccactctaggaatgtgagacaaatttatcttgttttaagccacccagttggtggtactttgcaacaatagcccaaggaaactaatttcacaggagatgtttctggcctggatttgagtctgctacacctcatgttctgtccttggtcctgaatcagtccccttgttttctgtccgaggtctcccattaccttcaggagtctccattctctaaaaggtgtctgtgtgggaaggtatcttcctgtggtagttccagcccagttgctacttcccatggagaaagtagcccatcaacggtgatgaaaatgacttcctacactcaggcagctgtgttggggcagatctgaaatctctgagggacagcccatttggcatggggtattttcctgggctgctgtggcttccagggcagatgtgcaaacacatctgtgaaagttcagggcccctgagagctaatgagagctgaagcttcaacctgcttgatatgtttgctgtcactttcttttctagtgacgttggagaagggaaaagtcatgcagtctgtcaatcttgtcttctcccatgaaattgagaaagttctattactttcctcgtgaagactgacatctgtgccatctcttccaccactgtgggggctccttcctagatcacgatttgggccaataggatttagctgtaacccttggcagctgtggaagacagcttgccagaacagttgtcagaactcaaaggaagcagagcagtttgcccgacaatagacagagcaaaagtcttatcctcgatctaatccagggtttcttaaccttgacaccagtgacactttgggacagataatgtttgtagtcagggcctgtcctgcatattgtatgatgtttatcatcatccctggcctctgttcactaaatgctaacagcaccacccagtcatgacaatcaaaaatgtcttcagatgttgccagaagtcccttggggaacaacatagcccccacttgagaaccactgatctaatcccttcaaatcaccgtagggatctctgggggattttgcagtggtctcgggaaaatgcacagacatgtcgtattaggaaggggtagttttgggtaattgcaaggtagttgaggacatttaagggaattgtacaaggcataaagatgtcaggcttctgaagtttttttttttttttttttgagatggagtctcactctgtcaccaggctggagtgcagtggtttaatcttggctcactgcaacccctgcctcccgggttcaagtgattctcctgcctcagcctcccgagttcctgagactacaggtgtgcgccaccatgtgcagctgatttttgtatttttagtagagacagggtttcgccatgttggccaggatggtcttgatctctttacctcgtgatccacctgtcttggcctcgcaaattgctgggattataggcgtgagtgagccaccgtgcctggccctggagactcttaagacataaagtgaaaagaagcttcaatcaatgcataatcttacagattttaaatgttcagattgttcagctattgtgattatgttaccaaggggttactgtttgctggcaaataggtagggtaactttcatcacagtttgcccaggacagttttagtttacgccattttcctggcataatcagtagtagtgtcccctttattctaggaagtatcccaatttagacagcaaattttatggtcatcttaccctcgggccgggtgcagctcactgtggtgtttgtggacagcacaaatgctaatatggctgtcactcagtagagtgtgtgctctctgattccttcagtcctcgccactccttattgtcatatgtgcatttgttgtattgcagcatttctaagatgtacatttcttttacatgttagcatacctgaatccatctcaaaattgatggattcttgaaattgtcactgaccaggaggcagctgtgatggagttgctgttattagtgcacacttgaattggtcatggtggttcttattatctttgctgcagttgacttatacagatttttggtacttcacatgtcatttatgaactcatcatgatttggcattgaaagacaaaactattgtgttaacaaaaagaacataaacttgacattataaagcaaatctttattattgaaataatgaccttggttcatattttctggcaaagtaacaagcagaatatgaaaaaggaatgttcctgaggcattttaaggtaggaaaaccttgggtcattctttattgacagtgttgttgttttttgttttctagtacataaaataatgttgtgtctataattggtgcagcttggattcattgaaatgcaatgtgtcacctgactggaccctgaagatgtgtttgagttgagggccccagtggttcttttactgcagtagatatagatttgagttggggaattagatcatggatatccacacacaaagagcctgatatctaagtcagggctgggcctgggcttctgaatttttgataagtctcaggagattctggtgcaggtggtccacgagccactcttttacacagtctgatgtggtcactccccttgattccactccagaggaatctgagcccagataagggagggctctgttcatgtagtgagttcagcccactgacccctgagtagtgttttcctggatgctgcatcaaacacaaggtgagctgaggaagggctgcttggcagctttgcctgaggtggggtctgacccagactggaccagatgtgggtcgcctaccctgcttctctcagctgtctgtactataagcgtgtggatacttggtacatggatatgcacatgtggcttttatttggtttccctatgcatgttcaggaaaacatgtcacataaaagcaggtaaaggtattttggaagaaagagagtggggatctatggaaaatgatagggagggaagagcagaaaacaaaaaagaacatttctaagtctggcagaggacgaagacaggcctggaactggaagcacctgcacttacatttcttgagtgctttctggtttgccaagcactttcccaagcttccatttgaacctccagattggaaatggggggctgcctgatgttctttttattccttcaaccccagtgcaggcccctcactctaaggtgaggacatctgggcatccacagccactgactcctgtccaagctgcctgctcagggggccctgggtatggggcctggaaagggcctgtgagaagagtctcctccaggttcccctggcagctcccaatcccctcaccatggcaacctccaagatggtgctgaagaccccagcgagagcccccactgctgttcagaaaacctgaaaagaatagaatatagactatggtggacatttgcactaaatatgcttacttagcaattctgcgcctgaggaatgtcaaccttgtgtttttccatgccttcctatgagtgtctttcacttttcatcactcttccttcaattttccctcagttagtgttctctttagaagtgatgtttttcaagctgccttcagataaatttctggctctcttcttggacttttcttctggaaaggaggcaggattgggatttgggcctgctagtaggatgcaaagagatataacctattgtgcccatggtcacagagcttaattaattgtcaaggagacaagagtaagatacctgggacagttggacaatagaccaaattcatggaccagtggtagagaaagtgttcaaatagaagtcctttgggtattcagtctaggcatggttagctgggtttgggacagacagagaagtctccaaggaaatgggctctaccttgacccgtagttgtgatgcacgtcaatagtgagcaggtgggggcatttcaagtgaagataaaatgaccagacacactactcaatctttctgcagatcttggcagatccttagaaggtgataggaataaaacctagaggtctggcttgaaagcttgggtcaagactgatcaaaaagttagctttgtcaaaagcatcaggctcattcttacctacagacaacccatggtgatcctaagtcattaatccacccagaggcctgtcctaacctgagtttccttgctttgaagtgtgctgtcctctgcaacatgaggaaataatttgctgcctgcttcagtgaaccatcaggagagccagcagacctaatgacatgtgagaatattaacctcctaccatgaagagctgtgaatcttgagcggcagtctataattcaccctggactcttaagccaggcctctccagctttttctctcactcactttctcacttacacccagagagagaaggagagacctgctcataaaactttatattctccaatagtgtgagccttgctgagctgtttagtaatgagtgactttccttttgcagtcatggaaaaatgtatacctacagaggcaggagcagggggaagatattttttcaatgttgcgctttgcatacgctttttcctatgcagaaaggaaaagtgtcctcctgacactggaaaaaatgcatgatattatggaaggtgaccatttcagtgcttgaataaccaaacttctttgtaattctgtactttatgttaaaagtcaaagaaaagtggaggtgaggatactaatcttaagatatttggatattagaagagatcttagagaccttttaaggtcacttggaagcagaagaagcactgaaatctcattaacagtggtcgtctgtttatgcccttgtttcacgagatttggggcttttggaggacaggattgtactcctagtgcctggcagagtgtctaatccataggaggcctcaaattaaagttagtcaaaagatggagccagtcacctgctctaaccccacattttgcatacggaagaaacaaaggtccaccagtgattgactcatgggcacagctagagtttttcttaggcctcaacggcagctcttttcttccatctgcctgtctaattgctgctcttggccttatgatgttttcacaagcaacgtgttattctaatggagactatcttgatcttgtcaattgagtgaaggcaaacacaaatgtagggccaaggcaccatatcagggagtaaatacagaagtgggcaattagcctcagggcccagagtgcaaggatgtgcagatctggctgcctggcagagagcacctagcatggtaggagtccttagaccagaataatcttccttactttgctaggaaagccttccccaccaggcctcactgctccaccagctccatgtgggctgggaggaaacctattttattcatcctaggcctggctaggggatgctcaataaatatttgctgtagggggaataaataaatgaatgaaggatccagtctgtgattgttagggtacctttctattcaaccaggctgtttaatttccgtatctcaagcatctctgtctggacaatggacaatgctgggcacctataaactttttgatgacttatagaggtaataaaatcaaactttcttcttctgcttacttgactagtgcgatgaattaaccaatggttaatgtctactctcggtatatgtaattctcagcctttctgatctcttcaaattactgtcttcttccttctgccatcttctttttttttttttaagaattaattttattaaaaccagtcaaattaaagctgcctctgtccagggcatctcaagatccatccattatggcttcttatcttggcaggcgatcggcttggaaaggcagctcagccattatgcacatacaaagcccatcacttcacaaccaatggtcaattcatcaaacatttatcttttgccctctgagcgtgtgacgctttgcctctcatttcctagtttgggttgctctgaaagatgaagaaaagcaggcgggagttcttttctcccctaactttccccttcccccagatcgtttttattaatcagatttcatacttgaggcttgaaacatgccctgctctctttttttggccatctgagggttagggatagtctgccagtctcatgctgaactttttactgaatggtggaacaattaaggcaatgataaaactttgcgagttttcatcttgcaacccactttggtgcatgggatgtttaaaaatgaagagacctccaaaataatctagcctagccgccttagtttacaaaacagtacagtgaggcccacaggaggcaagggtttgactgaaatactgcagcaaggtgctaaccaaggcaggacctggatcaggttccttggttgttcctaagacagaggctctcccgagctgtcatctccccatgcattcaaatgattctgaaacatatcactatttcttctggaggtttagccactgacctgcttcattttctgaggcaactaatttcttcctttgaaaagaaaatatgcacatttatttttcaaaaacaatctttcagctaaacaacaattggtctaggtttgtcttcatgtactgtatctcagctgatccccattctgatatctgcaaattggacaggtcagggattttctgccaccttgaaagattagaaagctacattttccaagtgttatttttccaaagtcttagctcacaaaaccaggacttgaaaacagagctcatgactcaatggagtggtcttatgctgtgtgtttaccaactagatttgcgtttggcctcattgagttgacaagatattcctcatcagaacaacacattccctatgaaaacaccacactggcttcctgctgccatgagcagcagtcagataaccagagaggcagacacagaggaaatagccttggttcagtgctgggaaaaactctttttctctatgctgcacaactggaaacagttgatctcgtctctgtccctaacattgttaggtgctagtacacagggcccaggacatgccatgagaggatctggaaagcaaagctcaccaaattattctttgagaggttttgtgaaccatagagctagagctattctggaagaaagaaaatggctccggtagcaagccacttttggaggtcaccatatctcctggggccttctttcctgctggagacataaagctatcttgtagtctgggacagaaaacgtgttttcacctttttcagccaattaagacctcacagaatcaacagttggcacgtttttactggctttcctggcctgagtccattccaggggggccctgcccgtggggagctggtctttgggcaagtatttgattaggggcccttggggtccctggggctttgagatccagccgtgtaaatgtctccttttctggttggcttgcaatgagtagacaccatctgttgaattaaaaattccctttatggagggtggtgaaaggcttgtgtagaagagacactgttatctttcaagcaaacagttcatgaggttgaagagcagcgttcttggcccaacatatgtttgcccaatggctgtgggcgcctcccccaccaggctctgcattccgccccatggcgaggtgcacgcataccatggctgcggtacaccgtgtccactctcacatctccctagcaaagaaaacccccatttatagaacccgccaaacaaactcactctttagactcttaaaaacaaacaagatcccgaggccacaggctccatgcgtgcatgtgtggttttgtaaaatctcaagccgtgaatcaaaataatttcagagacatagtcaaagcccaggccaaaccctgtcaccagggtgggaaaaagacaggaaagattcgctttgaggagggaggatagcccagagaaggagaatgatgggagcaaaacatggaggctgtccttcatctagtatgttcctggagagacacctgctccttgtctctgtccttagggacttgctataataccttcaggacaagcataggagggatgggccaaaaacagaaagggcttactacagccctcattgctttcctctcaacttccagagctcatcttatccatgctgcttactgatacgctgtcctgtatggtgtccccttattccaagcccagcgtctctgtctccttcatagatggtaagagcattgagagcagattccatgacttgtgcatcatttgtatccccagatgcatgtgctcactgaattcctgtcatgttggaaatggataccacaccacatgctttttggtagcaaatcagctttctggactgtagcttacttgagtgccaggatcaagttatctcttttccttatgttccctcaccaccaaatgtggaataaggtatcagcagatgctcaaaagattagaattcatttgcattgagacttagctcaagcccatctccttcaccagccccagccccttctcagagtagcactaatcatcccaatctattaccctgcattatctggtaactgcttccctgtctatacctactacttaatagtaggggactattgcacagtcatccttgtagctccagagactagcaaagtactaagcacagagttggcactcaatacatttttataaatgaatgaatgaacaagctatagaggtgtaccccaaggggatcattagcagataaatctcaagccagtcccacctaatgcatacttaacttcaaaggaaaaaaaaaatctaagaactagctctttgggagattcttctaggagcatccatggagtacagagtgaaaggaaaaagaactcgaaaaccatttaggttcatcattatattaataattgaggacgtacaatgaatgggttacaaagctacacacagtgtttggataaaggatgtggcgatggtgaatttccatttctggaccacagctagaaagtatgtagaggtagtttaacatagttggggagcactgcactttatgtacacaggttctaaatgtggcctggtgactcatgtgtgttttcaggtaggccactttacctctctggacattagtcatcttctgtgaagtagggggagagtggaacagcctaaaattcctctaggattcaaagtctatgagtctataagaagactataatagggcatattttacacaaatagagctgtagctctaatatgtagtttactttctataagaggtcagggtgcaaacatgtgcctttttattatgggcacatgttacacccttcccatagttaggaaaatattaaagaagccttgcacagtcccagctagaagaatgaggcatagagtttagtgtgctggaactctgctaccctcttcctaccagactgactcttaagggaccctttggcaaagcagaactgacttaacagcccttataaactatagttataaaggaaggagctccagtcagataaccatagtatctggatagaatattagaagccatcgaatctgatctctatgaagaaattccctctaaacattctccatgattttagcctctgttcaaataagtatagtggctctgagggcagctcatcctttagtgaacagcttctccattttgacaagtttcaaaaaattgattcaagacatttcctcccagcttacataattttctatttgtttttgattctgcattctggaaccctgtaggctgaggactttgaaatgactaagacttctctgctcctggttaagcaactttaggactgtctcaatcactgtttcttacacccttcacctcctggtggttgtccttggatggtgtttctgaatgcaaatccacctttgaatctggcacctggaattcaaacaaagctccaggcacaggcacttaggggccaggagagtagtagagtggattgggatcagatttgcttctgtggtggtcactggcgattcatactaagtcctcttcccagacactgctctttttctaaagcttctacatgttatgtatgtggaattgtcttgttttatttaaaaggaatattaactgtggtttttcctgattataaaatgtatattcatgatagaaaatttagtagctagagaaaactatttgaaaatgactgataaactccttacctgggggttaacggtatgtatctgggagatatagataggtatcacacacatacacacacacacataaatatatacatttaagtgtgtttgtgtatgtgtgtacagaattgttataatgtctctgtgtacaagattgtatattaacagcagtttataaactagaacaactaagaaagatgactttgatgattcttaaccattaacatggaagaaaatgcccagaaaagcttggtgcagattaaaatttgtgtggaaaatggtgaggaccatatggatgacttttaattttcatgcatgagatctttgtgtgtgtactatattacattgtgacttaatttggggtacttaaatgtatagcatgaaaattgtactggctcattagatagctgcctacaatattatttttaattcctgtgtaatattttatgatacagatatattgagctttatttaatcattcttcaatccttgggcatttaggcttgtttgcaatgttattgtaaatgctatagtgaacatacttgtacataaacttatacacatctttgatatttactgaataaattattggaattggaattagtggatgcaaaggtaattatttttaagtcttttaatataaattgccatccagcaatttcactgtctcattagtcttgtgtttgtttgaagtaaaagcttgacaaaactatgttaaaatctaagaaaaggatataaatatttttattagaatattctagattcctaataaagctgaaaatttctcccatatttttattattgacaaatttccttgtgaattttccatccaaggtttttggtcatttttctgttagggcttcaggttttccttaatgatttataaaagctctttccatgttaagggtgttaaatcttagactgttagaagggttgcaaatatattcccaattttcatattccttttaattttttcgagtaaatatttttggatagttgaactttattatttagtttacattagacactgtgaaatttcatcttattgagctgaaaaatggttgattctaacaggatcattttggatcctactgtatctttcttaatatctctttagggtcctgtcccctataaatgtgataaacatctccttaaccaagccactggcaaaaaacaaaaacaacaaaaaacaaaaaaataagatcaaaatccctagaatctacccatagagcaatttgagccattaatcagtattcttcaggtacatttttgaagcagttatgactctacttctacctaagattgtcattttctagcctactttttggcttcctgtcacaaagatattatgagaagcttattcaaagccttttttttttttttttttgagccgagtctcactctgtcgccaggctgaagtacagtggcatgatctcagctcactgcaacctccacctcccaggttcaagcgattctcctgcctcagcctcccgagtagctgggactacaggcacgtgccaccacgcccagctaatttttgtatttttagtagagacgaggtttcaccatgttggccaggatggtcttgatctcttgacctcatgatccaccctccttggcctcccaaagtgctgggattacaggcatgagccatcatgcctggccaaccattttgaactctgaatacaatatatatcttctttattcctacatgagtatctccattaacaactggtctctcaaaacttttccttaatgcacagaatctgcctgtttgagaatctgtattacattttattgatatatatcctacctcattctatgaaaggtttgggctagcttattagaatgaataaaattaaaaagcagtatataaataaatgaaataccaaggctatgaaaaaattataagccttgacaatgaagttagaaagcaggtatggatatcatgaaggattacctttttacaattgggtcacaatttacctctgagcttcctggtagcaaaagtaaaaaagataacatgatcagatacattattcacgttgtcctacagcaagaaaatacaggttcctgagagctatcatctgaccagaatttcatatgggtaattatataacctcatgtatccaaaataggagaatctaccttcttacctcctttttcaagtaacattaactccaagggcttctagctccttattctccattactaattctttaggcatcatatttgaaagttttcttagtattcttagatatggtgcagggggcttcagacctagttaactattaatactttagctttttggctggtcttggattcaggtctctcagatgagtgttgaattttactgtctgcagttcagggattagccatcatgttggggtctcaatagagctttggggttgactttgaccccaaagtcatgtaaccactacttcttttttgttgttattgtttagcaatgaggtctcgctctgttgcccaggctggagtgcagtgacatgactgtagctcactgtagcctggccctcctgggctcaagcgattctcttgcctcagcctcctgaatagctgggactacaggctcacaccatcatgccaggctactttttgtgttttagaaatggcgtcttactatgtcgcccaggctagatgcagttccttgtgatgtcagtgtacactctgtctcacataccctagccagaacctttttcatgttcttctatttcttaaagacatttctattcatcttgatacacttacagtatggattagttgatttatataattatttgtgtgtgtgtgtgtgtatatatatgtatggctatgtgacttgaatggcagaaaaatacacacagccaactctacatactgtatatagtaatatacaacatgtataatatgtatagtaatatataacatgtataatatatgtcgtaatatatagagttacgtatctatgtctgtctttatccatacatttaaggatataaaaaagagttttatggaaaaaagaatatctcttacaggactaggtaaacaaattataaaaatgtataggtataaaaatgtcacccataatcccagcactttgggaggctgaggggggcggattatgaggtcaagagattgagaccatcctggccaacatggtgaaaccctgtctctactaaaaatacaaaaattagctgggcgtggtggcggaagcctgtagtcccagctactcaggaggcggaggcaggagaatcacttgaacctgggaggcggaggttgcagtgagctgcgattgtgccactgcactccagcctgatgacagagtgagactccatcttaaaaaaattaaaaatgactgtgctgccactggaccatttagtgggagatgagtggtcacatcatacctcaccaattctctcttttctcccttcattttccaccaggtggcttttggtcacctgtcctgtccttgtggcttttgccatgcctttgtgggaagttgatatacagacatttcccaaggagctgccgtgtgccaggcactgcagttggagtggtggggggagtataggagaggaacaagttactatttctgctctcaaggtaatgttgaaacaatttaacaactgcactgtccaattagaattgatgctggctggagcagggtctatggtagccctgggctgtagtgggcattggcctcctagtttctggattatgaagaggtctgggggtgccaaggaatggccagggtagcaggaagggcactcagagctgcaattatttacctactgaaggaagtatttaaatattttaataatgagaactggtatacccatgcagacttgctgaatgttactctttcctgatcttagccacatggccccagggaaaccatgaggaggcattctggcctctgaaagaatacgagtctagaggctgccctccttgccactggccagtgtgctggtcctgctgtctgtcccatgcttggatttattggccgtttttttcttagacactcccaggttttggctgaacagtgctcagtggatgaggcagtaccgagccctcactgtacacttaacagctttctaggagtatggaggctgcatggagatcccctcttagaggggcctgggcagacagaaatcatcagagagatccatacagaacaggcagcagccagcccttgcaggtctgggggcctagccagggtagtagacatcagacccaggttaggccctttagaacttccatggccacaccattttctcaattaaaaatatgggcagggatatttagagtcgaggaagtaggtaaagatctttgtggagatcttgctttcttgattggtttgagaacatcccagcctttgctcctggatttggggccaaatatagtcccaaagagacagatgcttttgttttagggtctgtggtcagctattccccatgttcgctgcccatctcatgttggtgcagctctgtcacccctggtataggctggagctgagggaggagagatcgaattcttagcacagcctagatccaaggattgatccaggggttctggaagtatcctctggtggtttttatggtacaatgttctggctggtttttggctgggcaaggggcagggaggaatggctacaaattagaggctcctgcccaaggctgccagccctacctgggcccgggccctggctcttcccctccattctggtgagtggctcatttgcagggaaaggatgaaggtcactgatttgtgcccacccaggagcagaagggactgggcctcaaggggcggcccttctgtggggcccctggccccctacccatggcccccccatgccagccactggcctggcctgggcagggctgcacgcctgttcggcgctgctgttttcataagctaatgagggcagagtgtgagccacaggcgatgatgttgggatattaactctgacaggaagcttgatcataattatcttaacgaggatagggttaattacagtggaaacttaaaagttctctccgtttgaatccactggagcccaatgcgttgtgatgttttgtcattttgatgtgactttggaaaaggcactgggatgctcccagcagccgctgcagctcctgggggagcccaggcagagccctgggaacgagggaaggaggtaagaggatggtacctgtgtgtgagatcctggctgcgttgctgctggtggagggggaggcaggcagcctgcagggagttccaggggtgctgattaggtttccagaacaatccaggcctggatgatctccctccagctggctgtgcctaggtcctgggtgaaccttgctctctcctatcagcccccagcccatacctcagacatcgcactactccaggaagctggtgagtgatgctggactgacagttggcgtctccaccggggatctggttttggggtgcattttgctgtccatacacaaggtgatagcagacaaattgtcattttatttaacagcacatatttgcaggcacctggcatataggggaatgaactcaaagatctacacacatattttttctcctattcctccctagaaaacagcagtaaaaataacagtaaaaaaaaaataaataaagggtaaagccacctcattctaggtgtatgtgtattgtcgtccacgtgtcagctgggacccccaaaacctatcttccccagtactcccatttactatgctctctgccccctgacttctgtgccccagccctcagctctggatctagatgattaaatccccaggagcacaccacactgataacatgaaaacaaggatttattcattagcaatcacccatgtaatatggttctctttttactgagcagctaataacgtcacatagcaaaaagagtctcaaaaccagacaggtgacaggggatttgagactgatcttaccagctcttctgggaagtctcactctggcgtggatttctgccccatagcccaccctgaggggaagaaaggctggctggatggaggtgggcgcttccttggtgctcctgggctctccccatcttcatgctgtgtcgttttgctttatgcctccctggagcactcttggaaaggagctttcttctgcttgccagttgccaaccatttgctgattctcatcagaagaatctaatatttgcataacgtaactcaggaacaatgtgtatttggatgctgcctttgagcggagtccaactgatgtttgtgcacaaaggaattattaaccacccgtaaggctccctaaggggaagtggcctcacctcccctagtggtaaacgggcccagtcctgagaagccttttggcacatcactccctaacccctagtggaggaagggacttcagaagagcccgaaagtcccctgcacaagcctgacttgctgcacgcctcctctgtgggtttgttcatgggcccgtcccctgcattccaaacacacccccagggtcagggcgtctggaaacaaaacagtgaataaaaggaggaaggaaaagaaaaaaaaaacagcgtatgctagtaaccagttagccgtccttcacttattctcgacaagatcctatgagctggaaggaacacagaacaggagagttcagatgggctattgacaggcccaaattcacacaacaggaaatagaggagcggaggcaaagtcccaaaccttcctgcctagatgtgcgtacattgtgggtttttaaattttttttttgtttgtattttttgtgggtacataagaggtgtagatatttatgggtcacatgacatattttgatacaggcaggcaatgtgtaatcatcacatcaggataaatgggatatccagcccttcaagcatttatcctcacaagttgtgttttgcctctcggaaccaagaggaaaaagagaaaggaggaggaaatgaaacacgatgacctctggacccctactccaaaatgtgtcccccctcggtggggctggcagtgttggttggaggagcaggcgtgctctgggagtcgagtcctgagtgggaccaccccgaggtctggcaggaatggaacatgccggcagagctctgggcccagtggtatctacagatttaattacttacaacacatttttatacctcgtaagtattgactccctattttggagtcctcttggcagcgatcccacaagggagctatggatgccttgggaaagatctggtgctgaagttcacactcacagcagatgtgcagacattgcacacgcaagcacacggggctgtaatggaagcactatcagtaaatgaataaatagtgtggacgacatctccctgatttgtcacattttatagaatagcccggcatcccctacgtgtctccctcccgtccacatcgtagctcagctgtcagccggtgcaggctcagcacatctcctgggtctggcaggtgaacgagctgggagtctgtgtctctgtgtaagcccctctgccggccggcttgctttaattaatgtctgtgtgcgcccaggcaagcacttgtgcacaactacctcgtgtcacctccacccccaacactcatgagagcccataaaattaagagttaactttcagcgatgtgtataagcaaggctatttttccctttctgctgtttttttttttttttcctggagccgggtacttaattctttctgttgcctttttatttactgcctcaacatctacagggttgcactctacacttctttcaaaaattaagtgagaaatccactttccataaattaaaacagtaacttcaggccaggagctttgaagcagcaattctcccaacccccgtctccccacccgcagcaaaaacaaataaaaagaaataataaaagaaaaagccctctcagatcggagtgattatgtaattctgcagatgccttgcctttggggcagccactgggacgctgggcagaagcaaattaagtgattagtaaagaaaaaaggcagaggaaaaaaaaaagtcaaaggatgtgaacggagagaaaggaagccttccctgtcgtttcccccgcgactgtacagagaactgctaagaaatgatacttgaagttatatttattattgtaagagggtatgatatttctgggcaggaatgatggatgacaacttgaatttgtgtccagggaatgaaggtgaactgtgacagagttatttatcttgggaatggaggttagggtcagccgaggctgggtgcctgaaggcacaagacattgacaaatttatcctgcaggccgtatctgaagccctttgttttggatcctggctactcactaagtgaccctcatccttcatgttggcaatgcgtgaaggatgcggtgggtgccagcggccccttctcccccgccgcccccgccccgactcctgctactaattcttgtcattcactttgctgacaggcaccaagcccaaactattcccagtcctgaaagggaaggttaaaatatttatttcggctcataatggcctccctgatttagtgcaggatcatttttcctgttgcctttgtcattgcaggtcactggaaggactgagcgcattcaggagcctggaggaactcatcttggacaacaatcagctgggggacgaccttgtgttgccagggttacccagactgcataccttaaccctcaacaagaaccgaatatcctttcctctgcccgctgcccccactccccacccagccccacagtcgtcccccaaccccaccctgcacaaatacctgcaaaatgtcaaatgagttttacgtgtcagctaaattaaagtatgtgaaatacagttcgtgggcagacaaagcattctgtcttctggcactcgggacacttcagagtaatttattataggtcattcataaatgaaacgcaccattatatcttcctgttgctccattttagtgtagagatctaagttatggctgtgaagaaatctttttaatagataaaaatagagaaagaaaataatgtcaccgctgcagaggcagcgaagcccagtctgtttgcttgggcttgtgtgggagggcgacctctggtgggaagtcccgggtaatgccgccaagcaaacttcctctcctgggaggtttctggaaggctctggggcaggcttggggaaccgttttggtgagggaaaggagctaaggtggcagagacatgtgaagcccaggcctggctatgccctcactgggggataccatgctctggtgatgagaggcctaggggacccacgacagtgtatggcctcctctatggaggcaaggacctagtcagcctagggtgagacttacgggcactaactgctctggattctgtagtggggatggaaacagggaacccttgctgcaacctaaggcccgtagctcctgcattgttagtgtagtggattacccggcactagaatgccagctcgatgggacagggagtttccttggttttgttaactcctctgttcttcacactaagaatagtgcctggcaccaagtacaagctcaataaatatttgagggatgaatgcatcattatcattagctattccttattgagcactcctaggaatgaggcatggtgctgggttctttatgtgtgttgttattcatccttaccaagccctgtgagaagggtgtgtcttttccatttacctagacatagaaagaggtgaggtgtaggcacacagccagacactagcaagatgctaggtcctggatgattcagtgtcaactgtgttgtgtccaaagtccaatgtctgcattctactgtgttgcttcagactcagtggtccaatggctttgttttattggatggaacatttgagacctggagtagttaaaccacttgttcacattcatacaataagttagaaatagaaaaggagacaaggcattttcctctagagtataaaataaaatcagatatacatgtaaggcttggcacatatgcatatgccagcatttaagaatgatttgcagaagtatttgttagctactgtttatacttcaagccataagttaatgttttctttattctctcagatattgtctcagtcagctcttgctgctacagcacagtaccgtacatgaggtggcttaaacaacaaacatttatttctcacagtctggaggctggaggtttgagatcaggatgccagcagggttggtttcttggtgaagatactttctcactgtatcatcacatagcagagagagaggaagcaagctttttcaagtctctccttataggggcactgatcccatcagagagatctacccttatgacctaatcacctcccaaaggcctcatctccacataccatcattttggggattagaatttcaacatatgaatttgagggaagaacaaacattcagaccatagtattataaatatgctccttgtggtcattattgtcactttgatagaagtagaaggggagggcctacatgtaaattcacagtctttgtcataatgaaattttggtggaattttcccttcttatgtctgttagtcaaccaagtttcccaatcactctttgaaaaactttgtagtcttatggctttctaggctgtcttagatgatcagttggccaatattctcaaataaatcaaggacagaaggatttttagacatgtcctgtgtcccaggtctccgtagaatattagggtccatggactttggttcatgtctcagcttaatcatatttagcggtgtgaccttggacaagttatcttctgtgagcttctttttctcatttttaaagaaatatgttggactggtcgatggttttattcacagtattgctgtcaccagagataagcaggcctcttggcttcagagtgctgagaggttttctttgtctttggttgagtcctttccctattctgtgcctccacttttccaatctgtagcagtaatgctaagggagtaatggtaatggcctaggagggaccgaagcagaagacactgtgtggctgtaaacctgaccagtgatatcactggtgctgttgtagcacattttcttatcagtgaatattctgaatagacttctttccttttttctcctctgctctactaatgtgattgtgaagatcatcttccccatctacttgactcagaagtcacagagaaaggtaggtaaaatcaggcaataacagcacatgctatcttctcaacccagcacttctgatgccactttttcagctaaatgactctcctacctaactgtgagaatgttgcaggctttccaacaatttctaggttccatattgttattgccaccccatgaaatgctttagatatggcctctatacattagcttttgctgcataataatccaccccaacatttagtggcttaaaacaacaaatatttacaattctatagatcagatgtttggccagggctcagcaggatggttcttctgctagtcttattctgggtcagtcatgcagccacatctacctggaggctcaactggggctggatggtctaagatgacctcactcatatgtctggaggttggtactgggtgttggctaaactacctgtctcttaacaggctagcataagacacttcacatgggaggagtattctaacagcacaagccccatagtacaagtagtcttcaagttcaacttatatcatgtgttaatgtcccatgaccaaagcaagtcacataccaactgtagaacaaatatgggaagggactgcacagggtgtatgtataaagaagcataattcatttctgtaacaatctacccaggagaccttggcattggcatcttgtctccttcagattttactttatatttgtgataaagggagccctagaaacaagtaactattggcctcctaaaaaagtattagctcttttgtgtaaattgaatctttaaacaagttaggaagcttgctgccaaatgaggttttatcttgaatccttttgtgaagttagctttattttaaatttttttggtttgtattttggcatatgtaaaatggttattcaccccacctaccatgtaaaatctagatttttccactttggtttgactcaaagttaaatgtgtctataataatgctgtaggttcctagaccctggacacttgggtcattggcttctttaatcctttagcaagagggattatcacatagtggttaagaacaacaggctctgaaggcagacttcctgagcttctaccctaaacctgccacttttctgcatgaccttgggcaagtgatttaacatctctatgttttggtttcctttgaaaatgcagacaatgctagtacccatcccataggttgttttgaagattattctaagtatctcagacatattagattctagtaacatagtaagtgctatgtaagggttactattattgttgttgttattatcctagagaattgtgtaaactcatctggtttgacttgggccacattgtaaccaaggccagagtacagatatacttctgagtttagaatggttctttgacttgcataatttaatattgccctaatggcattccgtgagttgggtactgttggtgaataattactctcatttttatggaaaaactaggagtggatgagctctctgaagtcacatagattgtcagtagtggggcttagtctagaacccaggtatgctgattcccagctccagactctgaaacccaaaggagcggcaatcattgtacaaggagaggagccaagatacaggaggagtcagcatcctgagcctgcctctgcaaggtcctgctcccagctggggctgctgggagtctgctcttaaaagggattccagagcccagaaccagcatctggaaaatttcttctgtgttcatcagtcaatgcctccctgccatctgcatacctcctgctggacctcccatctttttccaccagccctttttctcattgtgttcagccctcgtgttgatatcctgctctggtatatctgaaagcctggttgtctgagattacctcatctcttggttcgtagggatctcattttctttctttgtttcattgagactggccaggtagtcactggctatggacttgaaccccttccccactgctcacactctttctctctctctctctctcacacccaaccacgagcatgcacacgccatccccaactcttccaccaggaggggtgggatatttggtaatggtctcagccatatcatgtctgaataatcaaccccaagtaaggttgaccacctgaaaattcaggaaagtgtagataacctttgcgcaatcaaatgattctcccccactttccttttggggtgtgtggggggcacataagcagattttatttggaatcacacttcatcttctgtctccctatttgcttcagcacatgtactgaatagccaatgagtttggattatagtgccagcacgaagaaagaatggtgctacatgttacacagctgggctgtggcacggagaccactccagcgagtcagaggtgggactggagttcccatagccatttgctgtgtcatcttaggaacgatttgctgtgtcatcttaggaaagtctctgtaccttgtcaggggcctcagtttctttataaaatggttaacacaaacttcagcatattgttgagaggtttaaatggtataatatgtaggaaatcactttgttaaagactttacaatttcttggcatattttactgttagccaatgcctcgatgcgtcaaaagaagtagcccaaattggaaggaaggatctgaggtacagcacatagcccggtgatggcacctgtgctgtcacacagaaacatgtaagaaccctcatgttccagtgttttaaattttgcttttgtgttaggaaattataagtcactttttcctctagaaatgcagtttctttaagatctgggtttaaatccagactctatcatgtactagctgtgtgaccgttaacccgtttccttaattgttatttcagcatgataaatttctgacatatgtgaataaaaatgaggtatgtcattatgctgtatatttagtattcaaaaacccagtattaggattagctgtggttaaaatcatcccagtggttatggaggttgccctttaacccgcagctgagcccagagggagggatgtgtccattctcacctgggacagctttggacccgcacaactggacacaggctaggaggcttccctcctccctcatgctccaaactttcaaggcaagatgctgctttgatcttgggccctctgcagaaaatctcctttggcaagcctccccatgacagctgggctctgcaatggcaactttctgcagacaacactgaaaaaaaatctcaacgctaagtaccccggagaagacttgataagggaaaccaggtgtgtgccgggaacccagctggagagagttgaaactgtgccaggtagctacacatttttaaaaaaggtacccttaggagaatccctgaaatgatccccactgcagtggtcttgattagccagggacaccaggtttcttccacagattgcctgtggtcaattttctatgcatcttgacaaaaaagaaatgtgagaagttctatgttggatctcaaaaccagccaacataaggctgtgtttgtccttgctgacccaggagacaaagaaaccaattaaaacttctcatgttttatcctctggtggtgctatcagcataaaggcgaaggactggtctagagcatgcatgcagggaggaggtgctagtgcttcctgcctggtgtggatttgggggagaccacctgactcagccaaaagtatcatttatagtaggtagttgaaaggcttaggaagatggagcttctgccatacaaaatacccaaaagcaggcaggctcttagaaatctctttgattcattggcaaaggatggctgaagcttcttggaacctgcagaccccttgcccaggaaagtcccatgatcagagcattcaaatgatccacttctttgtggccagggacagatccaggtttggggagtgtgaaacctctgtaatttgagggagccctcttaaatactatataatcaggaatgcaaaattaggtatgaaatgaatgtttatttggaatagaactgtatcaaaggaaattttaaaattttaagttgataaatttcacaaatgtcaaaatacctagaaaagtatcaatctttattgaagatatgcctctagagaaacttttttcctgcaaatttctcatagtttcattatttggtgaaattttgtaatttttttctagagagaatagataattccctcttttagcatggttgatcgaaaattgattttttaaaatagtttagaaatgtttctttcagtttcaccatttgttattggtagtttcaccactaaattattggtaaaacttttaggattattacattttggagaaactcttacacatttctttcatatatgataggagctgtataagatttcaggacattttggccgggcacagtggctcacacctgtaatcccagaactttgggaggccgaggcaggtggatctcctgagattaggagttcgagacgaacccaggaggcagaggttgcagtgagccgagatcacgccattgcactccagcctgggcgacagagtgagactctgtctcaaaaaaaaagatttcaggacattttaagttgtgtgtgtgttgatgtgtaggcatgtatacatacacttaacaactgaatcttaaatgttctttgaattgatgaatgagtttgttaatcattttgccatcagttttatgttggtccctgcatatttgtgttaatatggtggatagtaagagtattactggaagccattcctactgatactgttggaagaatttaactagacacagaagtgactgcaaattatacaaatattcccccactgaatcataattaaatgttactcctacacaatgtacccttaggtggggattcccatagacattcccattgttactcagctgaagggaaaatgtggtagaagtcctagtggagcgagacagtgatctccacagattatagtgtaaattacctactttttcaaattaaaaaaaaaaaaaatcacatgatcatgtgactctattaccagggtctttcccagggccttggaaggggcctatgcaaacaagaaacccttgacgcatgagctttattagctccatggtagatctacaagtgaaggttcactcaacttaatctaggcctacttccccgaacatggtggccagctaggcttccttcactcgtcattaaatgttgagaaatgactggcatttcaatccaactcagtttcccaatatttcctcaacttaaaagccttgccagtttggggttccattcctgcatatccccaccttcatacagcagacagaaaaaagagccaagctttgaggaatgtttcctaagaggaaagtaggttttggtccgggctttccatctgcagtagagagggcttccctcagtcgtgtagggcccttgtctacgtaaataattagaatcactccaagtcagtatgtcagcaccattctggtagcccactttcttgcagtcccacaaaagaaatactgtgctggccagaagcagtagtcagcttgtctggctgtccttcctggaacaagggcctggccttgaggttttaagacagcctgatccagacatgagttctagtgctccttggagcatctgatgggtcgcatgggtgggctagaaagttggagcaaaccatgaaggggagaaaccaagcctgggactgaggcccgtgcaggtccgggtctaggtccaggcctggggtactctacctgaatgacaccatccagtcctgggtattggaaggggacttaggacattctgaggaaggtacttgaaagcacagggcacctgaggtgtctgtgcccatatctaagggcaatactagcaatgagacttttttctttgtttttttttttttttttcttttgttgttgtagtaatgactgtgaagtatttaaagatagaaactgctagaaaagctgaacttaccctggaattgttcactgtcattttaattggctctatttaaataattttcctgaagagtatgatgattgaactttagtaagtgtattttgtctccagggattttgattcctggccacccacccctctgtactcccaacctcatccccctggtgtgggaccttctctccagtctctatatgaactcccattctcacctcctcattctagtgttcctgtatggccatctctggatgttatttgtgaaagatttgagagattgaaaacaaacttccatgtctatttctctgtctttgtttgggaagcagggaggatgttggtgaattgaagccaacagcaaatgagtgtgctcacaactttcttttgctagtttcccctcttgctagtttccctctcttgctagtttcccctctcttgttagtttccccctcttgcttgtttccccttctcttgctactttcccctcccttgctagtttttcccctctcttgctagtttccccctctcttgctagtttaccttctcttgctagtttttcccctcctttgttagtttccccctctcttgctagtttacctattcttgctagtttttcccctcccttgctagtttccccctctcttgctactttaccctgtcttgctagtttcgccctctggttagtttccctctcttgctagtttcgccctctggttagtttccctctcttgctagtttccccctctggttagtttccctctcttgctagtttccccctctctggttagtttccctctcttgccagtttccccctctcttgctagtttccccctcttgttagtttcctcctcttgctagtttctccctctggttagtttccttctcttgctagtttccccctctcttgttagtttcccctctcttggtagtttccccctctggttagtttcctcctcttgctagtttccccctcttttgctagtttccctctcttgctagtttcacctcttctgcttgtactctgcttctcattgtctctggctgctctcacctagggtatagcatttggccttgcatatgatggtggcagagcatgtgtacaaagaatgcttgaaggaacttagtttggagaataaaagatttaaggaagacatgtgagcttcaaatatctgaagcttcatcatgtggaagagaagaagccttattctttgtgaccccaagcagttaaattgggtcactgagtagaggttagagaaagattcaattccaggggaaaggaaaactgttatggttgtcagaaatggaatgtgctatgtcgtggtgattgcttggcaaatattttagggacccaattccgacattggttggattttgaattcattcttttgtgacaagttgaaatgaagtatgaggaaatctgtgtaacagcccaaggttagataacatcctcacagagcaagaacatcccttttctttgattttaccttctcctaggttcaagtggaccccacttctgggaactgtaatctgagtctttcacgcttgcatatggcatttcttctacccttgtatgttttgttcctgtagctctgctgccattccctggctgggacccccttttatctgccaacttggttaaccctctctcatatgtctctcgaagtcacggcctaaccaggcatgcctatctaaccatcaccttacctaggctcagcttgtctgtatgtggcttaagccaggagttagtatggggactaagttgtcattaaaccctttccagtacctgtgattctgtgaatctatggctcttgctttatttggtttggccatgattggacagtgggtcccactggaagatggctcctggaataatctcccccatcatgcccccctctgacttttctctttcattctctaattccctcactaacagagaaagaatatattttaatgaggccttctgaaataatttctggttttctttttctggtttttttgttttgtttttttcttttgagacagagtctcgctctgtcacctgggggcatgatctctactcactgcaacctccacctcccaggttcaagcgattctcctgcctcagcttcccaagtagctgggattacaggctcctgccatcatgcccagctaatttttgtatttttagtagagacgggtttcaccatgttggccaggctggtctcaaactcctgacctcaaatgatctgcctaccagggcctcccaacgtactggaattacaggtgtgggccaccatgcccagcccttgttttcattactagaaacgaattaagttttatggttttgcatattgtaaaaatattttactctatggaatcttcccttttggtgtgttttagaaacagaactatagaggaaagaaaaatatgatgggacaatcaagtttattcattcttcctcagatgatctggacttagtcttacctgcctagcgaaagttgggctgtgttcccaacagtgggagtgaaaaagtagcaataccgtatacccacagctgaattgatttcagcccccaccctgaggtctcacaggagcagactggactcatcagcgcctgtcagtcatggcctatgctcattgctaagccttttgtcttactggaccaagattcttaacctttgtcacatcactgatttggagaacctgctggatcacttggcagaagtgacaccagctctggagtacctcagtctgctgggcaacgtggcctgtcccaacgagctggtcagcttggaaaaggatgaggaagactacaagagatacaggtgagtgtccaggggttggaccatggtgggaaaagggaaaaagagaaactttaggggatgatattatactctggggtgcatagtagatgtttggtacatatcagtgggtttcccatgacaatgttaaacttttaccttttggtaacctatagccattgtctctcttggttgaggtcacaaaagctaagaaagatgaaaagttattgccttttctactttttttgtgaagtgccagatattaagtattttaggttttccaagttacatggacttgtcacaactactcagccctgctttcataatgcagaagtagtcatacataatttgtgaacaaatgggcatggctttgttccagtaaagctttatttacaaaacagatggcaggccagatttcacccatgggctgtaacttgctgacccctgctctgtgttgtaagatctttctgtggtctgtctcagagtcatcttgaagagagagatgacttcccaccaaaatttagggagctcatagacaatctcaagaggaagtcccacaggcccatacctctccaccatagagctatgccgtggcgcccaccagccatgcgctttgatgggctccaagtagaaatgcttttcgttcttctctctacttctcaaccatgtgctttaaaagccctgatccaaagtcatttagagagtctttttggtcttacccattttaccaaagtcacctaattttccttcttcatttaaaattgtctgtgttctcattgttgattgttgttttgtaaatgctttaatgaccttttcatggacctctctctccattatgacataagctctcattaaacaccccacctgaatcactcttaaaaataacttaataaattttgtatatgtatatatgcatatatacatatatgtctgtgtctatatgtatatgtatgtgtacacacacattcatgcacttgttcatttattcattcattcatggggccaagaagctatgtgtgaagccaaccatgtaggcaagtttttgtaatttttttctagaatgagagaggtagggagggattggtctcaagtacagggcttatgaggttgcaaaaggaaaagaagagctaagaaaaatttttttctattctttttttggtgtatcatcagctctcaaataattactatttgttttttctattgtaactggtcgcattagcaaaagtactaagaccaaggtatgtggggtcagatcagaagatctgatgtggagtccggctttcccagtggggcttttaaaataggaggacagtctatatcagtattccataatcaaggatctacctctgagtcatccaaggtattctgatgcagttggtggcaattacaacacaacagtccataggtgtttctgatgtccagttggctttagaattcggagacactcagctcccaacaagttcaatttcttcctttactgtctcacaccattttatagatcctatcttgtgtattttttctcacttcttcatgtatttccacatctagagaatggcttccagtgggtaggagctgagttgtcttgactcttgaagcctcatcaatgcctaaagtagtgctggatatgaaaaaagggcttggcacctttttttttctggaggtggcttgaaaccacctttccttctcaggaactaggaacttatagggagatgcagggatctttggccatctcagatgcccactgcccatttggaatcagatccatttggatgtcaacaaatgcagctaataagcaaaggactatgattcagactcaatccaagtgctggttgtgggtcatgaatctttagggagggctggattctacaagtgtggtctatctcatgggctagcctgggcaccctccaagcccatcctccccactccagttctgttcccttggaaggagttgaggggtggggctagggaggtggtttgtgagtacacatatgacaaagttgccatgagaggctagattctagaggtcatacaaaaccaaaatcataactagtcaaaattaacttagaaaatttacatcatccacaatgatggcaagatgcttgcactctgagagaatcagggactaggaacagcacaaggaacagtaaatatgttcccatgtagttacacattcactgcacagcaactggttgaagagtggaatggtaggctgattctctagcacatttaaattttttattcatttaatctctttattttttactgttggtttgatgagtgctcacacttgtatatggaaaagatagatatgtgcttgatatagttccattctatggtctgtaagcagatccgctttgtccttcctcgagtttgtgctccatttgccactgagaaattttagggttttgcaatatgacttttgattctggagttcctgtggcatttgtgtttatacaaaacaatgcagctgccttttttttcttttggtaaaacattttcctggcccttcatccacaaaacacgaggtttgccttccttctagctgtttcccagagcctaatagtagagcctctatgtaaatttatgtgacgttttcactagaaaattgcttaaaaatgaatgctatttctagagtttactgtttttcactttaagtacattttctgacaatatgtcttctattaatcatttaagcaatactaggagccttaaaggagtgtattcagaagcaagaacccatggttcatttagtgctgtctgaaaaaaattcttattgattggcatcctctgtggttatgtgatgtaatatttataatatgtcacccaggcatacatcaaaacaagtgtgtctgttgtttcatttccatgggagatgttgatttcaaagaggtcagcccagtttttaggtcacattgtggccaaccactggaccagaaatgggaagtgactcgatttatgtagttattggaaatggcatcacagagcttgagtttctgtggagtctttcctcccctcctcccaaattcacccttttcacttcctcacttaccccctgtgcacccagttggattttcttggcacacatccccaccataaaacaggctcattaaatttatatgtgagcatgaacatacaaccaagttgttgagtagcaccctggccccactggggcaggagcagaactgtgcctggggtttctctttgccattcatcatagttcatggctgagaaatgtccatggccctgttattataggagcttaaacctgtctgtgattttcagtgtgtacacaccatgctgctattttgggatgaatgtggaatggaggtgaatgtgataatcagcagcctccaggatttgggcaggaagagaacagcagtgcaagacttggccggagagaccaccatgctactgagaaaccactttagtgccccttgtggatttcaacgctagccaaaataacaaatcaatatgggaaagttgggtgcccagaatggtctatttcttgtcttcccttgccattgctttttttgtttttgctacagaaagaacaatggacttgaaggttaacagtagacaagtctggacttcacctttcaaataagggagttggtctcatggtcttttagctcttcctctgtcactgaaccctctgtcgttcatcccctcctgccactccagtctctggttggccttgctttactccctcctccctgtagggccttctgtattccttacaactttcaattatttaaaacgtgacaccctttctttgttcccctgcatggagcagccctggggcctgcccagtgtctgcagcactcagccaaagggaaggagggagggaccctccgccgtctggtcgctctgggctgccaccatttcccagacgaataggagctgtaaaacttgtggcttacataacccagtgagcattctccagctaatctacaatctgggctttgaagatcacaagaaagcaaaggtcacgacccagagatcaaagtgacagaagcccacagagtaattgccggttactctctgtagagggccttggtctgtcctgtgggtgtattgtttgcacagagacttcaaacatgctgccggtgaactgtgaggaaaatcagctggcctctgccagttgtcaggcattcatgaatgctgtaggtgagctcacctcggctcattagagtgagattgttgtcatctctctgagcatctgcagttattccactcacactgtttgttcattactctgtggtctttattgactttctcacagtcgtcatttacttggaggtgttgggggtggttatataaggaaattggaataacaagaaaggacgacatggacatttttattgtaagtcaactttgagccacgtagagttcaagcaaggtaacatttgaaagaggcttagacatcatttggcccatccccttcacagcatagatagaaaaactgaggctcagaaaggcagcagagactgaaccaagatcacagggcaagatacactcaagagtctggcctctttcactatgctattagtccccaagctttttgttacaaaaacttgccctccttttatttttctccccaacactttaaaaactttgatctctcaaataggctgcactgaagccattgctaagtttattattattatgaaacatatacgttcagcagttgatcacggcttctgttcagcatgaggtaaccagtgctattaaatggagttaatgtaatctagtcaacagtgaggaagcatgatgttttgttgacggactcatctatcccatcaagctttgtgaaagattgagaatggctcacagatcacccactgctgccttcaggggtctcaggtagcgcatcagtagcttgtaccatgtctcactgcctccaaagaatagaagcaagaaggcagcaagaaataatgcaaagaagcatagactgccgtaaacggaagaaaattttaaaaacgaaacaaaactctaatgaccccatgcccagttccctcaagaattggaaacttggtacttcttgaatagagtgtcagagaaaaaaacatgtcagccaaccccattcgcagaccgtggaggcccatctgagcttttctgtggttgtaaggtgttcctggggagcagccattgccctggggggagcagccattgccctggggataacagttacaggcagggggaaagaacatcctcctctctctctcaggtctggatgaaaaatgcctgagtgttgggactagagcagagaaaattgattttggaaagaaagaaaaaaaaggtatttctcctgttccttttctcctcctagcggttttagctctctccttagaggagtcctttaagcaaatggaacattctatgtgagaagaaagaggacctgaaaagctcaatgtgctggtctctcagatttaggaaatctgtttccagacagagacaaatgggtctttaagcaccttcccaggatccctgctctcctcttgataaccccaccttctgtatctcagccaagagcacctctgactctcacccccacccctcaccacccccagccttgggggctttcccctagccaccttgagaaggtcaggaaaattggagttgccctctggagctagggacgtgagacttagaacttagaccgatctcttttcattaagcagtgccctggcttaacaagcagttttataaatctgaagctgtctccgggtgtcgcaggatttatagacgggggtttctgccataaagtggtttatgatggctgccttctgtgttattagtagctgtctcttccttcaaccattgctgtttgataatagccttaaaacacccagaattacttacctgcaaaccctattcccgatagcccctgttgacagtctgaataagtttagtgcccttttgttgtactttaccttcaaaacaaactgattgaaccatcaatagctcgtggaagctgacagagggatgtcatctggactagcccttgtgattgcaggttatctgggggagttaaccttcccgcattgttaactgaaatgttttatgtactatgcaactttaggatacggctgtgataaccccagtaactaagtaatacatcacagtaaagagattttggtgcaacaaataacccaggattaaatttacaagggttgaattgatattgtaaaagccttcattctgtggctttgggaatcctctcttgtatttttatggcaaacttgtattacactcaggattgaagctgtgccttttgacaccctgacatgacctagaacaaagggaaatagatctcccaggaccatgaaaggacaggcaagcaggaagcccactgacttatcacttggcaataatgtttggagcgagttccaagccaccaaggggcaagaagatctggcagacatggccactggctgggttctgtgcactgcaggcattggggcagggcagcccttagcagaactggaaggagaccctttgctgcctcaccaccctcctaatttcaaagctattattcctcatggtgttattttcacgaggacattggttctcagcaggactagcagcatcagcatcacctggggacatattagaaatgtaaatttcaggcccagttccagaaatactgaatcagaaactctggggatggggccctgccatctgtgtgttgggaagtctccaggaaatactgatgcccactgaagtttgagaaccactgtgcaagaatagaagctcactgaaagagcacagatcttctgcattgcttttatctcctcatgttggtacttgactcaggtcctgacacacagtagctgttccataattattgttgaacgagtgaatgtatgagtaagtaaatgaaagaagacatctctatggaggaactttggaccctgggctgaatctcagatggaactatttggggcaagtcctcctagtgtccctcacacctctccaagcagcaaccacttggaaacccaggctggcccacgggatgggtgaaaatcatccctcatttcagggggtgactggcagcctgtgtcatgggctgtctcttcgattgtataagaagagtgatctgaaaacagcagctctttgtcatctaaaatttttaactagcttaaaagccagcacctctgtctctctctttctcctttgatttcagggctgtgatccaaagtgaggcaaaatgacaatgtgcggtctgttgtcatcatggttcctgccagccccgtgaaggcatccttcactccatcgttaaacattggctgattttctaatactgatgttttcttcacctgaatattcatcttttcccaccctacacttagtgggtgtctttactccctgcacgtcactcctgacatattgtttctgtctgtacatgtctttatttgaaagagtctgttgtcataaagacttttctgctacaagcagaagacggaagttttctctgacattgactgaggccggtgggagctctactggaggatagaaaagatatttggtggtggttcatgcctgtaattccagcagatggatcacttgaggtcaggagtttgagtccagcctggccaacatggtgaaacgctgtctctactaaaaatacaaaaataagccaggagtagtggcacacacatgtagtcccagctacttgggaggctgagacaggggaattgcttgaacctgggaggcagaggttgcagtgagcagagatcatgccactgctctccaacctgggcaacagagcaagactccatctcaaaaaaaaaaaaaaaaaaaaaaaaaaaaaaagaaaaagaaaagaaagaaacaaagaaaggaaagatatttgggtgttttgtggcactttcttgattttgggtgaggttagcaggtatttggagggaaggcagaacccagggtaggaaaaggacaatagactgaggccagggaggaaacaggaagtagccagagtcaaatttccaggacaccaggcatggggtggacatttctgaaggaagaaaagaatttcataatattttgactttaacaatgagtcctgtgaaggttattcctgcagacctctaaactattctctctggctttgggatggtcagccaagccttttacctggataagcatatgcaggccacttggtgataatgtcaccgaatccttgggttgttacttcctcagttgggaacctctgtgactggtggttcctttgcctgagttttgcttgggcctgctgagcttgttccacctactcggcctggtgggctgcacttggctcgtgctgccagttcagatcccatgcctgccaagggtgagccaggtgtggagtggtaaggggtacatgagcaagcaagcacagggtctggccactgcatacagccaggcatgctggaagcagcaggctgggcagctctagacactggcatgggcactagctccctgtgaggctgcatctggaccaggcataccacaaccagcttccactgcaggcactggggaacgtggtggcacctggaagcttgaagatgccaggaaccacagagccccaaagagggtgtcacagcctttgcttggggagctgttaggtctgggctccccaaagggccacagctcttctctctgtctcatcacccaccatgtggcgagtggggggacatgtttcagccctgtttgtgttacagctctttcagtcctgccatttggtgggtcccaagttgttgtcccagatccaggaagaatgaagcatgcacacaattggagggtgagcaaggcaaagaggtgctttattaagcaacagtacagctctcaggacaactaaagtgggtagctcctttctgcaggcaggtcatctcagtttctgtgcagccctcagcagagaggagacccagagtgggtagctcctctccacaggcaggttgttccatcaactgcccaagtctggctgagtctggggcttttatgggcatcagaggaaaggaagtgcatgctgattggtccatgggtggccacagcagggtccagaaaaagtaccatatgttctcactctgatttacgaaactggtagcccagcccctatgctttaggccacctctggcctgatggtggggtttcaccggggacacacccctttccacctaggagcctgtctgcctcctgctgccagccatcaacctgctgtctatagtgcccatggtgcccaggctgtttgtgccaagggatgcctgcaggcccatgctgagctgtcctctgctgtcccttggcctccctgctgtgctcatcagcacccaaagtccagaaggggctgaggtggcagggggctggtgtttcagtactgctccgagcatgtacacactcagccagattgtgacagtgcctgggcttggccgccactttgctccaaaattggagtgggcattgggagtcgggagaggccaggcagtgggagcaggcactcccaagccttccagtggaggggggcttcccaagcccccaagagcacagggatgcctgggtctgcagctgcagctgggcagctgcagttgcacctgggagcaggggctcctgccccaccaactcaggagggcatggggctcccacctgttcctggctcctgccagctccatagagcaagcagcccctactgcagctggtgtatttgcagcaattgctccagatgggctgctactgccaccaataatgagaccaccttacgaatgtggaaggtggccttgggaacccaaggctccagtgaaggcaagccacactgttccaagtaacatcctcactgaggaatagctaggttcttggggttgccttaaggtgtggttccttgatgcccatttgagatttcctgtttctccttttccattgagttttcagtcagtagacctcttgctctgtgctcccataaccactctatgcataacctcgattttggcacttagctatgcttattcctaatttctccatgtgagtgtataatttctgttacactgagaacacctttgagagcaggaagcatgttgtaatcacatctgtatccctaaggcctggcacatagtaggtgatcaagaaatatctgtgcaactgaaatcaactggtatgttattgactccattctaatgccagttttcaagatgtggtgagagtgagcaaataaatttgtccctgccttcaagaagcttacagtttgggtaaggacattaatgaacaccaagaaaataattagaaaacaacaaaatgttagactgtaaggtgctgatggcatattctaggagtcctgggaagggagaaagcaatgaagggtggaggtgtacaaaaaaaccttcacaggagatgaggcttgaaagatgagtatatgctgaggaggctgggtataggaaggaaatgacagattcccttggagataatccattgctcttgacactgtgtacttacctcttgataagcagaatagggtggaaacaactcgcttgtttgattgttggactatggaacttgatggaaagcatcttggttagtgattgtccctgacgagggagaagtatagacacatgtccatacctgttatacatttatttatgcatttatataactataccctggccaagtggttattcttgtcaactccatatatacctatttgaggacagttaattacactagcagccattggcttatttctggagtccatctgccaaggaattcttccagggaaatggagagcacctagcatttgttgggccattaatatctcctagaaattaactcccccttttctccttgataatcttcataggttagcaagtgtggaaataaccacatgtattatcgagggatgatgcgaacaaagttcttaagacccctgcctgattcctcaaggaagcatttctcagctacatgtgttcctcacttgtaacccacagtcatccaggtcattatagtctatgatacagatgacccataggaatggcagtgacgtaaagggtacaatcaatttataggtttattttactgagaatttctgtgtagcaaagaagctgagcctgttttctagactggaaggaagggcatgcgttgatagggtgccactggctaacccacgtgtgtgtgtgtgtgtttacctttgagccaagtgtaccattagtgtgtgcttctaatgtttagttgtgcatgtgtgtaagatagaatcattctgacttctccaaggaacagttgtttattctttgtgaaagaagagaggaggcgcagccaaggtctaagttccagaagaccggatggtgtggattcttgaagatcagacaagctgtcgggatctctgaggctgccactcaaacttcctgagttgtctctgactcttatcttccagatgctttgttctgtacaagctgcccaacttgaaatttctggatgcccagaaagtaaccagacaagaacgagaggaggcgttggtcagaggagtcttcatgaaggtggtgaagcccaaggtgagctgcctacttgctgttcttcacaagggatttacatctcatggcagtgcttacaccccagggcatgcagaatgtcctctgagtgtttagaatgcagttggaatctcacatgaagggtccttccatggatacattgttggccaaacatgaaatagggttaggtgtaaattggatcttcctgttttaccaataaagcagcactatgcatagcccaatggtgaagttctgtgggggactgcaggtctccttcttggaaatattcactaagtggggcctctgcaggtttgcagctgagaaaggagaaagaggaaagcattgggcatgggtgggctttggggtaggggggattcttctagtacttcagagggggactttcttgtttgccaccaaagggaagctagggaagagtgattttcttccatcacaggcaagggctccacggccctctgagatatcgttagtgtggaaggtgatgttttctgacagtgtgtccctaggctggcatgtgccccccacatgtatctctccagagctgattagagtggtgtttactgacctttcctttaccagctgagtctgtaagtgaatttggtgtcatgctaatggcagctctgatgaggcagtggagaattggcttggggtcttggattcagacacaaggagattttttaaggacatggatgactatctctttgggaggagttgggagtccttcagtgaagccagaggctggggaatggactcggtgacccctgatgatctccttggagaaccatcattgccttgaggctctgtggagctgtgtggtcacctcccatgagattgcaacttgtgtgttgaaaatgctggcactgatatcctagaagtctagtttatcctcagctattgacttatagcactctgcatgtgcattggaaatgattaaaggggggaaagaaaaaacaaaaacaaaacagaacaatgaaacatcttccatcaagttgctctgctggcagcagacctcaggccactttctttccctgaatccatgaggtgcaacttattttccattatgctgaataaaattgctagcagttgtggaaatatgtgatatggagggtatattactggcagataaatgtattgttacctctttcagcatgtgggaaattaattgagtgattcatttcatagctattaaagtgttaacagtgctccctatcgaggcacaggtttgatgtattgcacacaactgcctttagttattctagcttttgtaatttttccaaatgaaataatttatttcttggccttctttttatttgtttttggtgaaaacagtccagagatagccagcatgaccaaacccagcaaaagtacaacaaatgcactctataatatcctgggttattataaataacctgcccaccctacatatctcaccttcttgtatacatctgtattcacgtgtatacctgtgtgcagagtggatcagtatttctcctgcgctcattgactttgatgtgggcagctctacattgtcacacaaaatctgaaggggtaataaatgtagtacccaccatatctggatggggcactcagtgcatgcccaccccccattcttctaaggttcttggtgcacagatctacaagtgttcacatcatcctctaaagtagaaggaaggggtcactggctcgctttatgggtgagggaactgagggctggagaagttaactgggctgccccaggtcacctggctagtaattgtggagctggaggtttaccttgtgtctgaccactgggcccacactcttctctctctgctttctcacccctggagcagtgagctacatatttaccctgtggatctctttgttcaaacaaaacctcctaaggtctaaatgaggaaaacaggtaagagcaggactgttctgttgagtagaggtgggaggaatcgaaatccttccttgcttttgaaagtatctgagactggctccttaaaatccagcattagttgtttctgagtcattagcaacatcagcagaaatgccctttagggttcccaattagtttctaatcaattctagaattagttcatgtttgtatgattgactccaatatccttactaactgtattaagctttaaaaagcctgttaaggtgtaaattagttcaaccattgtggaaagcagtatggcaattcctcagagagctaaaaacagaactaccatttgacctagcaatcctattactgggtatatactgaaaggaatataaatcattctatcataaagacacatacatgtggatattcccagcaacactattcacaatagcaaagacatggaatcagcctaaatgcccatcagtgacagatcagataaagaaaatgtgatacgtatacactatggaatactatgcagccatacaaaagaacgagatcatatcttttgtgggaacatggatggagctggaggccattattcttagcaaactaatgcaggaacagaaaaacaaatacatattcttacttacaggtagaagctaaatgatgagaactcatgaacacaaagaagggaacaacagacataggggcctacttgaggctgaagattgggaggagagagaggagcagaaaaaataactattaggtactaggcttggtacctgggtatgaaataatctctacaacaaacccccgtgacacaagtttacctatgtaaccaacctgcatatttacccccaaacctaaaacaaaagtttaaaaaaatacctgttaattatttgaggagagagactaaagtactcttacaaagtatggtgatcttggttctctttctgtagtcacatgatttccagaccaaagaggacttagaaatcacctagtctgtgctcccgtttcatggatgagggagctgggagagggtgtagtttcctgaggctccatggaattgggaccagaacccctgggggtctgggcttccagttaagtgttcaatttatgccatgattcttcaagtgcccaggacgattcttctgtgttcttggtttcatatcgaactggatgcctacattgaatggcaggcagttcccttttgtctgttattttcagagataggcagtggtacttttcttgtagaaagaaagacgccaaatgagctccttgctgaattaataaattggcattaaaaaggctggttctcacctgttcacggtgtgtacagacatatgtttgttcccatgcaggtgtgtatacccgcttccgtctctgtgtatatatacatatgcatgttctgggaggtatgtgtacaccagagtcagcttctaagtggcaagcaatttcctttccatgtgttgctgctgctgtgctgagcacactcagggaagacctatttttcacgatggaatcggaatctcaagctggctcctgtcctttccagggcagccaaggcctgttgtgcttattcagcagaatgctctgatggatgattaaggtggccgtgatttggggagctattttcattttattcctgacataaagaatttgggagaatggaaaatgtccctccaatcacagctcttgccttggaggtagggaaacgggcagtctgggtgttctcggctgacacaaatgcagaaccatccaggaggtaataaaggcccgatgtcgcagaggtctgattgggtacctggcaggcgctggcgcttgagtgcaagtcctcactccctttctcccatgatgacacatttctcctccgtggctgccttttagcttttgttgtttcaaagctggcttctgtctgagctctgattgttgtagagaaagatgctgtcattcattaggaagtgatagctgaatgctacaatggatgcttccagactttatctctctgtgtgtgtgtgtgtgtgtgtgtgtgtgtgtgtgtgtgtgttattagttgatggacctgcaacagctaggctttgtcatttccaaaattcaaatatataaaatatatataactttatcaaatattggccattgaatcatgccattgttaatacagagaacaccacactggatacagagaaggttcaagcccccaaagaaagagcccgctagtaaccaaactgtgaagcccctcactgcactgggaaacatagatcaaaggggtgcagaggcctgtccaggatgacgtgtgtggtcggcatgtcagccctgcacagcagagagacagctcaaaaatccgacagtcagaattgtttaattatgtcctgactttgtaattattcatccctgttctggcaaagagcacagttgtcatttctttgacataattatttaaagctgagccctcttgtttacaggcatgtatacaaagttggctaccaactgtttaatcttcagaatcttaaaggagcctaaggagggcaactctagaaagtgttttgacgcttatgttttgcttgcattaatatccatcctcatagggaagatgtggtaataaatatgtctgtgagtagtgaggtgtctttgaagacatgtcacttgtttgtttatgtgggcacagtgtgttcaaacgtatgttttttcccatgcaggtgtgtataccagcttcaatctctctgtgtgtatacatatgcatgttctgggaggtatgtgtacaccagagtcagcttctaagtggcgagcgatttcctttcctgatttttccacctgattttcccatcgtgtagtttgtgtatttgtgtagtttgttgtagcttgtatatttgtgtgtgtgcctacgttttgatacttgggagggtgggctattgtgtatgtgtgtgtgtgcatgtgtgtttgtgtgtgatagaaagaaggaaggagagggagggagatgccctgtgttgaagaaataaactttggagtacatgcatttccaaaagtctctcttattcttttcccctaaactgaaaattggaaactatttgggcctgagaatcacctgctcccacaaataccctacatagtcctgccattgactcttggagttaggtcctcactcccctgggtacctttagtttcttccatctgtgtctgtgtttttaggtttccatgcaaaaggccatctaggatgaagacggaatgattcataaggaagctggcttctcattgggatgaggaagctgctcgcccctggggtgccagctccatgagggcaggaaccttgtgttttgttcgtttctgtatctctagtacctagtctatagcagaggctcagtcaatactcatcaaaggaatgaaccatgaacagcagagcatattggaagatccatcatgaaaaggttgttgtatgtgttctaattacttcagtcaacatggttacattaaaaggcaggaaagaaaccattgcctttagactgtgtgttaattgccacctgtacactggcagaaaagacagattctgggcatcgtatttgtttttccaaaggattttcctgggattatttatgatgggaaaacctactactaccacaatccccatgacttggcttttccactgggtagcatttcacggggaggcaagggtgtgatctgaagctgcgttctcctcgtcactcggggtggtactggagtcctccttctttctcaacccacctgctcatattagggcttttaggaagtaagtagctcttctcatgaaacatgttagggtacccacaagtctgtgtgtagttacaatgaaattttccgtcttcgccgctattgtattttttgtctatacctaaaggagcactacctagttgcttctttgctacacttaattgttttttatgcctagtgtagcactttactaagtgctatcttattctaaactacactgcgtatgtctttgatatcttctgttactcctatgtagcccaattgcaaatgcataaaagggtatcagaaactacttctaggtttattacaattactgtcctttatactcaatattttcaagaatatatattttatataaagccaggacatgcctataaataaacattataaatcacaagtacattcagttcaacagaccatcagccaatatattttgaaagttctccacagtgccaaacattcaaaaaataatttaaaatattggttgtttttctggatgtttccaactacctgaatgtgctcatgtttttatgatttttttttctgttttcatgcagatgtttcttgtctagagacatattcagattctattttcagtttctttctagtaaattttggagagaggaaaattttttaattaactgttttttttaagaaaatgcttagatggtgtgttcaaaaacaactctgggagccaaacatttgcagtttgtttgttttttcaaccttattcctgacttcacagtttgcacgttcatttgagggagaatcacttaaagattttgtatttctccatttttagaaccatggcatcctgtgcctcaagcaaatgcttttggagtattgctctttggaggcggcctctgtagccttgcatttgggtagcaaccctctaaaataaaaaaatagagcactgcaggaaagccatgtctctggtgtgctggtgaaaccaaaatacacaatagaaagaaggaaggtggtagcagcctcttaggggcattcccaggagtcctaggggccttgccaggtgctgagcacatagtagagactactgtccatgaagccagtgcctgggggatgttactgtttccctgatgggacctctggcttgcccagctccccaatggcccagcttcaccctcttcctctttttagcctcccacatgctcgctgctgtccaaagatgcttagatggatgtatcaagaggatcatggaagtaagtagcattttttaagtgttggggataagatgagtaactcttggatactttgtcctgcctctgcaacccaacaactgggagaagtgtggtagattgcattgtttgtctaaaaccattcctttctctctgcccttgctgtggctccccatctaagggaggaatacacttccccattccattgactttggccttggccatgtaactccttgaccaatgggatgcgagtggaagtgacagcatgacaattctgggccaaggccttacacagcaccatgtgttttcactcactgctcgcacacgtctgccatttgctatgaaaacaacatgagagacaccatgaccagacctgaacctgacttgaggcctgcaaacatcccagccaaccacagacctctacatgagaaagaaatgcttgtaataagccactaagattttgagcagtagtgtgctgactaatacctaggcaggccatcccatccacacaccctacctctgctgcatctctggccattgaaccagggtcttaactggaacacaacttggagttttgtgaggttagtggcagtcattggtgccacagcaccaactactgtagggtttctgggtacttaactaattaggatagcagggccagtctagaggtcaactggctgcctagtggtacattagatgcacagaaacttccctgatatgtgagttagaagaacatgcattaagtagtcactgtctgctagctattgtaccagctgcttaacaattttatctctaattttctccctacaaatgaggaaactgatgatcagataaattatatacataacctaaaattacagagcaaggtggaaccaggtcctttttttcccccgggtcttcctaagccccaaaactcatgttctttcccctctatgccttgaattacttcagggaaaaaagtcacactcaaagcttgtgctcttcccactgtatcccttacatttcattaacaaggcatacatttctgatggaaggcaggggtgaaagagcaggaagatcaggagatagaaggcagccagaggcaactttgtaatttccaattttaaccctgtgatgactccccataacatattttggtgaaatacatgggctaggcaaagaactacaggagccaggctgtggggggatctctgagttaggtcaggtttgcagtttcccctgagggtgaggaggaaccttggcagagtttgaagtgggaaaaaagtctgggcaggcctgtatttgcatccctgggtatctgggagagggagccttagagctctgtgcagagcaggtgctttggtgatgtggaaatctgtgcaacagcaggcactggtctgaggctgccacagtgttcccagcacccaggccagtgtcagtgctcaggcagctacaggggttagagagctgtgtctaaagaagctctgggatagcagagatgggtccatgtaagagtgagtagctctgattctgggacaaggagacagctgatggctgtcagagacccactagtgactcccccttaaagggagttcacaacatctcgaaaatgttctttgacatgttcttacctcaaagcccctgtcccttatagtattcactgtctcgttttaaggagtaaatttaagtcttcctaactgggccataaaaagttgtcattcgcatgatcactggcaatgactaagatggagcctttatttgtctttagtctgcacattatcagcttgacattttcttgatccactttggaaaagtatctttggcattttgtttgtgcaatgtagattctttttatcattatttttattaagtttgaaaggaaagagaagagggaaaaggagaggaaaataaagatgtttacttaagaaattgggttctggagagtaaagttagggttctgatttaaagttatccatatttaaaaccaacattacccggggttctgtgcagagctacagggcaggactggctgctgttcttcagctatgggtgcatgggtgagcttgacaaatccttcccatgcttttgtccatcctccagcccacccctcccaattctttgctttgagcttggtgattctaggctagtgatgaagaagaataagttggaaatgcaggggcaacttgtctaggaacagggaaaaaaggccaatgactgacgtatgagtaaaaggagaatcatgatggcctcggcatcccctcccctccattagaccagggccttgctgtctttcctgaactctacagcttaatagagctctgtcttcctcagaaagacccttctgggcccatggaaacatcagactgtaggattctagagactgaactctcaggccattgtgtatccttgaaggcagggaaacctgcaagaagggggcaggcagaggccaaccacacagatgccaggccactagagaaacatcatgaacattgttctgaagctgccttcaatgacatgtgcatgtatttgcaattccatggctaaggaagaaggagaaaacagggatggcatggtcccattttctactctgcagttctggctatttccaaaccacctgctactataggtaatagcagataagaagagcaaattgtaagaagaaaatataaaagaaaactcatgtaagctcagtgatgaaatgaatgtttctgatacttaacatttacctgatctttttgttgttcccaaaagcaaagttgtggagaagataaagtagtaagataatcttagggcagcagtcaccaacgtttctggcaccagggactagttttttggaagacaattattccacagactgggggtggggatgggggatgatttctggatgaaactgctccacctcagatcatcaggcattagattctcataaggagcctacaacctagatccctcacatgcacagttcacaatagggtttgaactcctatgagaatctgatgccaccactgatctgacaggaggcagagcccaggcagtaatgctcgctcaccagccgctcacctcctgctgtgtggccttgtatctaatagaccacagaccagtacatgtctgtagccccgggattggtgttggagacccctgccttagggtgtccaacctgaacagagttaaaagtcttcacaacatttggaagaaaaatgtgatgatggtctgaatgcggctgatatgtactttcagggtaccctttggaggagtgtcaaacaggtatgcctaggcaagtaccagcatgcagtagcacgcaagtaatggcaccccgttccaccaccctgcagactcagtgaggggccagatgctcacaagagaggggcttctcatttcaaaagaaattatctctgccctttatcccaaatggtccattgagaagcaaagagaacatctttctttcctgtttccccagagagcctgtttctcctcaccaacacctctagaacatccaagttcccagacagctgttggatccggcttgagagtctgctacaaccctctgggaggtgtgtttttgcctagaagttgttttgcccacctgtggtcaccatagcttccttctggggcctgtatacacactcagattccaaatgcatcttctttgtcactctgaccagcagaagtgccatttcacaagcatgatggggaaggcttgtccttggggtcactgaaggctggtgctacaattagcccttctgtttgcttttctgctccttacagtagagtgtcttagatgaacagacagggctccatcaataatgcacagatgctctgtaattgggacttcctttgatgttaatttagctaagttcaacgccattgtcagtgatagcaattacgtgcagccttttcaccaaggacattttaggataattttatttttcatgtgcattttaaaatatggcagtaaattttgagctacattacctgaattagaactcattatttattttcaacagtgaactaatactctgtctaggctccaaagctgtcttttttttttttttcttttttgaagtgggggatatgtactggggcttctactttatgcagtttttaactcttgagtgaaatttagaagtgagtcacctcttctttttttgttgagcattttgaattgtcacagaggctatctggctcggtgacctgtcacgtatttttgttgggcccatttttattcactcctcccccattccacagcctttacttttgttcttgacacaatttaaggagttgcctccagctgtttttctggggaggttttaagtctgaatttattgtagctgttgagttccatggaaaacctgcaattcttaatttgttcatgagctgttgttggatttgctgctccatttggggactgggcccactccaagtttcagggtaatgtttaggtttggattaaaggctggacttctacctcctgttattggttgccttattaaaatggggaatgtaatgccttccaagtctgttgggggattaaatgagataatctgtggcaggagctaatgcaggctctggtctaaagcatcagtagcagctagtgttcttagtcatgtaatttcaacttacaaggactctttttgtggcactgctgtgtcatcaagatgtgtgggtgaatgtgaggaaggtaattttggcttgagatgctggggggcaggtacctaagtcagcttgggataccataacaaaatgccattgactagatgtcttaaacaacagaaatgcattttcttgcagttctgaagtccagaagttcaaggtcagggtgccagcatggttgggttcaggtgtgggctctcttcctggcttgtagatggctaccttctcactgcactctccactcatggtggagaaagtaaagaaagagaaggagatctctccgtcttctgatgaaaccacagtcctattggattagggtctcatttaaccttaattacctcctaaagatattgtctccaggtagagtcccattgcagggtagagcttgaacgtgtgaatttgggggtacgcattcagtccacagcagggggcattgcccctctatttctggtggcttaactaagttttctggaatttatccttaaatgaaatacttctgctcttctgagacatctacttcctagtaagagtaaaatacctaaaagaaaggaatgtgagaggggaaagaaggcctcacattcatcctggggaggtccaggctcctgagcttgggcatctcctcagccaccgcacgagacccttttgttcttgtgggaatggtagagggaagcagtagggcaggtgaaggcatgggaggagtaagcatggcgtgggggacgggaggctccttgccactgatggagccaggagcatgaaggtgcagctgccctctggacagctgtggaggagagaggtctccatacaggaccaatgcgggaaaggatgcctggtgcagaagtgagcccttaagctctttcatttgagtgacctcgcactcaactctcttaatcctcctctaattcccttggcgaatctggaaatgaaggctgatgtttagatcctagaatttgtcattggaatcaggcccctctgcccccagagtgaaatgaaaaaactggggaatgaaatttgggagcttgttacacatgtccaaagaatattatcccatcatcagaagggttttgaaacccaagattgagatattggctctttagacaattagaaaacagccaagtactgtattatgaaacaaacaaacaaaaaaatctgttcagtttaatgctagaaaaagagaaagagaggttctaacttctgtactcattctaatttttagtcatgggatgttttggagaagattagattacaaaatatttttttcttctttgtgttcagaaaagcctcaataccaacttgcagcctctacacttttagatgccagaggcctaagctgaaaatatgaattgtgtttgcttaggtaaaaatgaacagggcgagtaagcggaataaagaataaaaagcttttccttctttgctttccctcccctcttcctttgcacattatatgactaaatgtgcaactttgttcacataactgctacaaacagttcactgtgtaggccaaacgctctcttatgcagtaaaattaagaaataatatgctttgaaagtgatttatgagtgtggttaaactgccagatttacaaagaaatagttcagatcttgggaagcctcaggagtcacgtcaaaaatgaatttgaccatgatttaaactgctacttttcttacatgacatttaatatgtgtactttggaggcccatatgtctttaataaaatagcattaagttttaaatatgatatgaatgcagccagtttctaaattcataaccttttccacaactccaaaatgctaaccaataagggagtcatacacgcaataaaacataaaccttagaaaatagctttttattaaaatggttagacagttggcagctgggttgcaatgtaataaatacttacagcattgtgggtttatcagacgttgtttaccctgcaagcaactgggaccagacaactaattatagcccctgccacaagagcagttcaagctgagtccccctgagtatatcgaagatgcaggatagtttgtgttgagggccctggacagggagtccagagatttgggctctaatccctctccaccacttaaaggggtgtgaccttgggcaagtccctccatttttccaacttctccaatctgtgtcacagagataataatgcctggcaggcagttctgcagtgctgatagataagaaacatctgacaccagtgcttggcacatagtaggtgctcagtaaagagaaacaattctttttaaaaacagcctttaattaaaaaaaaaagtattttaggctagaccttcatgtcattctagcagtgatgttttatgatgactctaggttggccccaagagaagtttaaccacttagccagagatcagtgtaaacatcatgaaaaatgaacatggagctccttgtctctctcacctcttgaaggaacaagcatgggagaatggcagaaggacatatttggttcagggggaatgggagtgtcctggtggccactgctactttcctgttcccagagatgaaagggaggtgtgcaacactgttccttcttgcctttggctttcccattcatagtgaaggtgacttatctttgtaaactgctctttatcacagcctaaggtctttgagtacttctgctgctgctgtgtgtgaatgcatctgcagacctttctgtggagtagtcttgaagtaggccttccagtctccatgtttccagatgcataggaacagctggtgtttccagcatcgcagatgaaacagccagtctggcagtggtctgattgtgtttgtccatgcaaccaaatcttaccaccccccacaaacctccttagcagggaattcctgaattccctaaaatggaagttgtacattatatttgagcctagattttgaatctcagggcacagacatatgtgtggttatcaaagatgaaaagaccaaggaaccacttcattttgttttgttttgtgttgtttttatattttttaacaatgttatggtttcattaagggaaattaacaaagaaaatccttcaactctattccctatatgtgactctatgacacatgtagggaatatgtgtgttcccttccaaaccgtatccttttctaaatgtgtttagaaatccttttctaaatgtgttcttgatgtgtttaatgttttactttttacttaaaatttttattacttattttgtattcctcaaatatattctttctatggactgtataattctctatcaagttgacctaagtactattagttaccaaaccattttcccaccgttcctggattttaaccttatgtataaaatactgctagttgtatgtatgtgcagggtatgtgtgtgtgtgtatgtgtgtttcctttaaattacttccttaggataatttttcatggctgggcttattgggtcacaaggtgtgggcacacaagcggttttaggctctgcctaaggattccagggtgccatttttcaagttggcagcctatcttggctgagtcattgcacctacccaggctagagggaatgtaggtcaaaaggaacacttaacatttccaagaccttctttggaaatgagtttcctagagtcttattggtgggtatggttctagaagcaaggcttagattctgtacaaagcatgcattgacctgctaagttgtagtcctagggaattacgggttccctagagcatcctgaaaattattagtggcacgaagtcctgatcagtgtgaatgtgccttcagactgtaagccaaatctttgcataataccaatcattctacctataaaagcacaaatatgttattgttctcaatagccaatttaatgcggctttggggaggaaaaaaagagaaaagaagattacaagctggctgatcttgcttttatttctcttaaatctatccacacttctcaggggttatacttgtttaaagattgtatgcaactgtgcagtctgtgtgatttggaaagcaaatcaaactaaatatgaagttttcagcatgtgctgtttttaaaggatttcatgcatttattccaaatatacatttcttcccaagtagcactaaacctataatctttttcttgttacatttgtttttcggggggtgggaggccaagagggtgacttagctttggagtggaaggttcctattaacatctacctccttcttgtgcagcattattcacagcagagctattaaggctaattattttcaggtttctatcaaagggggatatttgagctgacaaaaaaatgcatttattgggaagacaaatggcctgtttaaataagaaagggaccattatcatctacagcttccacccccctcccagttattagcctatatagggaggaggaaccagagacccatgggagactgtaagtcagaggaggttctgggggaccgtgctcactaaaatgcctggaaccccaagaagggaagtagattttcctatcatgtctgtagcccacctgaattgttcattgactttggagctggtgtcagcctgtcatttttttttcctcctaggtgaaattcattgacccttgatgtgttatggaaagaatattggttgaggagctacatgtattagtcaggggaaactaactgctgtaacaaacagtcccagatcccggtggtttagtcagtctccattcactgataactccttgatggagagtgaggagtgtccagggacctaggcttcttccatgcaatggctctgcatttttcttgggccttgagtccttcctgggttcagcccatggatggagcaagcatgagaacatggaggattgaacaggaggatccacagtctgggtttttgggtggcacacatcacttctgcccattggccaaaactcaggcatatgaacattcataactgcaaaaaagcctgggaaatgcggacattgtgcactgacctgtgtccgctcaaaactcatatgttgatgccctcacctcagattgtgactgcatttggaagtagagagcctttaaagaggtaatttagttaaaatgagactgttaaggtgggccctaatccatctggctgtttcccttataagaagaggagattaagacatgcaaagaggcatcaggggtgcccatgcacagagagatgaccaagtaaagaggcagcaagagagttgccctgtgcaagccaaggagagaggtctcaggagaaaccagccctgtgggcaccttgatcttggacttccagactccagaactataagaaaagaaaggtctgttatttaagccacccaatcaatgatattttgtatttcagccctggaaaactaatacagcagctcaaatgagtgctccaaaacaaaagtcagtgtatttggtaaacattgagccagcatctaccatactgagcacttgtgttttggccccactgcaatagtcagctactgtaaacccttgggcaagtctagtttgtcctccagggctcagattgctcatctgtaaaatgggtacagtgatgcagatgaactctgagggtctccctatggttttgtgacctggatggtgcacagtccctcagctggcatcttggtcaggtaggggtccagtatctggcctactgtggtggtacactgaaggacccagattttagggttcaacctggattcaaatccccactctcccattggctatgggattttgagtaaatgagtgtctgccttagttacctcatctttaaaatgaggttaataaaaataaatacctgaaagtgttgctggattaagggattaaaggaaataatgaatatactgtaaagtacttattccagggcttcgtgcccaataaagacttaataactttgggctgggcgcggtggctcatgcctgtaatcccagcactttgggaggccgaggtgggtgggtcacgaggtcgggagatcaagaccatcctggctaacacggtgaaaacccgtctctactaaaaatacataaaattagctggacgtggtggcgggtgcctgtagtcccagctacttgggaggctgaggcaggagaatggcgtgaacccaggaggcggagcttgcaatgagccgagaccgccatgccactgcactccagcctgggcgacagagcgagactccatctcaaaaaaaaaaaaaaaaaaaaaaagacttaacaactttgtatctcctcctctctctttctctttcttcttttttgccttttaatttttctgcatattttgtaattattttcatgtaagcatcctgaatgtgaagatagagagtgggaagcattgtcacgcacgtgatctcattttatcctcatgagaggataagacagatgaagtggagccttattttacaaataaagagcactaagatgggggagttgtgggattcactgacaattccagagaaaagtgaaagtgagatcgaacttgggcctcctcttggcccagtgctgtgttgttacatgatctctaacctggccattctgggtatttcagggctcaggagatgacatgattcaggaaaggagagctggagtcatcaaccaatgccaggtccctaaagttccctcaggaagcacaaaatggaaatggcagctctttcaagggtcgggcagacaacaaacaaatatgttgcatttatagccaggaatagaaagaacatggttaacctccaaaagttcctgaatccatctgatgaagatgatgttgacttgacctagtttgggaccagggtttacttttctttgtgctccacgttacctggacttctccacacttctgagagtcagggacatggcctcgaaacaatgtttgtcctatatgtctagcttgccacagctctcatcttcaaaccaccagttcttggttttatatacatggcagaagatgccccagggccaggagttcccatcccaaatcataggctgaggatgcagcaccagggccaggaaggaagggaggaatagagatgacatattcatgtcctggttctgttgaccatgcttgagcttcagagccaggcaccatcctcctacttagaggtgatggcgaccagacagtcttttaagagaaaaagtatattttgcttcacttttattcaaaacaagctttctagagggctgaaattttggatgcactagagacagctggagatcttcaagctataggaaaatgacaatgaattcagcctttctgctatctctttcctgtagggcaggttatctgtctttgtcatggctaatggcaatttatgctatccatgaccactgggaaagaaaaatattcatatttttaaaatgaactgagacagatcacttctctatcagggacatggtcatgctagaaggaaggaagtagagtttccaaggtcatagtttctcagtgttttctgggaggtcaccatttatttatgatcttatcatttgagtttcaaaattaggatgaattctgctggaaccttaaaaataatttgaagtgatgagggcagaagaagctgctcaaatcctgtgcttttcaggaaatagggtactttttagatttgccaagcagcaacgacattgtcacccagaggtttagctggaaggtaacatacctgaagcctcaagattggggcattttcaggccatctatgaaaatgaaatatcccaagcccaccattagtattctcaagctatgaaagaagatggtttaggtcatttctcaggccatgccctctggtatacttggcctggatatattcaacttgtattctcattcctacccctaactgcaatattaacattttttttttttttttttttttttttttttttttttgagatggagtctcgctctgtcgcccaggctgtattgcagtggtgtgatctcagctcactgcaagttctgcctcccgggttcaggctattctcctgcctcagcctcccaagtagctgggactacaggcgtccaccacgagtccggctaattttttgtatttttagtagagacgtgttttcactgtgttagccaggatggtctcgatctcctgacctcgtgatctgcccgtctcggcctcccaaagtgctgggattacagacatgagccacggctcccggccaatattaactcttgaacacgtgtttacacaggtgaccttcagctatttaagcacagacgttccataatggaagggcagcaccagaaattcccagcttttgagaaaattattggacctgttattactggaaggaggagaaccaagatgaggtgatttaggatatttatctagaagatgagggaattaatacatagaggcatctgcctctctttgcattccaccaaacagcttaaaaggaatttcagggctgggtgcggtggctcatgcctgtaatcccagcactttgggaagctgagacgggtggatcatgaggtcaggagatcgagaccatcctggctaacacggtgaaaccccgtctctactaaaaatacaaaaaaattagccggacatggtggtaggtgcttgtagccccagctacttgggaggctgaggcaggagaatggcgtgaacccaggaggcagagcttgcagtgagctgagatcgcgccatgcactccagcctgggcgacagagcgagattctgtctcaaaaacaaaaacaaacaaacaaaaaaaatggatttcaggtgattctttttggaaggtctttcttctcacccattggctagtttctacccattaacaccaagcctcagtttttccattcttcttcccactcattcatccatcttatatttactttgtttatcagggtccttggaaggatttgggtagaaaaggaactaaaacagccttagccttcacagggagcactttctagggaagatggactcaagtctttcctctgtctcactatgctgacctcttctacagttgcttgggtgcctacaaattttttctcctttgtgtgcctgatgaagtctacaaatgttatagactgaatattttaaataatttgacctttgtgccttatagtactcttattccctttttattgtcacattctgttagaatggaatgaacagaattcttcaaagggctttttagattgccgtttgatctgactgtggagggaagaatgatagagagttgggtgtgcagttttgcacacttctgggtgaatgggcagtatgcatgtcatctgcctccctccaggctgaccacatgggctcctcagggaaaacacagcccagccagggggagtgggggtgggtctcttcagatgtatggaagtccttgtgtgaagagccctatgtggctttcaacaataaagtctcattgagttggaggcagtttggaaaaaggcttggagccccacattagatggataccagaagaccaacatcccattataaaaagaaagtccttacatcaaaatatttaaaccaaagggaaaggcccaagaagtatggaaaagaaacaagaaaataagcaaaagtagtgaaagtatttccttccaggacatcagaagctagaccatggctctagtctagaatcatctgataatgatggagatggattttttgttcttaaaaagaatgctctggataagtcatttcatgtcagcttttataacagttaggagtaagggaagagacctgccttcatcttgccagtctttttaggtgtgttggtccttacctgccaggaatttggtaaacttcatagcatagagccttctgtctggggtatccgtggtcatttgctgccagctctaagttttcttttgtgatttctggcctcatttcccactgttctgcagtgtattttttcagtttaactagatcagtgtatgtctcaagttcttcttcctcctcctcctcccttcccttcgaaatagatatgccttcattattgttcgcccaatctcttcactcactcatctaccttctagggaatatatatctcaccttctttctctcatcaatccttcggtgcccaactcagattctgtcctctatgaagccccctttcagaattcccagaccccagagctttcctttaactacatctttaagccatattatattttcaaatatttgaatatatccatcttgctttcccaagtgagaaggcaaggaatgtatctcatctaccttctgtttaccccatggggccaaacttagggatggtcctatattatcccttagtatttagcatcttctactacactgagctatactgagacagtcaccttcttccccatggccaattaccagggaagacccaatgcaccagcactcagttctctcaccaagtgttattctgaaaatatgtgtatgagacagtggccagccttggaccagagggaaattctgcaattctgcaatttatgtggatgcttgctagaggtcacaccacaaggccactgtccacatatcagctttgtctcaggagctgactcatgttttttatataaatcatagtgagttgcccattataaacaccttgtaacattcaaaaggctttatggctgttattagctactgcagttgtgatttactagctaattcaggctgatgtgtagatgagtgtgcccagggcaccatttgtcccatctacataagtcagagagtagaataggctgggtactcaaaagcaaatgtctcttccgacggcctgtggcatgtcagggcttgcttatattttcagttagcaggtcagcagtctctcctctctaggtgggctgtgtcttcacaccttgacacctccatccaagagcccttggtgggaagcacggctgtaacagacagtttgtgttcagcgctttcactaaagacttccttattgcaggcagaaaagaaaataaagttgtgagagaaatatctggaatggccctggtgacacctttatgtttcccagtgcattcagcatcagattttgtattggcttctagttagcagtagtcacacttaccacttgttctttttttccaatgaaagtatctggcaggatgcggtgactcatgcctgtaatcccagcactttgggaggccaaggtgggaggattgtttgagcccaggagttcaagaaaagcctgggaaacatggcaaaatcctatctataaaaaatacaaaaattagccgggtgtggtggtgcctgtagtcccagctgctcaggaggctgagcctggggaggttgaggctgcagtgagccatgatcacaccactgcactccaagctgggtgacagaatgagactccatctcaaaaataagtgaaagtaacactattggattgcctgtggtgtgtacatttatataaaatcagatatagccacagattgtgtttaggatgacatatgttttacgtaacatgtttatttgtattaatgttttaggtttttgctttctttttaatcctactaattgcctaagatgagatgaaagaaaattcacctatacaagtggtattctgctcttctggatctgaaaacagggactaaactgagtaaaacttataaagtagtttgtagtttatttgacagggagaaaaattatagaaacacacatgtatataaaatgtgtgtatgtacacacatacatgcttaccagatgagcacattatatgtttatatacttactatatagctatatatgcatgttatgtaatacatatattaaacactatcccttactttgttgtatagatttctgctttgattggctcacatttaatagacaatatctcttcttagtttcagatttcggtgccatagaaccaagtagcttgggtaggaggtagttctttgcaattccaaatcctcatccttcagcctctaactacagttgactctcaaacaacacaggtttaggactgcacagattcacctacctgaggatttttttcaaccaaatgaagatcaaaaattgaaattctcgggatgccaaacccatgtatatggaacaccaacttttcatattccatagggccaactgtgggacttgactatgcgtggatctgtgtatacgcagggggccctcaagccaattccccttgtctatcaagggatgactgtactaagttgacctagaaagtgtgatatttgaattgtacccttgcctcaggcttgatttccctgcctgtcactttggggtgagctgtccaacatggcaaggtttgtcttctaaatggttgcatcatccacaaaatcaggaaacagatttatttgtatctgttgtagttagtgcttttgcccgtgggtttctggtgggaggagcgagaactaggcagcctttgtacctgtgactcaaaggaaataagtctagcattttccattagatgtttattgctcaccgagaattggcttagaaacctgtattgagttgttacaaggaataaagctgaatgagatcagactttggagaaatcagagaaatgtaaattaatataagaataaatgatcaccttgtacccattaggctgggataattgaaaaaccaggtaatggcaaacgttagtgggatgtggggttataggaaccctcatgccctactggtagagttacagtaattctggagtacaggctggcttcattgagctgaattaatatactcatatcctgtgcccagcaagtccactctaagataaatatcccgatgaaattcttgcataggtccataaggaagttcgtaggaggattttcattaatgtattatttgtagtggtagaaagttgaagccagctttgagttgaaggaaattccaggagattggaaggtagaatgtggtagatgccttggagtactgagcaacaattagaagcagggattcagtggatgcatggcaacatgacctagattgcattgactacatgtgcttgtttcctgtgcttttgataaactgacatctggggctgggctaaccagggaaagactgtccttcccagggctagccaattcttagagattgcaaatgactcacttagaggtgtgcctttgatatgcaaaggaacaaatccagagcccctgctgtgaaccacttcctctctctggctcctacactctaggagacagaattcctctgccctaatcatcccaggaccagtcaagacagccagtcctacttctgcttaccttgcctggcccatctcgtcccagaaccaccacagtcaagactttactgcctccttctgccttgttgcctacccagatgcttccatgtggggccctgtgtaacatggcatgccccctcctcttgggaactagagtaagctatgttttcaatggcagtcatcccctgatctgttggcctcaccacacctaaataattttataacataggtataaaataaagtcacttcatggcttggcacagtggctcacgcctctaattccagcactttgggaggccaaggtgggtggatcacctgagatcaggagttcgagaccagcctggccaacatggtgaaaccccgtctctactaaaaaaacaaacaaaaaattagccagatgtggtggcgtgagcctgtaattccagctactcaggaggttgaggcaggagaatcacttgaacccgacaggcgaaggttgcagtgagctgagatcgcgccattgcactccagcctgggcaacagagctagactgcatctcaaaaaaaaaaaaaaaaaggggctctagtgcatcttgtggggaagaagttggttgaaccttgtttaaccgtttgtttcccaagctcatttgaccatgaacccttcctggtagcacctacttacttaaatatgaagcttggtggtgaacctctcagggtacttgagcctttctttctagcagagggctttgggctcctgagcaacattcatgaacggaggaagactgtgtggacaagtggctagggaaaggcacaacaatttgttggagaagaagccattaactgagataccacctcttccttagtatccaagggacttggctcagtaggaatattatgttttttcttttcttttcttttctctatttatttatttatttatttgagacggagtcttgctctgtcacccaggctggagtacagtggtgtgatcttggcttaccacaacctctgcctcccgagttcaagcaattctcctgcctcagcctcccaggtagctggggttatgggtatgtgccactgcgcccagctaatttttttttttttttttttttttttttttttgtagagtcagggttttaccatgttggccaggctggtcttgaactcctgacctcaagtaatctgcccaccttggcctcccaaagtactgggaatataggcgtgagccactgtgcccagccatattatgttttttcaaaccagaaagatatttggttcaagtcatagttttcaatcattgtgacctttggcaagtcctttgaattcttttggttcagttttctcgttggcaaatgcagctttgaaacttaacttcataggtttatgttgaaggttaaaaatgatatatgtaaagtatctggcacttagtagtaggttagtaaaaattagccactgttaagacattattatcaaaattattaatatcttcatttgatcttttatgaggactaacagtgaacctattcacaattagccatgtgactatagaagtggcttactcaaggtcacattgctcattaatagcaggggtgggactacaatttacttctcttaggtccttgctcaatgtcatcttcattacactggaccaagggtccttttgcctatttcgtgactgaaggaactcagcacaagctctttcagtggactgaatggaccacttcattgcagcactggagagagatgcgggatgggattcagagggcctggggtgccactgggatttttgcttcagttatactctgcatccttgttaataacctagagaaggttgtaaagaatatgctcattatatctgtattttcccctaaatggagaggtattacaaaccccaccaatgacagagacgtgacataaagggacctggagctgtcaggcatatggacaggaaatcactagatgagattcagctgcaataaatgcatcctaatacatctggggacaaataatccgaaacacagatattcaatgggaggaagatatttggaaagcagtaaatgctgaaggggacctgggggatactggacagcaaattagatgtgggttttcattgtgttaggccaacagaaattggtaatgcaatcttgcgctgtattttccagcagtcccctggagcagctgggaggagaaagcctctttcaccagccaagatcaagtctgctcgccccacacactcctgaagaatggcctggctggggctggggtggagggaggggtcgctttactttcccctggcccctacctcacagggatggtgactttcctttctctaagccttaccctgaccctgtgtccttggagagtcggtctctttcctgtctcccagcgtcttgctgcagaatgctgtgggatgttggtctgcctgggacagccaagggaggacagtcctgcctggaaagtcctggtctgcagggaagacttggcctcaggtgtttgtttccatgtaagctaaacatagccatcttttctagtgatcctggcttcctccccgctctccctcacactcacacccccatcctcttcctcatgaaggatttcacctgcagatagcctctatagacagaggaatatttgacaaaacacaagcatctgccccagcagctgttcccagcaatggggatcagtcaccaactcctcccacctcctccttctcatgcttcactcttctgcaccaccccccgcccaattttatagtcttctcaagtttaaagacttcccttgacatgcataaaaccaaatttctcttctggggaccagtgaacacatattctgatttttttctagttcctcgccttaccccattctcaggaaagcccagttacttcgtgagttcagagcacttccttgctggggcgcctgctaagtggggtgagtttaactggagcacccctcccaacttttgggaaagagttcactctcaccaacccatactttctgcctttccttctctgggattgtcttacctctggaaatccttcagggacttctagggaatggctatgtcaatggggctggtaaaaagcagctgtgggctggtaaatgtcagaagctgtttgcaaggctgggaaaattcactgtttatttcttcaaacaagccctagtttcctccactgagaatgttcttcatcaaactcatcattcaggtttgtattcagagcagtttagcttaggcatgcaattgtcagtcaacactcgtaagtaagtggccaagtttaaagttactctttgaatatttctatacactctattcagtaagtgttcaccaagtcccttctctgtggctaccacacagctaaatactcatgtgtatatgtgtgggagagagagcgttttactctcgtggaggggcccgaatgaaaaaggcatcaccgtggaagaacttgagctttcagtcctgataggtcatggatataaatggatggcagctgctagcacagtgatttatgagtgatgctcccagccaaaggaagtcaggcacattctagaactgcagaccgctgtgtacagggcatctcagtatatttagcaaaatgagattgcaaaccacagaaaaaagggctgagtgggtggagaggaagaacattctctggccagaaacttgctgaactttgaggccagggaccggaggctttgcagaggtggggagagacgttctttggcttgtccgacagaaataaatcaccactgaggagatataccaaaggccaattatatggagtgttttcttggaaaatcatctcccagacaggccctgtaaatcatccccagcattggcagacattcagatctgcctggtggggcgggtggcatgccagtgcaccccagtgtcaggtagaggaattacacaggggtagtctcgttgtagcagggaaaacagaggtcaggtactagctgtcttcatccgaggaagcagtgtagggcagaactgtttgttctgtcctaggaattgtagggccaaggcttttgaccaggttttgccacttacttgttctgcgactttcagattctctacaaacagagtggggactgggttatctctgaggttcctagaagccctgacattaattttatgcctttgtgttctctataacttctgcatagcgtaagcttttgcataccacaccctatgctggtaattatcccaagagagacaaaaatttccatctacccagcaaggttagtcatacaggatcatcttgggagggtgattggggtccctcaaagccaggtcctcagtgtagctgtagagagagatgggaatttagcctggagaatgaagagctaagggggatgccagaggtactgtgttcaatattggaagggcttcatgtggaagagggatccgtgtctgttgtcctactctgtaggccaaaaacaggaccaatgaactgcaaatagaggggcccaaaaggaaggaaaagataaaccagcaatcattattccattgctcagtgacacaaactttgatttcctcagtgtttgaaaatatagcaagaactcttaactggccaaatgtggtggctcacacctgttataccagcactttgggaggctagagtggaaggattgcttgagcctgggagttcaagaccagcctgggcaacatgcagaccctgtctctacaaaacaaacaaacaaaaaattatctggacaaggtgtacctatagtcccagctacttgggaggctcaggtgggagtatcacttgaacccgggaggttgaggctacagtgagccgtgattataccactgcactccagcctgggtgacagcaagacacacaaagtctcacagacacacaaaaagaactctaaccatcagaactatccaacagtggcacctaaacctggcagagcggaaagtgatccatcactgctgtaatctagccgaggctgggtgacagtcatggtcacagcagagaggacaggatgctcctttctgctctatctgtaaccatcttctgtccctggaatgagctgagtgaggaatgctctccctcctctcctcaaagtatcttccttgtcccagcaaagcttcattcttcctattgaggaggggttcatttatctctaggagagttatcttaaaatttgtctactttttggagaaaatatatattgagactttgagggtgggaatttaattggttgccaataaacaggaaggccccaagggaaagaaatgagaattagaaactgactcacaatatctggatgggaagccaggcaggagggaaactcaggctctcgaaagggaaatctgttgggcacccagcttacttcttaattaccttttttgttaatggccagcccattccttatgggtttgttgttggtgggtttacttaaacctttttgaaatatattggttattttagcttgtactgattctggaggcaatgaatccacaaagttaataaaataattcttccatcatcttaaaattatttcttcattcaagcttcaagatttccttcttcttcccatattctagaatgaacaattgttttttctttatttatcttctttgtgattctattgattctgttgggatcccttctcagtctttgactttctttctagacaaagccctcctaattgttctcattagtttgagtatgacaattctgtccgtgtgattaattcaacacacacctaacatttattaagttcctactctatggaagtcgttgagcgagacactgaggctagaggtgaaaaagacacttttcttgccattctttatacaggattgtagcagaaccaaattagttgtaatgaatagagtgctatgatacatgatgcaaacactggccattgttcatgaggtcactttcatctacctcctgtgacagatgaaatcactgagactctgagaatttcagtgaatcactcaagttcctacagctggtaaatggcagagctggggtctgaatccagggctgtctgactccaaagcctgcatcctttccactgtgcaacacttccctttgtttgattgtcgatggaaatacagagaaacatgtgacttaagaatgagttggggaacttaattgcactggtgaaaaatgaagacattttataataaaacacataggaagatgaagtagaaagtttaccagtgtcctgggatcctccgcaaccactttgaggagaatctgagctcttggtatgcaggcttggaatcatggctctgtctggcgttggacataaaatggtagacttgatgcagactccagctcagtcatccttgtctgttatgcttggaggcgacagctctgcatgaacccattaactcagagagatttcggcagagcctttcccttccctgaccactgggcacgagtgcaccactctgctctgagctgatcagctttccatatgcacggaacaaccacagcctccctccccatctttcatcacctaaataagggcagttaatgtttaagagtagagaatagggaacataatgatggataaattataagtttggggatatgaaaagtcaaactgtgtaaatatgtattttaaaccacaaacagaatgttaatgcatctttcccattaactcactaactgaaattacagagtgtaacgtgagccaacgcccacgggttggttatgatgttttcagatttagaacagcaaatgataaatgcccttctctcagacaaagaagcgattgacacagcttttcaatgtagtcactggcaatgtcagcagtggaaaataaactgagcaccaggaggagagacgtcctgagatacctgcggaaagtggagtgtgggctactgttaagcacctcctgtatatgggggaatgtctcaggggtcggtgcagcccctccgagcagtgaggacccaggcgccattgcctggactgcctttctggattagagggaaggcttgttttctcaagcatcagctctatcttgctctgggttggtgggcagctgccgtgaagccagtttcactgtggctaggtttgggttggggatgtgtggtttttgcatcagccatttcattgtttggttgcttatgggcagcagtgtaaaagagaggttaagaggatgtggagaaattagaaccctcgtgtgctgttggtgggaatgcaaaatgctatggaatagtatggtggttcctcaaaaaaattaaaagtagaattactgtactatatgatccggcaattctgcttctgagtgtataccccaaagagttgaaagcagagtctctaagagatatttgaacacccatgttcgtagcagcattattcacaatagccaaaaggtggaaacaaaggaactattgacagatgaatggagaaacaacatgtggtcagtatattcagtggaatattattcagccctaaaaatgaaggcacttctgacacatgctacaacatggatgaaacttgaagccattgtgctaagtgaaataaaacactcacaaaaagacaaatatgattctacttatattcagagagacagtagaagaggggtcgtgaggggctgggaagagaaggaaatggggagttattgtttcacatgtacagagttttggttttggaagaggaagagttctggagactgtaccacaatgtgaatgtatttaccactactgagctatatatttagaaatggttaagatggtaaattttgtgttatgtgtattttaccacatataatattactgcatctttgtaagagaaggagaaggaatccagctttagggacttgggtagattcactgctgctgtttacttgctgtatgactttgaacaaattagtaaacactgtaagcctgctcttctcaactgtgaaataatatctgctgtaagggttgtaaaatagcgagtactcaataaatgtcagcatccctcactttggtgtttcagaaatcctctcttatgcccaccccaaactgttctcctgaaataaacatggtggacgtgtgtgtgtgtgtgtgtgtgtgtgtgtgtgtgtgtgtgtgtctgtgtgtaaaatctttgtatacatggtaagttatgcatggacttctttctgggctgaagtttggctctattaacgtttcttcacaaagatggattccttccctttgataccatctctgcactttgtccagttcccctgcatgtctttaattgaaggatcagaaagtaaatggggtatcctggagagactgcagcctgggcattgtatacctcacttcttgttagcctggtggtcctcatggcccttgggcagctcactcatagtcacttgggggtgctcagtctttctcatcccaccccaggatctgcctccctggtgcttcctccctgccatgcatccccctcccaccaactcccttcatccccaaactcccaccccttcttttagaggtagagtctctctttgttgcccaggctagagtacagtggtgatcatggttcattgtaacctcaaactcctgggctcagttgatcctcctgcctcagcctcctgagtagctgggactacaggtgtgtgccaccacatctgggtgatttaaaaaaaaaatttttttgtatagatggggtctatgttgcccaagttggtcttgaactcctggcctcaaggatcctggtgccttggcctttcaaagtgttgggattacagatgtgagccaccagtatccccctttcactggcttttgacactttcttggcctcttttggccctgagccaagtaaccctagggcatatttcaggaggaggttgttggcatttctgaagcctgtgggacaatttggctgtatgcaaatggttgagggtcattttcccctgaaggttaaatggtgaccctggtcaatgtttagctagtgtgcacttaaatgatttcccctagttaatgaatcataggacaaattagctgaggactttcgcaccctgcaggtaagctggggtggtaagaactggtaatactgaaattgtgttgagttatgtaggctatgcagtgcaggatctgcttagcacagctttccggtgcttagatcctaattacaaatgtaaattgagggctgcaactgttggagagccaccaaatgatgacctggatatacttatttctgagcctgctcaaacatccctcctcttcaccttaggaagccctatatccaatctctcttcctctatccctgtcattcccaaattgtgtgctgagactccccagagtgctgcagcagactcacagggatgatacgggatattttaaatgtttgaaggcaatacaaccacatgcaacatctgacagacgctatgtgaattaccatctcaggtgtttcacagtttcatcattagatcatgctacaattctttggataatactgtatctttgcaaagttgcataatttttttcggtagttgctgtgattaaaagcaagtgtgtatggaataggaaatgtggatggcagtgcctaatatgtacaattccaatattaaggaagttgtgcagggcccaataggtacacacatccctttagtaaacaagtgtgaatcttgaagaatgaaataaaaatgtttcctttcaatttatgcatttttttatcaaatggctattgagttattaggacataaatacttattaagttgttccataaaatggaactcaggtatttcttttggtccgtgggctctccctggaaaacattactgagaccgttagggcaccatgaactaagttggagagttattgttattattattttttgagatggagttttgctcttgttgcccaggctggagtgcagtgacatgatctcggttcactgcaacctctgcctcccaggttcaagcgattctcctgcctcagcctcccgagtagctgggattacaggcgcccgccaccatgaccagctaatttttgtatttttagtagagacggggtttcaccatgttggccgggctggtcttgaactcctgagctcaagtgattctcccaaagtgttgggattacaggtgcaagccaccatgcccagccaaattggagagttattatagacaaaaaaaaaaaaaagaaaggatcttcccctccttaccttcatcagtcctcccactgtgaactctcccttctgaacaaactcactgtgtcccttatatctctctttcttcaccattagctccttctcccacctgaaagatgaagtttcattgatcctttaaaaataaaagaaagaaaatcaagccttgtcgaatgttgttaccacctcctcttccattctcctttccttctcctcctccttctcctccatctttccctttccttcattgcccgacttaagaacagtcttgtcccgattcctttactgctcatatcatatccacattgctaaaaccttgtctggctttgtcccctgctgctgcctttatgtggccctcaccagggtcactgacaagttccaaataaccaacccaacgccactcatatatctgcatcatagtcacaataagctgaggtctcacgttcccccacctgatattttggcttctgctggttcctgtgtctagaacatctgcagctgtgttaccttctcattaataacagtggtgttgatagctcatcttgagtttccttctcccatagagcctctggggacctcaatacccccttaccacgctatccgccaaaatgctcagaggtatttgaagccacaggctgtaccacacagttttgtgtcctctgtagtactttcacacacagtaggaaggtagtaaatatgggtttgaaaggagcagcactgttcagaataggtggtccagactttggtctcccaggaacccctgctaacatatgctgaaagaacctataggtatgatgaggttggcttctgagatggaacgatagactccaaatctttctctcaacttaccaaatagagacctttctttctcattatataagtaatgcatgtgtactgtagataagttagaaaatgaataccaaggaaaggaataaagcttatatttagaaataacaactacttatacttgtatttttatatattaactgttagaattttatttccgtatatgtgaaagatatatatttatgaagtataaataggattatattttacttgtttctttatgatctccttttgttgcttaggaacactacatatggtgaaatagaatagatgaatttaataaaagttacatagtattttatattacactattgctcattattatttttaattttgaaaatatatattacatcattattccaggaaattatctatatcagtactactcaaaggtgtccatggactggtgccagtatgaaaattaatacaggtccatgatataagtacaggaattacgagtaaggcttcagaaacttttaaaggaaagtaacattcccatatctggtaactcattttagaaactatttttaatacaaaatattacatattaaatgcttattaacagaagtaactactattaaaatcattccatattttacacatatttcaccacctaaccaccccccagtgcccgcccagattttttcatataactgggaagccacagtccatattattcttccactggcttttttcacttagtaggtttctttccaagaaggtaccaaagagaaaaattgagatagaatctattgaaggttcttgaggaataatttacttatagtaaaatttacccttagtgtagagttccatgaaattaacccaagtgtagagtctggacaaagatgtctgataattatcataacaatcaagataatgaacagttacctttctggaaaattacctcctgtaccttagtagtcaaccatccccaaccatccctaccatccccacttcctggcaatgctgattctatttctgatcctaaaatgttgcctttttgagaaataaatggaatcataccatagtttggactctggcttcttttacttatcataacgcatgtaagatctatctatattgttgcaatgtatcagtagttcattcttttttattgccgagcagtttttcacatatggatgtactactatttgtttatccattcataagctgaggggcagttagtccagattttggtgattatgaataaagctgctattaacatttgcatagaatttttgtgtgaacatgaaatttgtgtgtggacgtgttttcatttcttttgggtaattacttggaagttggattgctaagtctcgtgatacatgtatgtttaactgtgtaagaaattgccagactgtttttcaaagtggctggctgtatcattttgcattgcttccagcaatgtatgaatgttccagttctactcacttgctatatataacttgatattgtcaatatctttttgttttagttttagtttcaatttttgcctttccaatagatgtgtaatgatatctatgccattgtggtcataatttgcattttcttaatgactaatgatgttgggtaccttttcatatgcttacttgggattcacacatcatctttggttaaagtcggttcaaatcttttgtccatttaaaaaagtgggttgtcgggaggcggagcttgcagtgagccgagatcgtgccactgcactccagcctgggagacagcgagactccgtctcagaaaaaaaaaaaaaaagtgggttgtttgattttttatattgagttttgagatttctttatatcatttagatataagtcattttgagatatgtattttgaaaatactttatcccggtctgtatcttcctttttcattttattaacagtgtcttttgaagagcaaaagttttaaagtttgataaagtccactttatcaacatttttcttttataagtcatagttttggtagcgtatctaacaagtcttggctaataaaagattataaagattttctcttgttttattttcaaaattttatagctctagtttttacatttaagtgtatgatccactttgagttattacttgtatatggtgccaggcataggtcatgggttgtttttgtttttttgtatacagatattgaactgcttcagcttcatttgttgaaaaggcctgcctttctcctgcttgcctttcatctttgtcaaaaattaattggccatgtacattggtctctatctttagactctattctatctcactgatttatgtgtctatcctttcatcagtattacattgtcttaatcactgtatagtgtattttgaaatcaagtagtagaagtcctctgattttgtacttttttgacaaattattttgggtattctagttcttttgcatttccctgtaaattttaatatcagcttgttaatttctataaaaaattttgctgggactttcagattctgttgactatgtagtgcatttttgagagaattgacatcttaacaatattgagtctgtgaagatggtatctctctctattaatttagatctttttataacttttaatctgttttataattttcagcatataaatcttgctcatactttgttagatttgtacataaatattgtatgtgctttgtgctattataaatggtatgagcttcgaaattttaatttccaattgttcattgctagtttcactttgctaagcttacttattatttctgagtgattttgtaaattgagattttttttttcaaattgacaatcatgttacttttatttttattttattttattttattttattttatttgagacagagtcttgctctgtcggccaggctggagtgcagtggcatgctcttggctcactgcaacctccgcctcccaggctcaaacaattctcctgcttcagcctcctgagtagctgagattacaggcatgtgccaccatgcctggcttatttttgtatttttggtagagatggggtttcaccatgttggccaggctggtcttgaactcctgacctcaggtaatctgcctgcctcagcctcccaaagtgctgggattacaggcgtgagccaccgtgcccggcttcatgttgcttttaaatagagacagttttatttcctcagtttcaattcttagattctttaattatttttattgccttattctaccacttagaacaacagtacttagaatcacagtaacttagtaccacaattccacagtactatgtaaaacaggcataatgcatgcagatatctttgccttaatcccagtcttgaaaggaagacagccaggctatcacaactaagtatgaagttagctatagattttttgcaaacgtcctctatcagattgaagatgttttcttctatctctagtttgctgaaagtttttatcattaataatgttgaattttgtcaaatgtttttctgcattcattgaggtgagtatatagtttattttctttagtctgtgtatatggtgaatttcattgattgatttttgaatattgaaccagccttgcattcccaggataaaccctacttggtaatgacatatttttaatattaatatattgctagatttgatttattaatattttgttgtagattttaattttaaactgatactaattgtacttattcatgtgatactttgtgatatttcaataaatataatgtatagtgatcagatgaggataattagcatatctattatctcacatatttatcatttctttgcattggggaaattcaatatcctctctagctatttaaaactatgtattattgttaactatagtcatcccacagtggtctaaaacactaaaacttatttcccctttctagccatattttcttcatctatgtttgtaattaatattggtctatagttttcttgtgatattttatctgattttggtgtcagtgtgtaatacgttatacaatgaatttaaaagtgttccctcctattttctagaagcatttgtgtagaatttgtattattctctacttatatgtttggtagaattcactagcaaatatatctaatgaatatagatacattcattagacatgtagttttttatcacttttgttgtcaaagttgtcagaagatttttaactacaaatacaatttctttaattggcagagggctattcagattatctatttccttttaggatgagatttggtaattggtgtcttcaaagggatttgacaatgccatttaaatacaatttagggtcctaaagtttgtaatattctttcattatcattttaatatcttaaatatctgtattagcgtcccatctttcattgctgatattgacaacttgtactttcttcttttttttcatattaaatctgactagaagtctatcagttgtattgacttttttttaaagaactagattttggtactactaatgtaaccgcccagcaggttcaccttacctgttgcctagacagagccaatttatcaagatgggcaattgcaatacagaaagagttattcacccagagccagctgtgtgggagactggagttttattattactccaatcagtctctccaagcatttaggaatcagagtgtttaaggacaatttggtgggtagaacccagtgagtcaggagtgctgattggtcaggttggagatgaaataatagggaggtgaagctgtcctcttgcattgagtcagttcctgggtgagggctaccagatgagccagtttatcaatctggatggtgctagctgattcatcaagtgcagggtctgcaaaatatctcaagcattgatcttaggttttacgatagtgatgttatcctgaggagcaattttgggagggtcagaatcttgtgccttccagctacatgactcctaaaccataatttctaatcttgtagctaatatgttagtcctacctacaaaggccatctagtccccaggcaagaaggaggtttgtttcaagaaaggtctgttattgtctttgttttgaagttaaactattaatataaactaagttcctcccaaagttaatttgacctatgcccaggaatgaacaaggacagcctggaggttagaagcaagaaggagttgattaggtcagatctctttcactatctcagctataattttgcaatggcagtttcattaatttttttaattttcttttttattttattcatctctgctttgtctgtcttaatttatttgttcttttggctttgcatttaatttgcttttatttttctactttcttaaggtagaaacctagattcttgatattctttactagtgtaagcattttagtgctataaatttccctctgagccctgctttagctgcatcccatgtattttgttttattcaattaaaatatattttccacattgccttatgacttccttttacctgtgttctttagactttaatttgttaatttcatatacttggcaatattccagatatcttttttgtattcattactagtttaattttgtgtggttaaaaaggaaataaataataaataaaccaatagtaataataataattttgtgttgttagataacacactttgtattatttaaattctgttaaatttattgaggtttgttttattgcccagaatactgtctgttttagtgactgttttgtttgtatttgaaaataatatgtatttttactgttgtttcatatgaggcttcataatgttaattaggtcaggttggttgatagtgttgttcaggtcttctatatcagtgtctactttattgattagtgagagaggagtgatgaagtctccaactgtaatcatagatttttcccttttttctttcagttttatcattttttgctttatgtattttgaagatctgttgttaagtacatacacatttaggattgttatgtgttcctgataaatgacctcttcatcattatgtaatattcttctttatttctggtaatggtgttgcagaactttgctccttagttcagctaaaaccaggttcttgtcacatgatcaggaaaagttaggcacacagacatattgaagggtaaagggaatgtggaatctattgggcaaaaaggaaaaaagaaaaaaaactctcagaaagcaagaggggttcctgctaacaggcccccatctcacagattgatttcaggccatacacaggaacggaagaggccaggctcctccccacctccacatgacacaagcttcccgtggcttcagccctttctcccagtgtgcaggcaggtcggagattccagggaccctctcccttatctgcctccaacatcaatcaatggcttttgctttatgggtgggtcttgctcattgatgagtcctgcctcagctgtaggagacctctgatagtccaggtctaggatcacttactgttcttctgcaggggttgaagtctttcattctttaacattttcctcagatacagtatgcccccagcatgacagtgtatgctacctctttcccagcaatttaaagcttttgttcttttaagggacaagtaattttgaagagctctctgcctttccattagtagcatctgctccctcctgtagaattgagggtagctttccctgtaccctagtcctgcccccactctttctctgtgagcacatagagaggtccttggaaaagagtggctgtgaacccctctgtgtctgcagttccagggattctattttctcatgctagtacatagttggccttcagcaatctattgaaaattttagctgaattcttcacatccaggcatcagaggccccatcttcctcccactggttcagttccctgctgggatcaagaaaagtaataattttacaaattatccagctctttttttttattgcatgagtgatattctctccagctttttatattcaaagaggaagccagaagtcctaataattcattttattacaaaagtatctatttatgaaggataggaaatttaatataaacaaaaactactgattgtttaagaagtgctagtctgtacctttatgaactgatttatattttcattctatgccacatcttggtcttattaggtccttgggtttgttacctggtagtaaggctggctttttgttgttagttctaaatttacatcttttgaaccaaaagttctagtatggcagaatttgctgactattcatgtattcacccttattatccccttttccttttaaaaaattttattgccaggcacagtggctcatgcctgtaatcccaacactttgggaggccaaggcaggcggatcagttgaggccaggagtttgagaacagcctgaccaacatggggaagctctgtctctattaaaaacacagaattagccaggcgtggtgccacacacatgtaatcccagctacttgggaggctgaagcaggagaatcacttgaacccgggaggcagaggttgcagtgagcctagatcacaccgctgtactccagcctgggcaacgagattgagactctgtctcaaaaaaaaaatgtattaagatgaaattcatattgaacatttagaagtgaacaattcagtgacatttagtacattcgcagggttgtgtgactgccctttctatctagttctaaacatttccattgttccaaagtcaagctcgtaacccacaaagcagtttctcccatttcccactcttccagcccttggggaataacaatctgcattttgtctccatggatttatctatttcttataaatattataaatatgattatgaagtttatatatttcttatagagtcttacaatatgtgactttttgtaaatgacttctttcacttagcataatgttttcaagattatccacatcatagcatgtatcagtatttcattccttttcatgactgaataatactcctttgtatggctatatcacattttgtttatccattcatcctttgatggacgtttgggtgtttccatcttttcactattgtgaatagtgccactatgaacatatttttattgcatctgtttttttaacttttattttagatgtgcaggttttttacataggtaaaccgcgttgttgtggggtttggtgtacagattgttacccaggtaataagcacaataccctatgggtattttttctgatcctcttcctcttcccaccctctaccattaagtaggccccattgttgttcccctcttagtgtttgcgaattctcattgtttagctcgcatttataagtgagaacctgcagtatttggctttctgttcgtgcattagtttgcttagcataatggcctccagctccatccatgttgctgcaaaggacataatctcatttgttttaatggctgcatagtatgctatggtataaatgtaccatatttgctttttccatttaggtcagttccatgtcttttgtttttttgtttgtttgttttgagacagggtctcactctgtcacccaagctgtactgcagtggcgcaatcatggttcactgcagcctcaaacacctgggctcaagctattctcccacctcagcctcctgtgtagctgggactataggtgtgcaccaccatgcctatctattttttaaaaattttttgtagagatagggtcctctgttgcccaggctggcctttaactcttgggttcaagcagtcctcccgccttggcctcccagattgctgggattagatgtgagccactggcctgaacatgtcctgcttgagtacctgttttccattctttagggtatatacctgggagtggaattgccgggtcatgtggtaattctacgtttaatgttttaaggaacctactatctcctttgactataatttttgtcatattgctctttgagtttgtcttcccagagggccctaacttttcattattgaagtaagacaggcaaggaagtcatctttctactagtttcatgtaggaacctttgtagcttctctaaagaggatgatttttttgggtctcctttaagactttcctagcaatttcataaccttcttggatggaagatacaacatggcaaaatgcagttgaggataaagaggttgtttttaacaataagagccctcttgaaaagtcatgagttttgcatgacaagaagtgcttccagttgccagtgggagagtttcctcatcatgcagagtggatgactcactgcccttgactgctcttctgatcccgggggcctctgttctctcacagtagatgcagcacacagagctgccaaggcatttccagcagggggttctgtgctcaggttttgaacaagggcagcatgatggagcctgacttactcatacacttcctgaggttgatgaacacattttcaccccttttagttgtggtaggtaatgtattcataaattcaagcctttttcccagattgtaatggatagtttatatctctctcatgattatttaattattcaagccaggatgactgtgtgttttctatcagagtttgggctgcctcagcaagatgcagactggtatctgcccttaggttaaaaattccggccagacatagtggctcacgcctgtaatcccagcactttgggaggctgaggcgggtggatcacgaggtcaggagttcaagaccagcctggccaagatgatgaaaccctgcctctactaaaaatacaaaagttagccaggtgtggtggtgggcgcctggaatcccagctacttgggaggctgaggcagagaattgcttgaacctgggaggtggaggttgcagtgaatggagatcatgccactgcactccagcctgggtgacagaatgagactctatctaaaaaaaaaaaaaaaattccacaccattcccttcttccaagtatggatggaatttcttccaggatctgccagcttttgtgtgtgtttgtgtgtgttgtgtttgtttgtgtgtgtttgttgaatgtctgtctaccactagaatgcaaggcccaagcagggaaggaccatggctcttctaccctctgcagactctccagggacggcactatgcttgggtgtgtggcctactccctatttgtcatcccagacctatgttttactcttctttcccttgctctgtgtcctggggtgataatgccttcaaccaccaggctccattgccctctggcttctggttgggtttggacaatgagggagaggtagggctacttcccctcccattgccacctgcaactttgtggttctggctgtgtccatccaggactatagcctttcatgccaggctgccctccctgcagctctgggtctccctgcagctctaggtctccctgcagctctgggtctccctgcagctctgggtctcaccgtgtgtcttggccacggctatctgctctgggtagctctggtgcttcagtgtccccggggttcctttgatcttgcccacacccctgtaaagaatttgttcttttaaaatcccaggtgaatatgccttctctttcttgccagggtcatgacaatgggctgaatttttgaatagatgagtggatggatgagaagacgaagggccgtgtttgtggctcaccccccatatggaacccccctctggctgccatctcactgggaggccttgccctgtctcatgtccctgctgcctttctcctgcactcccctttctcaatctgtcccaaccatactggctccattgctgtttctagaatgtacaaagcaagctcctgctccaggcctttgctctagccattctctctgcctgcaagtgtcttctctcagatatccacttggctaattaccttttctaggttttgctgaaatcttaccttttctatgagcctcacccaaaccactgtatttaataatggaaactgccctccaccaatatcaccttggcagccaagggcctccttcatcttggtctgtgtttcttttttccagaacacttaccacgttttaagaaactgcatttgacttatatatttattgacataaatattatgcttaatatttatcatctgtctctacctgctagaatttaaactccaaaaggcaggatttcgttaccgtttttttccatgggtatattccagactcccagagcaatgccatcttcacaataagtgcctgtgataggttgaagagtgccttccaccccagaagatatggtcccctggaacctgtgaatgtgggcttatttggggggtgggggggaagagtctttacacatgtaattaagttaagaagtccaaaatgaaatcttcctatattagtgtaagccctcgattctaggaaaagttcttttaatagaagagacagggaaacagacacagagacacaggggagaaggccaggagaagacaggcagagactggagttatgtagccccaagccaagacatgcctgaagccaccagcaactggaagcggcaaggatggattctcccctagagcctttggagggagtgtggccctgcagacttcttgatttcagaaacctggcctccggaactgggaaggaataaatttgtgctgttttgttttgtttttttgagatagtcttgctctgttgcccaggctggagtgcagcggcatgatcttggctcactgcaacctctgcctccccagttcaagcaattctcctgtctcagcctcctgagtagctgggactacaggcgcatgccaccatgcccggctaatttttgtatttttagtagagacagggttctgccatgttggccaggctggtctcaaactcctgacctcaggtaatccacccacctcagcctcccaaagtgctgggattataggcatgagccaccaggtccagccaagtttgtgctgttttaagccatcaagtttgtggtcatttgttatagcagccccaggaaactattagtatagtgcccaataagcatgtgccgaatgagtccacgcaagccttgttaacactgatatgacctccatttgaaataattcttctgcttttaatagctaccaatgcctgttagtaaatgtgagtacgtctgacatttaagcagtgttccagtttggggtatggtatggtccatttttgcagtagaaacttaaacttcctgaaaattttcacccactatgcttaacagcttaaagtctaacctaacccccaaataattgctttcactgtaaacctatcaatagcgtatggagaatgaactcacaaattattggttcttcaggcagtggatgggaacccctgttggtctttagccatgaaatatccctgtatcatttccccatttttatcctgagtccctcctgctgtatttaagctaattctcagtgattgtgtctttggaggagtccgtcacaagcatctatgtgatcaccctttgtatacctgacaggggttattttttctcccccaggcccagtcctggtgcgtgctgggcttgtgatgcagtgtggtactaactatctgctccttgtaggagacggaaggtaaatcaaattgaaaacacccttcctgtgtagtgcgtcttccaaatgtcctcaggtctctattacatcttctggaggctgccagattctctgcgggacaagaggaagctggagcagcttctctgtagcgacagaaggtgccattagcagaaatacatcatctcccagtggtgctagcaatagcagagtcctgatcatgtccattcttttgccagactgaggagagagtcctcagaggcaggggctgctggtaacagcgcctccatcattctaaaatattccccctggagtcccagagcagctatttctgcccagacgcaacgagagcttcacagagcttatttcaggcattgatctttcacaaaagcctccctgcttcctagattccaggccttctctagaaggggtgggggaggtagaggcctgcacatggctgatcagttgctctggctggggctggatcacttcttccaggtgttgctcattagatctcttttcaagggaaatctattagcctggagcagtggttctaaaactgcagcttgcagggcttggtaaaacaaatttctgggcctcacccctaaagtttgggatttagtaagtctggggtagggcctgagaatttgcatttctcacaagttcccaggtgatgctgaggctgctgacctagggaccacatttcagaaccagcggcttagatgcagagagacgatgttcttgtgttctctcctacttagtcttggcctcagtcctcctacttaaggcagtctgggccttttgaggttgggccaggccctgtctcaccctgtttctggaatgcagtgaaaacagctcttgattctgtgcagcccatctgtgctagttacctctgtctcccaggagaagagagcaatgaaccttcttcctccatggctctgtttccgctgtctctgttaacactgtttcctcccccttggtcctttagccctcacagcttcccccttttgctggtctctggatgcctcaacatacctgtgtggctcctctgaccctgtcctttaaatagacctttctttttattttattttacttttttgtgaaactttaagttctgggatacatgtgcagaatgtgcatgtttgttacataggtgtaaacgtgccatggtggtttgctgcacccatcaacccatcatctaagttttcaaccagcattcaagaccatttgtgttgaattctggttcctgctggtaccatgtcctgggatatttcttcccttaggggcaaagagttttctagacagactgagtcagaatcacttagtctttatctcaagagcagccttgtcacccacagtagaaggcagaattactgtggagtctaacagaaattagggaagtaagaaatttataccaaatggaaatatggaagatttatctcacttatttcaagcttggggaaatactagcctttaaatgtctgattactagagcctgggaataaagagggactgcttaacctagggaagtggtctttggtaattgggtctctgatccaattgatcggcgaacaaatctgtcatcatagagtcactggggcagctaccctcggcccaactctgctgtaggtgcctccatgacctgactagatgtagttgtgaatggagctgggattgtggagggacttcatatgtacattacgcatgtgtggaaaggtaaaataaccatcagtcttccaattagaaagccagaaagctacctgggacataatcaatgagggcaggcagattcacattccatttgggtgtgcaagggtatgtgtgtatatacgtgcaaagataaacacccctacacacatcattaaagaaaagaatggaaggaaaatcacccagatgttaatcatgtttttctctggttattgcaattacagatgatttttgtttcctatttttctgtgttttctgtttttattcaatgaaatatttttattcttccaaaaatatgttaagtgtggcataggaaatagagctcagtgccctgccctctgctcagcacctatccaaatcctattaacataccacatagttcaggttctgcctcctccaagaagactttcctgaccagcctcttgctgctaaattttggaaatacttttgctgagtgattgttcctacattgagtatatttgtcttatttcttcaagtgcactgtgacttatgcaaagatactttttctgttttccatttcccacaaggccaaatacagctgaactcattgtagatacttgttctacaatgggcagcgaatttctgaaaggatagaaaagatgtgaaaatgtgaaaaacagaccaaaatgccatttctcctcactcacatgccccacagtcatatctcaacttggttgtagctctccctcgctgagaggtcatgacctccagcttaatgtcagtgctgtagggccttagagcacatctcctggataacagtgtgcctgcgcatgggctgtgtatttctcccctccttccaaagtggtgagcactttgcatcaagcgcaagaaagatgtttgatgaccttaatagcattagtgacaaggcctccatccttgttgggcacttttggtctgctggtaaaagaaatgttcactctatccccaagagaaatcttcttttccaggaatatacagcaaaatcaatcaagtcttccccctattgaaggctagctactccacccatgtgatagatgccatcaattttttcgtcctctggggaaacagagtcattttttccttctttatcttgcatagtcagtgctcccttacaacacagtaattcccatcaggttttgagaactctgtcttctccctttaagcaaccaccctaccagaagccctcttcagttctttctctttttgctttagtgtcaaattttcaaaagacctgtctattcctgtactccccattttgttaccttcaacttattcagcgattcagtgcagtgtgtatcagcgcagaatttggctccactattctaccattagcttaattccctccatgttgctaaatccaatggacctctcagtgcatatcttatttggctttttgctagtactataaacctttgttcacctcttctttttcgaagcacagtctttccttggctttagtgacctatgtggcttttgaccacctccctggccactcttacatcaccatctctgtacaggctcatctacatttacccagctgatcaatgttgaaacaccttgggactcagcccaaggacctctcttcgtctcgggctgtactttctttcttggaggcctcattcacatccaggttttcatgggacagccacagtttgaaagtactcagggatgtgtcctctgaccaccagagaaatatttgcctctgccttcttgacatgtctcagacgcctcaaaggtccctcttgttcttcctgtgcatggccagtcctccttcaaggacctctgagatctcagcaaatggcactgtcacccctacaggtatgcaagtcagaagcttgagttggccgatctgttccacattctacctgccacactgcctcagcatttctcaaagccatccactcttgttctttacttctgtcacccaaattcaaaccatatcatgttcatggctttcatttttaaaattctggactattatagtccccaaactagtcttacttccatcagcttttgaccccttgcagtctactctgcttccttgaacagatctttgcaaaatacagacaaatcaggtcatcctcctgcttcaaaccttgcactggcttagtcttgcttttagggtgacagggtttggctgtggccccacccaaatctcaacttgaattgtatctctcagaattcccacatgttatgggagggacccacggggaggtaattgaatgatggggccccgtctttcccatgctcttctcgtgatagtgaataagcctcatgagatctgatggttttatcaggggtttccacttttgcttcctcctcattttctcttgccgctgccatgtaagaagtgccctttgcctcccaccatgattctgaggcctccccagccatgtggaactgtaagtcgaattaaatctctttttcttcccagtctcaggtatgtctttatcagcagcatcaaaatggactaatacatagggtaaagagtgtattcactaccatagcctgcaccaccatgcttcacctcatcccactgcctacagcccagctccatcttataccatcagcatccctgtccctaccccctactcatctactttttagtccctctgaagtgtcattctccatccacaacgggcctttgttcattttgtttttttttctctgcatgccacatctgaaatcccttctctcagtaacctaaatcaactttgtccttctcatcctccagttcttagcttgttatcacttcccctgggcagccttcctccaagaccagaccagatcctgctattttatggatcctcaaagcagcctgtacctctccttcctagcccttgtcacctttgtgatttaacatgtctttatgtgttattttgcttctctgcttccttaaataagctcctcaggacagggaccgtatcttttttgctcatcattgatatccttagcacccagcataatgcttggacgaagtccgtactcaatacccatctactgaatggaaaagactttggcagaagaaaatgaagtcaaccacttgctcctcagacctgggtcgagcaagccaccacacctaaatgttcaagttagaatcaagaaagttcatttgaaagtcatgattcaggtttccagcataaattatatgcagttgtgcaaacatgtcaaagtttagtaaattgaatttgtttaatgtaaacaacttttgaccaaaataataacacagctttagaaaaagacattaggcacccacttttgaagagtttgtataatttaacacacaagaaaactttactgtaattatatgcagacgtatacaaaggataaatgttatttacttgctccaccctccataaaataaacctccaaccatgcttcagcttgctgcattaatcctaatttagaaatcacccccgccgaaatgggggtgggggggggcgcatggtgggctctcatcttttcttcgcgtcaaaattagccgtttaaattagaaccacgttgggagcgtaggtgacgccaacgttgcggcaccagtccggggagcacttaaaagtagccacctgaagttaattaaaaccttacctgtcaaacccagtatggctacatttgaaaatctttaatgtaattaagagaagcacattatgggaggtcaagtgactttctttttgaattccacttctaatctgtcgtcaaatggatggaaattgccggccgagggagttaatgaaagctgcatgagcgagcaagggagcaggaggaggggctggcagcctggaggagctggcgggagggcggacggggacccctgtctccttctagcggcgaggaatgagcctgggggagccccaccgggcaacttcccttctgccaggaggctctgggtggggggttcattcagcccctctccctgagcacactgggggcatgcaggagcagggtatggggcgtctgcgcagctccctgcttatcgctaagtgagatctgtggccaggacggcggggcctggacagagtggagccggcgccggccctcgtcacccttcactcagagccgcctgattagcatcagggttccgctcgcctcttgcacggatcccccaaagagccggtggggaggggggcgcttccacgcggagcctcagctgtgcagcgcctgaccccaagcccgtcagggggaaggtctcccaggtccgcagccttcagcaccctggatctggggaagccccaagaggccctggtactgccctggattttcttctgggcatgtgggcttctgggccactaaacccatctcctactgcactaggtaggtccggctcccggagcccccagtgcaatcttaatgccagaacgctgccttttggagattaaatcacttaatgctttgctgtgtgttctagcctgagggtgctgttgacagaaggcagagtttttctctctggttgctgcttctctctctcttttttctttttgcattgcgtttgtctgtatcagcagaggtatctgtgtttgaaaaaggattaactccctcagaatgttgccacttaagttttgcccctgccttggaaactgacatgagaataaacaacatattaagtcttcacagaacactggtaccaagaagtttccaaaccagaggacttaacctccttaatccaggccttttccctttgacttcctcctgttagtccgagcatgggcagaaggcatcagtggggagaggagtgtaaatcttctagtttggaaatctcttccatactccatggaaaacattgggtgtctcctgtggggccagtgtggtgagttacttggaacagaatgggcaatctagtaggcgttgaaatattcagaagcatctcatagtgtcttagaagatccaagacctagcccgatgggtcttctctgttattagaattgtgtggaagggtggcagacgcagttgaggggatgggatgctgagagacaaggcatttattaaaacgacctctagagacttttttttttccactgggcttgaatttcttgggcttggagagttgtcactaccccatatgaaaaatggaagagatgagtgagaggaaagaagatgaggggggaaaaaaccaacctgagagtggtttaaaatcagaacagagtgttggtgagagtcagtttccaagggtcgcctcttcatgctgtattgctttttcttgaccaatgaaaagccccctttttcagatttccccccatttctcatccatagcagaaagggcagtgcttctagaaattgagatgtgtctccaggtaaaagccacacaaggcagtgggaagggatgtggctgtccccagcctccatttgatgccgcgtttctctcccagccacaagttcacaggtaaaagtgaaaagttgctctggacgtcccttccaaagagagctgtctgctcgccatggcaaccttttcctggggtctctggctgtcaagaacggggtgcaaagttcacagagctcagcattgtgccctcctctcttcttgtcccttttttcctgaagggatcgaggttggtttgcagcacagtttaaagcgaagatgccaaatgaaaagttcctcgttttaagttggtgcttatacaaagctgctttgtggtttttttcggcctgtcagacttgtcaggcctagtaagaaaaagtatattgtttccagcacttggattcctttctccctgacatctgccactctgtaaagatgataaattcctgcctcattagccaagggtgtgggattacaggctgacaacacattaatcaccagcctctgtggcaggctgactagcaataggcattgttaacaaaacttttctaatatgtcactcttctctatgacagcctgtaatcaatcattgtgattgacggcgctgatagattacactatttatactttgtgtaatgaaagatagtgtttccacctactgtcatttctgggctagtggtagaggatcagtaaatggaaacaaacataacaacagggcaagccctcattcaccccaaaatatccatagaactaccccaccttcccaagtcctaggcttggcttccacttttggaagtgaaaaagggcccatcctggaactctggcaatcattctgggatgaggggtagtggtgggggcacctggaaggacagaggtaatttggattttcacagagagagctctttgcaaaggatacgatcccaggtattgataggtcgagtttacataggtaggagagtccccaagcagcccctttccttcccctcatcagcttacgtgtgtgcagctgagcgttgagtgcctcctcccctgccagatgagagatgatttagatgttgataaaatatttgttctttcctggctctgagggcaaatattatctttgtttcccataatcgtaaggcgctgcaaaagtcaacagcacccagagcaagtacaaaaccaacactcggagagaagccctttctggaggcctttgccagggcttgcttgtcccccctgaagctcagaaaatttcaaacaggatacgaatgaatcagctgagctgaaatgtgttctgactctcacatcctcggtatttttggagggtcctttcagtcatttttattttggtctggaaagcattcgtaaaggatacaagctgtttttgctttgctggaagttattatttcaatagagtgacaaggaggctcctgggctagcatcctaagaggggagcatctttcctcgtgttggggccatttccaggcaatttggccacaagtgcctgttttaatgaatcactttaaaaatgattgtggtatttaattttccttactattgattaaacacaagaaaatactcctttattacttctttaaggtggttagggagattgctcataggtatataaatcttcatttgactcttcagtacaagcacagatgtgcgattccctgccttcccattcaatgcatttttgatctttgcgtctctgcattatatgtggattggcgaggccaagagaggagagtagtaaggaagcagagtcgtcgtcctcctcctgaacgctgtggtgttgataggcatcagacactttaggtcaccctgccagttggcaaagcaaaaggaacctgagacctacccctagtgaaattgccttagaggcggatgagatgggaggaggtgcagggagacagggagctaaactttaatctctctgtgaagtttgagtgagcccaggatgattaatgagagagcagaccatctgattaagcccctctgtgtcatagaacatgattagtaggtgacagagatggtaacagtatccagccaaacccttgtttctttcacagctccggctgttatatgattaatgtccccaagggctatcttggggtcaggcaggggaacctgtcagaacaggtggaagtgacaaaatgggcagaaactcctaagggggactggagtggtgagggagaaaatggagggggcagggcagccagatggagccggcgacctttctctgatccaagcaggcacagagatcatcgtgggaatggaaacgaggaagaatcacaaaactgcagatgtttcccaggtcctcaatgcatcaagtactgccagctcagacttgtgggaagcacagtgtgacacggcgcgttatcactcgtggtttatgttctgagatggaatgggatggggccactgcaggccctgtgggtatgaatgtgggatgcccgcacctgtgcctgtgtaagcatgagtgtttgtgcaggtacactaggacaagtgctccactctgctgggggattaagtatgtatcaaacgggtagagctgatatttcaatttactgctttctggggccaacacctatacattgtcttgactgtgctacttagaaaagataatatgggaaaataacatggatttacagaattgaaagttttaattctgtaaatttacagaatcaaaaggtttttagatttaaagtgaactgtagaaatccctaattcagataatccagattacaggtgagaaatctgaggttcagagaaggtaatgacttgcccagtggaagtcaagactagaaccccaggcttcctatttccggtttcatatactaaacccttgatgagtctgttggtaggaagcctcagaccttttcattagatgtgagtttcccagcaagacttgagtctttactctccttatcatattccctctttcccttcctagaagcactttgacctcccggtcaaaggtttaaacctcagttgaaatggagtctcattaagtccttttgggcaagcagccttcccagatgtcaactttgagaggagactatgctctcaaggcagccgttttgattgacaggagtcctgagggtagccatttttacattaaagggaaactggtttgtattgagtttcatctggtgagcctggcttctcttcttccacctttgatgccctatgtgtctgttacatacattcaagagtcattcccgggctctaatggggtctgggagaactttcatctcagccattttccagggctctcttgggtaaccagtttccctttgttattcacgtctatccaataactcttgctcttatgttcacacaataataataataactgggttagaacctgggctgggcagtgaccagccccctacatctgcttgatctctaatgcaggagtttacaaattggaaatctttgctagctaggaaaaagatcaccttgcagtaggattttatccataccaacagtgctcgtgcttcagtgagttgcaactgtggacttaatggcaaagctgcactcagtgttatgatcacgaaggagggagaaggaagaatggagattgtattggattttactaaattgtgtcagtgagggagtaagttgaataagagacccaaccagggcatattcataactctgtctcctgacagtggttgattatgtacaattttgatgttgattatctttaaatagctcttcttgttgtgggacaaactgggagatctacctcacatgagggtaaagtacaaaggatactaaaatcttcccagagtagagtccccatgattctgtagcataggctttgggggatcaattatggataaataaatgttcattagcttcagagctctagtatatgatttttgtcatgggtttcacctcagcatcatacagcctttccaggccaagaagagaatgacctagtgctccaaaaacagtcacttaaagactggctctgtggccttcgagtgagttatataaaatacaaccaagatgagactgagtgctttccatggtcaaagggaatcatctaggaccaaacttttctgtgagctgatagaaaaatttgagcaaactttggcagactgatccaagaagatacttagcctttactgtagtattcaggatattgtcagacattctggtgtagtgtggtggtggtgaagtggtgatatgttttagtacagagttcattggttgctttggaggatcatgaagtgcttgtgcctttcccctattgctatataggctgagatgccaaaaattcaggctttcataacccacaataaaacctcatcttttccaagatgttgacccattccctctgtgcacactgctttatggtagagacttcctggtagagccatgctgttgtggaggtgactcccagctttgcttttagtaggccctaaggatactttggggtgtcaccatgactcactggtaaaatttgggaatcattttatgagagaggccacaagcaaatggtgactaatgatacagtactgaagtttgtgaatgatgtacattcatgtaaattagaccagattcactttggctgccttcctctgtaatttcttgagcagagagagaggagtggagttaattaacttagggagaatcacatctcaccttaagggagcccttgggagtgggttgggctctataaaatcatcctccaagcacttgggcagagacatgtttgagaacttctatattaagatatagtgtgctaatgttattacccaatcagagtgtgtgacaaatagtttaatgaagaacagcaaatgttctgggtagcaggtattcctttacttaaaggcgaagatgagctatatttaaaattcaggaaatgcaaacttaggtccatttgaggctaatacatacacaagattctgccttttcatgacagaggaaaacataagaaaaatgtagagtgcaggagacattcatttatcttggaggagaagaccattctgtggccccatcagcctggactcccaagcccagggtaccaagccctcttattcccttttgcattaaaaacatcacaatcatatcttttttatcctgttatttatttttgagactctgaaaatggatttcttttgtgggtggttgtttaaagaaaccagcacagaaaaatcagcctgtgcaaatacactttttttttttttttttttttttttgagcagtgattttctttttgtagttcggaacttgaggcgaatgaaggtctccctggtgccctggtagctgcagcccctcttttagcattttttcaaagggcgcaggccaatctgcccataatgagcttggaaagtgaggatgaagttcctgataatatgacacaaatttctttacttttgctccttattttatcttaattagtccctgtagaaaggattgatttttgagaggcttgtagtgaacatctgttggtattcctggggtcattcttagcctgtcctgtgtttgacatttcttgtaaaagaggaggcatttgttcatattgacattagctgcctctgtatctctcggtggtacagatggtctgtgaataaagacatcaagctaataggcaagatgacaagcttcaatggagccaaggctcctcacacttaaatggcagggcagcatagattgcttctgctgctgaggctggggtctgtgggtagcaaagcgtatggaataagttaaaaatgaagagggaacctggaaaatgactagaaatctctccctgaaactgcaggggctttttattactgttttcattattattactggtccatatagtatgtcaagcttccaagatgtccagggtcagggagagaaagtgaaaactgggttttctgcccatcctgtgaccatacatttctgtcaaatgggcatgctaatctcagaagggagctattgttctcactttctggggaagtacattcatgttcctccttccatcagaggacagtcactcttaagtctagaggctgattccccccaaacccatgaaaccatgttttcccaagggacttccaggaaagcagcactctggaactttgtaattctgtacattcctgaggttctgggctttctccaaaatgcatgtcccagtttggtataataattcgtcatggctttggcatgatgaatctcaatttatgtccatttatattttaatcatgaaccagctattaagacaaagaggtttttcagttgattcttaccaatgtgaaatgccatatcttatgttacctagttcaagtctgaaggggagcctcccagttctggtgttgggtggataagccccccatttgttagggtctttttatcagtttctgttgtattcttgcagcttctatcttcccagatgctggaatcctcatatagagcagccccctttgactcaattacctgtatagcttttcttaccttctcctggactctctttgtatctactatacattctttattttccatttgtacattggtgacatgtctacaggtatgtgttgatttttttttttttttttgagacagagtctcactctgtcacccaggctggagtacagtggcgcaatcttggcttactgtaacctctgcctcccgggttcaagtgattctcccacctcagcctcctgagtagctgggactacaggtttgtgccaccacaccgggataatttttgtattttagcggagacaggattttgccatgttgggcaggctggtctcgaactcctgacctcaggtgatccacctaccttgacctcccaaagtgctgggattacaggcgtgagtcaccatgcctggccaagtatgtgttgatttttaattttcatactgcgccatgtttcatggatggtttgaggtagcttataagaataaaaactataaaacaacaacaaaaataggatcttaccagtatattggaaaatatttaaaaatgggatgatagcataagaaatgctgtttgatgatagaaagaccaaaacagtatgtgctgatcctcttaggttggtgcagattaggattattttgagcttgtacataccaaggacttgaatcaagaccaatagctttatgtgagtgaggtaaaattagctctggaactgggtaggtagataaaaacaatttgtttcttggttgattgttctttttttttttttttttccaaagagacggagtctcgctgtgtcatccaggctggagtgcagtggcgtgatcttggctcactgcaagctctgactcccaggttgacgccattctcctgcctcagtctcccgagtagctgggactacaggtgcccgccaccacgcctggctaatttttgtatttttagtggagatggggtttcaccggattgctttttctttatcttagacattagttgatattgaaatgtttgtatgtgttcctcacaccacccgcacgtaggatctcaatttgccagctctaggaaatgggagagacctatctaataggtatctagtatcttcaagaaggaggaggagctatggaggagaaggtgatagggagagaacaggggtgagtagaaagaaagaggaaggagaggagaaaggagtcctctaattcgcctagataatggtaatattaatgagatactctagttaatgaggcaattgtctggcagagggcgttgttcagtatttccagcccatttctgtgggcttgaggcaccattatgagaagctgaatcagatgtttagaaggaggaaaaattgggcttccaaaaggctgaggccagaaaacagtcaatccacaattgtctgtcatctgtttgatgcagatcagatggggacatggccctgccttggtttctccattgggactgagttctggcttcatatttcaactctcctgacacctgagagggttgtcatgaaatgagaggaaacttctccccttaatgtcattctcccatgccaacttggttttttgcttcttagtcactgtttctgttttccccagtacggtgaattcccccaggatggggaccagatatccagtattagattcagtcctcctccatgtggagtcaacatctttttgtcagactgggagctccctaaagacaggaatcaatgtattttatatcattttaggagcttctcaaagaaagcaattattcctctcctcctttctcctctaaattctatggttcccattggggatcatgcattactttattccacaaacatttataaagacctggtatgtgccaggtactgttctaggcactggagatacagatagactgagttcctgtccgaggagcttgcattttggggtggaagtggtaagagagacagataataagtagataaataaatatgtgtcaagcaggaggtcatgctgtgacatgtaggatgatcagagatggactttcagagaaggtgacatctcatgctaagtgatatacaattatttgggcaggtagatgagagttccaggcagagggaacagcaaatgcatcttctgtcatctctagtatctccaagggagtgtgagagaccaggagcagcatcccaggaggcccagggtcacctgatcaccttaagtctcagaatcagatgctcagacatctgctgcggcagattgtctcctgcttgggctgtgtccagtctcggtgccagcagcccttttaaacccatcggcaccttcaggtgttttccttcccctgcctgtctgtgaggtcttttaagactttggaactgggcaatctaggtacaaatcttgtccctgccacatgatggtcgtgtgacattagggaagtcacttaacttctttgtgtctctgtatatccttatctgtaaaatggagatgataattgtctctagttctctctagagattaaatgagttcatatatgaaaatgcttagaataaacctgcatataataaatgctatacaaatgttagccactattattgttgctgttgctgttaacttgttttagcaaatgaagcatctctcttacaatgcaaagccggcctctttcccagttcatcctcctacttacctacaaaatgagggatggagatgaacatgaacatgaactctaaggatttttttgttaggcttgcctttctgggttctactctaagccacattcagctcaccccaactctaaggctgcaaagctgattcggcatttagtagaccattttcctgctcatggtccatggagattagccttttctctttagctctaagttccttcagggcagggatgaaggttccacctctgttatgtctcctggatcatctaggatgatccgaaggattcccagatctgggcattttattctgtgcttattagggatttcagaaaaatgtgctctcctcatgtttggcatgcaatcttttcaacagtacaactcttcattctccatgctatcctctggtggaggcagcatagggcgctggctaacagacctcagacttgggatccacgtggtttgggattgaattctactgggtcagtgactttggggatattaatgatccctccttattaagaaggttaacaaggcaaggcacagtggctcatacctataatcctagtactttgggaggccaaggcagtcagattgagcccaggagtttgagaccaccctgggtaatatgactaaactttatttctaccaaaaaaaaaaaaaaaaattagccaggtatggcggctcacacctgcggtcccagctacttgggagactaaggtgggaggatcacctgagcctgggaggtcgaggctgcagtgagctgtgattgtgccactgcactccagcctgggcaacacagtgagaccgtgtctcagaacacaaaaacaaaaacaaaacaagtcaatatatgtaaaacacagaaaggtgctgatgagtggtctacaaatggaaaccattgatactgttattgttgttagtgttcttccagtgtgctttatacataaaaggttctaaactgtaggttaggatagtccttctctgaatatatataatctgtgaaggaattctttcactcagaggtggatgtgaggcagcattctgcagcatctcagaaactggtgctcattaaggcacaggatcctggctgaggccagtggcaaagcttgcttaaagatactttgtcatctttccgtgtatctcaaactctgtgccatgttaggggatgcggcaaatatttgcagaatgaattaataactggttgaaggatggatgggtgaaagatgagcctcttctgtcttattattactattaccaaagaggcaacagtgctttagcttgttccttcccctccctgatcttttctctcccactccaccttttgaaacttttgttaatcttgctttcttctaccttgtctcatttccgccttgctttcctctctcctctgccacctctcccatcgtctctaggcccaaccatgactctctgtgtctactatttgtcgcttctgccatcggtatcaagtactaagtatccctcaaatccagagtattcacagtgcagtgacccagatgaaagggggttgggattttgctttcttcccttggtaactatttctcaggatgacccagaattcatttgcttaggtaacaagacaacgaggtccccctccttcactttgacaccatctgtgtcagtgttttgataacagtccttgccaagtgtatcatggctgaaattgatgctaccaggacacaggaaactcacaccttttctcaggctgcctttctttcctctacacttactgctgtttaaatgtcaccactcttgaacaaacagtggagtaatgtgtcagggacagctaatgctatattttggtatgttcttatcaaatcaaaatgcctctggcaagctatttgcctttgataaaaagaatcctggtcttcctggcagaactcaatagtaattgaaccaggccacacccttaggacttaggcccctgtgggtgtcctgaatccagccccttggccacacagtagggtttgggtcaatgcccttagcattaacaaggctcagtagtctgaattcttttcagatattgactgctccccacgtctctgagaaggactcgcttttggggcctcagtttcaccatttggacagtgaacttccatgctttgccagccgattccttaaataatctcaccaaccatctgcagataattgctttgtgggtagcttatgaacagcagctgggagctgcccagtccccatcatttttgtctcaaaagcagggtttgggggccatactgtcagtagagaaatgtgtgctataatcattattacttatgacatttctacttaactaagaaggcatttccaggaaatatcttttaaatcagtaactttaagaagctgacgctcaaaggggatttagaatctggattatttttctgattcaaattatcttttcttttggcctttgaagaagcaaatagatatttatttctcttgttccctcctctgcaaatgcttaattgattttattcctgtcagctgactgcaatagaaatcgctgtttccacttcttcctgttaacaccttttctgcaggggtggagggctagggggaagctgggacaggtgaatgtcttcttgcgttcggctgtgttgtgcatggagaagatttggagaattttcattcttccaaaattatccacaacactttgaaatgaggtgacctcctgttcggcaaaatgttgatatgatagtatttatgaggacagtttgctatgtttacagaatgtatatttggaagttgcatgtactaattggattttgaatatttttgtttctcattgtatcacacctgaaatgatgaaaggtcatttaataaaaaaaattgaaccattgatgcctgagtggctgcccagagtaaaattgcctaccatctgtcaaggcaggaaaccagagtacagtgaaggtagggggagaggctcccaaaaggtggggtctgtcacctagaggaggagggcgtgatggctggaaggggtagtctgggtttctggtgactgtgtcccacatcaggactgcatgcagctggagggacagagcttcaagcaagccatcccaagatgactgtctcgacctcctcagtttctgtgaagaggacatcactgtctactcacagagcataaacccagaatgttttgtctgtcctactcctgtagacaattcctcccctcaccagtggtgaaagagccaatacaaagtcctgactatatgttctgacttttcctagggggcttaaggaaaggcaggggagtaataagcctctgctttgagaagccacctccttttcccctttgttcttggatagctatggaatgcaattatgtgcatttaggacctttcattgggctttgacattcaaaccacacacatgcccttgcaggttgaagagagaggggatatcctgactaacacattcccggactgcctcagagatggagcttcatgagaaaagcctgctctaggacttgtgtggcctcgagagcattgaggttgttcatgatggagctggcttttccagttgcctctgaacctaggatctgctttctctctccttcccacatcatagattgaatactactctaatgtaatgactttggctttttgtttgtttgtttttattcacaattgcagatagcgcataggcattctgcatatatcaatcttagggttctgtttgttttttcatgaaaacattgctttgttcagtgccctgtggtataacctgtggctgcaggaattatagaactgctggtaggattctttcagatagcaaggagaatattgcaatgaaatatagagaagaaagagtccgctcctgctggggtctttcatccagccaattgtttcccctctctccactgcctttctcctctctacatctgggcttctgtttctttttgtgtttctccacttctgtacccacactatcctttttccatcttgcaatacattttgttctttttgttgctccatgtaaggggcctcatggattgctgaccagcctattgcaggggttgcatttagctcaggctttcctctgagccatttagctgtgggcagaattgtggagttgcatgttaaaaaccacaagagagctgtggttatgacaggctctctgcatggaataagaaaagaacaatcttgggcaaaaggctctcagcattcttcctgatagcactgccaaccaaaaaccaccctaagcagattgtgctgaaggttggccacttctcagtccagatacctggctgaatgtttccctgaaattgagcctggggagcagattttgacttttcaggctacttgctcataaagccaaccatgtggatacaaaattgctcacataggaaatgccaagtggatgttcactgttgcagccattatgagcgctgacattgttgaggggacatcaggatcctgtatgcctgcctagccactgtggcttgtgcaagtagaaataaggtcattttttaattcatagcagagttgccagatgatcttaataagtatgttgtctcattatttaaataccatctcaaaaaatgcatatatgtgcgcaaatatttatacacatgcatgcatgcatacatgcacacacacattcatagtagaagcactcttaaccaacttgcatttcagcaacttggcgtattcacccacgccagccatcttcctgcgaaatatactggctgcagcacatcaccctacagatgcatggcagggcacttctgttcccaccaggtgaactgtatgtttaccaagtcagctgagcctgttcccaaacctacttatgttagttgtgtttatattgtaataatgtggtttaattaaatgttataaaaccaatgaaatgaaagagtgcagagtttttttttttttcatgaaaactaaggtgaatgtttggcaagactcagtgtgttttagttttttgaatacactcaaccaagtgtagataaggcagttgtaaaagcttgggaggaaaaaaaaaatcataaaattctagaagaagtctgcactcagattgccttaggagacttttaaagttctagttcctctttaaagaaaacaaaacaggaaattttagagctacatagtaagaatggtttgtacaaagtagtccatgctaagctttagtcaacagatccatatgcaaaagaaaagacctaagcctatatggaaagagcagcaaattaatttgattcacatgatttaaatcaaaatgtttacatatgaatgtagcattttaaccaacttaaaaaaaaacaacaacaacaaactagccaactactggttcagatcacagtgtataaagtgcttctgctcactaatacttgcccataaaatcaaagtctggtagttttgtttagaggtgaaaggagagaattggcaaagaaattaattctccaataacttgcctggattccatttttcttttgccatggaattcaggttctagatggtaacaggaaaagcaggcatttccaggtcgggaaaagcgggttctagatggcaacaggagaagcagaaggtgtgtgtgtggaggaaaatgagggttttcagaccctgggacagctcccaagtccgccgcagtgttcctgctggatgcaagccatgggggcagcacagatgggaaaccctgagttggtgtggatgggaacaatgaagagcaggaggctgaagttctgtcaatgcttttcaggtcaagagtgggaggtggctcaggaatgtggcccctgacgtcagcccgtgcaactcttgtcaacaaagagagctcccagttggagaaattaaaagcaaactttgactgggaatgtgtgggaagtggtagctcagtgagtgaggccagatgccacatcagctcaaagtaaagccatgcacttggctttactgatggagatgatggatgtttatgatccccagtgtgaaaaatccttgcaatgagatccatccctgaactcctcttctcccatctgtgaagatgcccaaagactctagactggccttggagcagtccctgggcatagcatgccctagagtacaaggcgagggacctttttggttgacacaattccccactgtctagcccagagctcatcagggaggcaatcattaaagacgtgaaagcgttgagcaggatgtattctatctaaggcaaattcatgtgctagaggacctcctggctgtgttccaaggagcgtctaccttattctaacaattgtgagggatactcagtggagtccaattggagacttatctatcctaagtaaaataaaccctctgttgcacatatgaaagtgataaataatttaaatacaattttaaaatattggtgcttctcagcatctcccactcctcatggttctctctttgacacctccagagtcccctagaaagggtgactttattctcaagcatcattccagtgtgcttcctaaccaataccagcagtgccagggccatccaattgacaagtgaaccctgggctgctggcccacccattattgtcactcatctgtgggctgatacccccttcactttgctcaagctcccagcttggccattggtgctcctccatcctgcagtcctaccccttagcctgccacagcccttgacttttcaggcccaccttcagccaggcctcactctcctacttctggccaggctgttgcccaaattgccatctccagtgggtagaagactatttatagctcccactgcaaattggttcggagactgaacgctggtctcctgaaatagacctttagtgtggacagagctcatggcaaaccttcttgggtgtagggtactcagctctgtccccctctccctagaggatgtgcacatggctaatgctacaggagtgggggtgggttctaagaaatacccagaaccactgttcactcctaccctcaggtccttttgctaaaccaggcttgtttgtggatcttccttccctaggagtgggcctcttctcagtgtggggttccacagttctgctctttaccagtggggttctgtttctcacctttccccagcacccacacttgtatatacctacacacacaccccttccactgccatgccttccaatggtctgggaagtgttttagtgggaaatagtctaaagtagaagttcatagcaaggggtcttcaaccagactactgggattcaattcctagctcttctactctctggctttgctaccctgggtaaattacttaacctctctgatttcagtttcttcatatgtaaaatggggtaataaccatatttactttataaaggctattataaagaataaatgaggttttcttttgtattttgaggagtacctggcatgtagtaagcccttaataaatattaactattaatataatatctgaacaccagtcactgtggctgctcaaagtttttttttttttttggacacttcttgactactgtgaatcagtagatacaaaagatactgggtgcaggacgagttcccagcttcatacccaatctccacttagactcatccagaatattttcttacacctctagccgtaaatattcaaaaattgctacatatgttgctagcccatcaagttattagtaaggaaccccatttgggtaggctactagtgtggaacctcacctctgttactctcagttactctttgtgtttaaaatgtcttagaattctttgtatctttaaattttaattagggattgataacaggttctgataacttgtaaatggagactgatcatttgttagcctgtgttttgatacgtagactttaaaaaaaagaaaaacttcttcggtcagaagctgttgttctgtgaaactagaccagactgtgttttggcttgtgtgagaagggaaagcatattgtttgtaggtgaacagtttgcacgactattgtgataatctatcctgtctccctgccttctgtgtctacccagcttagcctatctttttttttatgagacgaagtttcactcttgttacccaggctggagtgcaaaggtgcgatctcagctcactgcaacctctgcctcctgggtttaagcgattctcctgcctcggccttccaagtagctgggattacaggtgcccaccaccatgcccagctaatgttttgtatttttttagtagagacggggtttcaccatgttggccaggcttgtcttaaactcttgacctcaggtgatccactcgcctcggcctcccaaagtgctggaattacaggtgtgagccaccatgcctggccccacctagcctattgtatacaatgcaagtggagtaatcttccaagggcatgattttgattatgtattttttcattccggaaagcagcgagggccaccccgttgcctaccaaaaatgcacatttatggtccatggcaacctgttgcaccttaatgggtgagagagctgctctttccactgcccccttcaccatcttggtgcttccgccgaattggctgactcctgcttgtcacaaatgctttttgccttcttctgtctctgcctttttagttcccacccacccactttcctattgtatccttgtctggaacagcataccacattcctgtgcattgttcaggactcaatgtaaagccacttctcccaggaatctttccctaattcctctcagccaaacagaatcacccctgaggtgccatagcccttcatcccccatcacgtgggtatcatataccatttctagtgtgaggtataaggatattttcaatggacatttttatgtttgaatcttgtatatacctgcaattatcactttaggaaatagtcttagaaatatttaagatctttgatgcatattgcaaaattgccttttaggcaatattattccatttattctctactgtctgtgtattggggcccattttcccatattctctataaccctgggtattattttcttgccaccttttgctattttgatggtttttttttttaaagaaaaacctttgttttaattcatattgcattgctctaatttctagtgagactgaacatttcaaaaatgtgcttattagccatgcacattctctctgaattgtccgttgacagggcacttgacactttatatcatagtagttttgtgaacttgtcagctaccaaggatctatacgacaaacagctatactgtcagcccagctactgtgcttagaacatgataggtatgtactaaacatttgttgaaaggttgagtgaatgaatatatatggctgatgatggttaatgttccttaagcatttaaaaatgtgtagactctaatttacctccagtacaacaattcaagatgcaaatcttgaatgcaccattcagtgtgatcatgacagtgcctttcacttagtaagtcttccacttgtgaggttggttaagaggagtgtgaggttagatttgcaaacataaaaacctctggggtagggaggtcttttggtcactctctatgatcctggaacatcacgtgctctttatttatacttctggacttcaccaaaatagaggtggtgattttggagcccaagaagcaggaaggcagggtgagagcagacctgtgcttgagagatgtctgcttttcagaggagatggtgtagtgacaacttcagggactgatgcctggctattaggatcgagtcttcttagatgtcagctcatttccttgtagaaaatgaaatctaatgaaagctggtttatctggtattccatcaagcagaacattttttattacatcatattcatacgaatgaccctaaggcacagcaagatgatgttcagggtcacattggagttaaaggtcttataaattatattgtcattcttttgaaaattggtgattgtggcagatgtggtaattttccattcaccagaatgcctgagttaccaaaagcaaagatttctgcagactgggaaagttttgtgggagcgtgtatgtttacatgtgtaggtgagcgcatgagtacgagtatcggagtacgagtatcggaggaacaatgagctggagtccactagagagtgaaacttacagagtcttgaccattcatcattctgattctcagatttcaccagctgacaagcaccttcttttttggcggggggggtcagagtttcgctctgttgaccaggttggagtgcagtggcactatcttggctcactgcaagctccgcctcccaggttcacgccattctcccgcctcagcctcctgagtagctgggactacaggcatccaccaccacgcccggcttttttttttttttttttttttttttttgtatttttagtagagacagggtttcaccgtgttagccaggatggtctcaatctcctgacctcgtgatccgcccgcctcagcctcccaaagtgctgggattacaagcgtgagccactgagcccggccaacaagcaccttctaagggtgacttcactttggaattgtttggttgaagcaagggaagtaaggaaaccaaaacctcttcaacgctatgctaagtgttacttaatctcatttcataaaggaaatatgaggctggattatatttatttcgtgtgtgtgtgtgtgtgtaaattttcttaagaaagcagtaagtggttttttccttgtatgcaggtagcacctgccaacctgacctgttgacagataattgcttgacagcctggcctttgatgttaagcgtcacttaggcagaaagaaagtttccctgcacctccctaccagtcctgggtggtcttgtctgctttccttccccagaaccttgcccaggaaacccatgaattcaggcccccgggtgcaggtagggtcagcaaacgccagaccactccccaatgtgtggagagcgaggaggggcctgcaaactctgcttaaaacaaacaagtgctaaattaaaaagaatgttaaatacagatcagctgcctggctcctgacagcagatttaattcttccctcctctcacctgatggagcttcgcctgcagggtttgcatcaattactcgacgacatgtggaaaatgattgatgagctgcctgcggcactgaagtacactttgtcaaccgctcatcatttatacatcttatctctgccagaacaaaagataggacaacctcacactgaagttggggatgggaaggggggagatgaggatgggggtgagggaggcaagtcaggcaaagttgttgggtgcccacagggacgagcttgggtggtgaggcccctgctgttgcctcagaactgtctggtcagtcagctctgccacaggccctggctttgccaaagctctttgactgtcctcacctcccccacccccaacaaagtccaggaacagagaactgcatgctgttttaattacagcataatctcagagagctttcgaggcactgcagccactctgcagctgaccctttgctttaatcaaccactcctaaggcagggtttgtaaccatccctgacaaagatgaatcacggcccgtggatccagtttctgagagaatttcggggggagctgcccaggcagcagcggctgttggggccagcttttgggaaattggggcatctgatgatggtgagacttggcggtgatattcatggttttatttcaagccatgttcccaaggccggaatgagacccaaatgtttttgttcagattgagatggaaggttggtggtgatgctgactccttgtttgttccccagctgtggccttaggactaagacccctcctaacatgggaacaaaaaatatcacctcgcatatggctgtcttctctttcctggggacactattatagccacaaatccaggtgatgacctaacaatcatttctaggcaataactgctgaaaatagctattttattatgagctgatctctattaattcactctctattaaaggcatcccatttattgatttttttttctttgaaagaaagggtactgacaaatataaagtcaagtgacctagttatataatttgagtgattgacccaacagattccttagtaattggtcagggggtggaaaggaattaagttagaaaacttcaaccttataatataataggatttccctccaataaaatttgatacattacttacaaattgctaaataataaataagaatgaaaaatgaacatacctactgaatgaattataaaagcaagtaatacaactatgaggcaaaatcatgccagaaaagaaatagctccacataagagaattatgaaatggaaaaaggactcaatacccaggagaatatttctgcggcctttgaaaatttaaaaacagtattttgaactcttccaccagtttagttggtattgttagaggaaaggttttacctatgctcaagaatttgtagatgagataacagtgacaggtaaataatcatcatgatatcaaatgtttttataaaaatttcatggagcatgaattatactatacagaaggaccctcttggaccagaagagaagggcagccactgaggatctcataatgcccacaaatgtgctagcgttggcagatcatccatagtgcgtctctgttctgaatgaaagaaagcccttgcaggcttgatgaactgcaaagggacagcaccaaatggaggcatgtggtccctttaaggtggaccttaagatttgatttcagatttaagtggtagtcctatgcaccacaatgaatggagttttacattttttgtgcttttgataacccttcaaggcttctatcttgggaaatggtcacctatttggtattcattttgaaaggtttgaaagctatttgtattattttcctaaaactgctgtaacaaagcacaaccaactaggtggtttaaacagcagaaatgtattgtcttacatttctggaggccagaagtctaaaatcaatgtgtctgcaagggttggttccttctgagcgctgtgagggagaatctattccattcctgtctcctagctcctgacagcctcaggtgctccttgacttgtagatggcatttttactctgtcttcaccttgtcttccctctatggatgtctgtccttgtgttcaaattttctttcttttttttttttttaaggacatcagtctcattggatttgggcccatcctaatgaccttatgttaaattgatcatctgcaaaggccctatttccaaataaggttacactcacacttacctggggttaggacttcaacatctttttgggagaacacaattcaacccataattgtattacccaagaactttaattcgagagattctaccttcagtgctttatcttgtagtttaaggcatagattgttatcttgaagcaggagtcgtgtcatgtctgatctaagagtgggcatatagtaactacttgataaatatttgttaaattaatgaatggatgagactttaatcttgaacttccttggaaaaggcatttttatatgacatttgtaccaggaaaatttactaatttacaatttatgaagtcaatgaactccagagggacacaaaagttttagcaaaaaaggctttctttcaaaaataatatgaagctcagagtgtggccatttatagggaatcttctttttgtgaatggcactttagagagaagaattccctagataattctgtttttgcagaagtcagtgccttgtgctggatttattttcttgccaatacattgtcacttggggaaaaaattccccatggaaactttatattataagtttgttaaaactggctcaatattgtttatattatctggttcacatgctgatatataagggagattcaatattatgagtaaactattacctaatatgtgcaaatgattgagtcttgagttagtaaggaggaaggttttgtgtcttccagaaacatatttacatacaagtgaacttttaaacatattaaaaaaaaagcaaaaatgactatatttgataaaaacttgtccaaaaaatgtagatatagcaagtttagagattaagatgtttatttgtataaaatagatgagcactttttgttcttaaactttctatatttatattttacataagtttttaaaatccgatacagtcaatatttgtttattaaaattatatgatggaccatataatataccaggctgaggaggaccaagcgtatcaataccccaaggaagcacgtccatgtgggtaatgttaaggatacctatatgtcaggccctaaccaaaggaggtttgtggaacttggagagatccaggaggtaacaccaaaaagctgcatttagcaatgcctgcctagccctcctgtacagctcatgttattttgttgccttaggccaccttacaccaaaccattcctatctccatgcttttgtttatgctgttgcctccttttagaagggccacgctccaccgctctgctgtgttgatactaccgacccttcctttagttcctgttcaattcccaagccttctgccaagccttcttggacattcccatcccatgctgactattccttaagctaaaacccttagagttaatatgatacacttggctacctcattgtttcatatcagtcattcctgtctctagctataatcggctcagccaaggaagatatatttatatggacaatgtctttgtgccttggctgtaaacagtgttgaataattaatctcacttgatgaggtcttacttaatgatagcctccaattattcaccaagacgaggggcaacgatgcttgtccattgtctgtgcaggctagactggaggaaagggccttggggaggaacttaaggtagatggaatttgctgatggaaatgttatttacttgatcaaattttccactggcattggtacatacttccctaaagagggttaaaaataagaaaggccctcctgggagtcaggagaagtgatgagatgtgctgtagctaggcccttcctttgtgaaatggagtttatgctatagccagatgtcacaatgctcaacaaatgactgaagtccatcgtaaacaacaccaaaaacaacgaaatgcatttattttaaaactactattttgaaaaaacacagtccctatggcaaaaaaaaaaaaaacaaacaaaaaaccctaaactttgacttggggtgacaatgtgtcggaatcctggcaaggctgaatgtccctttaagagacttgatcagagagggatccatcaacatcccaggggttggctggggggactgtgattctaaaattaggaacagaaggaagaactgaggagcggtgagaactaaattaggagaatgttttaggaagattataatttcagggaggatagctcataggagttgtgtattgcccttttgcaactgtagacattttttaccttataattccctgtttaaacctggacaactttaattggggattaaaaaattatggctgaaacacagagccatgttctaatgatgaagggctgcaatttacagaccaattaggatggcatttgttttcattctgcagcaactttttccccccagtgtacccctcaataacagcaaaacagattcctgggtccaaaagtggttttccggagctgacagctgccatatgcctttggctgacaggtgggggacaggttctggacagcttccagagaaccactccttgaattttgcccattttgtagagccactctctctgcaaaacaatgccatttaacttcaagctctgacaccttgcctatttctacttcactataaataaacctactccccccatttgcttgcctcccccaggtcaggcattcctcaattatagtcttaaacctggccaagcgagaacaaatggtgaccttaagttatatcttaaagtcctgcctcatattgggacgcagagtaagtttttttggcattctctttgacaggctgcttgtagatagaacagttttccataaggaattgaaatcatacatcaaatgtattgttttatatgtaagccactggagaccaatgaaagcagttggtagagcccaaataccattacaaatagatttattgtagtgtgttttctcccacctttttctagaagttattactttaatcttaagaatttatgtaagtatgcttgtggcttttatatggtttatgcattcactttggagacttttagctatttagtggcgaggtgtttaaaacaagtgttatcaaggaaataattttggctttacatcattttttttatatttgcctctgaatgctacatatagaatagccaatcggcaatataaaagagttactgtggatgtcatggaaacttatctttccagtgccctttagtttggtgtgttcatctgcacctccaaaaagcaagcggagataaacatgctgtattcctttgctgccaaattagaaaaagctctgtgccttccttcctgaaccgtttcaaagacagacagagaacattagacttcacagcaattaaactcactgtagtgtacatttactaaaaggactggaaatctttttttcagccagccccacagtaacagagctgttagaaaatttaaaaagaaaaatcctgaatgatgctgttagtagataaattaagtgatcttgcaagacccttctcatttattatattaatacttcaactacatcatatttagttaaaaattttttgcatattatcctacaatttaacctgtttagtaatttttttttcacaaaccccttttaatttaccaccttcctctacacacgcacagacgcacatgcttacttactctggtttcaaatattatgcataaactgatgttttgatttggtagccataatttctaagtctgttgatagaaacttgtcaatcatttccaaggcaatatgttgccatctaactgttttgatatatgtgaagctcttgtggtttgtctagttcttataaaaatactgcgtatcccctttgatccttcgtgtactttcaaaacttgatactggtggggaacttgactcttcagtttcttttgaacttgttttagaattatgacagtgtttttctagtacagaaaagtagacacacctaggggacccaaagagacctgactgttatgtcaaactaagagtgcacgtgttattcttctgacagttattgagattaaaaagcaggttagcagttttcttagaccatatcaggccctgaagaggagacagtggcttttaaatctctctgtggagcatgtttaggagggacagtgcctctctggggatggaggtgccttccagttcaaatactgtttggaaagtggggtgactgaaatcaattttctgaccctgtttgtgtcatcttccagaacacaaaggactcttttcatagacttttaagtttaagctctgttccaatctgagccagtctccaccctttggaaaccagaatatgccaccccaaaatatgtctctctagcgtaaggattattttgagctgattatttggaggtctacagccataggagaagcgccgacaacagaataaaagttaccctgttaaaagggaaatttacatctctcaagggaatttccattcatgaaggtggcttctgtctgtaccaagaaaagaaggctgactgcatcaccagagactcctttcactggagaaggtgccagctgaaatctgcagaacaaaatctgaaatctgaaatctgtttttgtggaccatacttcacctgaatacctacccagtatatgtctccctccactcccacccaacatccttctttctctgtttcatttcaagatggtatttaagcctgaactcaagccacctttttaagatttgctcactttttttctgggtatctcccttgtataaatgagttatcactggagctcagaaaacagtaccccaaaggatggcactttggcagcatgggaactttgaaatgaagcaaatgaaaagatcttagaagcagcttcagaaccaaagactttctcaccttctgtttctctccccaagtacagggtggaactctctctctctctctgaagttctctcatttgaagcttctcgagaagaatgaacacaattgccttcaatctcctccctgaaatttcattagccagaaaagattaaactcatattgcaggaaggaagactaaggaatgccaccacacctagacagactttgtcacaagctgtttgctgttctttggtcccattcagtttccaaaaagaattatttagaaactattgcctatttacaaattattctttgagtccaaccaactctcctaaaaatcatactcttttcaaaattgcctacattcccccatctccctctcccctaagaagagggcagtatttaagcttgaaccatctggtccttctttgagtcttgtattttgtatggctcccatgcacaccagcacattattaaatgtgtataccttttctgctaatctattatcagtttctttcagcaggctcaaactttcagaagaggagggaaaaattctctttgctcttatatcacacatgttaataagcttctatttgttcttctctgttaatctgtcttttgttatgggggtccattccaactaagaacatgaagggtggagagaaaatgatttttcctctcctataaccctttttggcagcaatggattactaaaagattattttcaaagcacagttttaattaatactttgaaatacacctggtaatacatactagtagctggcgcagtgcccttcagttgagaacctcttttaatgtctagttaaagatcatgtgtaattaacatactgattgttatagaacaaatgaatttagatatgtatgtcaagtttgtacacctaagtaggttaagtactcccacctgatgtgtctcatgctattaatttgctgagtaaacactatttttatagttgaaagatcagttccattccagccattccaaattagttttgttcaaactaatgagaccttattaaattcgaaaggtgatctagattggggattatagtcttgtcacaaatctctctgaaattggacatatatccagctttcaagccccttggtccatcagccccaaagcgtaattccttctaaggtttgcaaaccatagagttttacctgtacctttggtttttgctttttatcatcaacttgacttcaacataactgtcctcctagttattttctgtctcgttttaattgttttgtgcagaactttagtttctttgtcttttctaacttccactggatatcctgtttgaatcgtggatgcatttacatgttgcccccttacctagattctactcttgactcataatactgccccacttgggctagttttgggagaagcccttatctcaacttttcaccttgtctctatccatagcttctctgtggtcctaggctgcaagaaattttctacctcaaggtcaatactggaagacatctttttctgctttaagatttggctatcccctaatgtagatgatttttttctttcaatggatttcaggtgcatggaattgaattaatcataattcttggtttatgacacactatcaattggtttatgtgtaacatttataattatatgtgtgcatttacatagtcttaaaaatgcaatgaatgaaccaacccaagaattagaatatagataataacttatgtttttctgtgtggtcctcttcagtgtaatcattatcttgaattttgtgtgtaatatgccatttcatttttaaaatatttaactacaaatacatttatgtacctaaataatatattgcttagtttggggctgtttaaaactttggtaaaaacaaagcttgtcacgcttgatttttttttctgggatttacttttttcactcaacattgtgttactaaacttcatctgtgttgatgctatagcagctgtttctgcattttcaatgctgtataatattccatcatattcaagtgcaacagtttattctccagaagatggtcattatgttattatctttattattattattattattattatactttaagttttagggtacatgtgcacaatgtgcaggtttgttacatatgtatacatgtgccatgttggtgtgctgcacccattaactcgtcatttagcattaggtatatctcctaatgctatccttcccccctccccctacccaacaacagtccccagtgtgtgatgttccccttcctgtgtccatgtgttctcattgttcaattcccacctatgagtgagaacatgcggtgtttggttttttgtccttgcgatagtttactgagaatgatggtttccagtttcatccatgtccctacaaaggacatgaacgcatcattttttatggctgcatagtattccatggtgtatatgtgccacattttcttaatccagtctatcgttattggacatttaggttggttccaagtctttgctattgtgaatagtgccactgtaaacatacgtgtgcatgtgtctttatagcagcatgatttattatcctttgggtatatacctagtaataggatggctgggtcaaatggcatttctagttctagatccctgagaaatcgccacactgacttccacaagggttgaactagtttacagtcccaccaacagtgtaaaagtgttcctatttctccacattctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttgttttgctgtgcagaagctgttgagtttaattagatcccatttgtcaattttggcttttgttgccattgcttttggggttttaaacatgaagtccttgcccatgcctatgtcctgaatggtattgcctaggttttcttctagagtttttatggttttaggtctaacatttaagtctttaatccatcttgaattaatttttgtataagttgtaaggaagggatccagtttcagcttctacatatggctagccagttttcccagcaccatttattaaatagggaatcctttccccattgcttgtttttgtcaggtttgttaaagatcagatagttgtagacatgcggcattatttctgagggctgtgttctgttctattggtctatatctctgttttggtaccagtaccatgctgttttggttactgtagccttgtagtatagtttgaagttaggtagtgtgatgcctccagctttgttcttttggcttaggattgacttggcgatgcgggctcttttttggttccatatgaactttaaagtagttttttccaattctgtgaagaaagccattggtagcttgatggagatggcattgaatctataaattaccttgggcagtatggccattttcatgatattgatttttcctatccatgagcttggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataagaatgcttgtgatttttgtacattgattttgtatcctgagactttgctgaagttgtttatcagcttgaggagattttgggctgagacagtggggttttctagatacacaatcatgtcatctgcaaagagggacaatttgacttcctcttttcctaattgaataccctttatttccttctcctgcctgattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgagatacgtcccatcaatacctaatttattgagagtttttagcatgaagtgttgttgaattttgtcaaaggcctcttctgcatctattgagataatcctgtggtttttgtctttggttctgtttatatgctggattacatttattgatttgcatatgttgaaccagccttgcatccagggatgaagcccagttgatcatggaggataagctttttgatgtgctgctggattcggtttgccagtattttattgagaatttttgcatcaatgttcgtcaaggatattggtctaaaattctcttttttggttgtctctgccagactttggtatcaggatgaggctggcctcataaaatgagttagggaggattccctctttttctattgattggaatagtttcagaaggaatggtaccagctcctcttttcacctctggtagaatttggctgtgaatccatctggtcctggactttttttggttggtaagctattgattattgcctcaatttcagagcctgtttttggtctattaagagattcaacttctttctggtttagtcttgggagggtgtatgtgtcaaggaatttatctatttcttctagattttctagtttatttgcgtagaggtgtttatagtattctctgatagtagtttgtatttctgtgggatcggtggtgatatcccctttgtcattttttattgcgtctatttgattcttctctcttttcttctttagtagtcttgctaacagtctatcagttttgttgatcttttcgaaaaaccagctcctggattcattaattttttgaaggtatttttgtgtctctatttccttcagttctgctctgatcttagttatttcttgccttctgctagcttttgaatgtgtttggtcttgcttttctagttcttttaattgtgatgttagggtgtcacttttagatctttcctggtttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattccgttgatttggggtggagagttctgtagatttctattaggtccacttggtgcagagctgagatcaattcctgggtatccttgttgactttctgtctcgttgatctgtctaatgttgacagtggggtgttaaagtctcccattattaatgtgtgggagtctaagtctctttgtaggtcactcaggacttgctatatgaatctgggtgctcctgtattgggtgcatatatatttaggatagttagctcttcttgttgaattgatccctttaccattatgtaatggccttctttgtctctttttatctttgttggtttaaagtctgttttatcagagactaggattgcaaccactgcctttttttgttttccatttgcttggtagatcttcctccatccctttattttgagcctatatgtctctgcacgtgagatgggtttcctgaatgcagcacaccgatgggtcttgactatccaatttgccagtctgtgtcttttaattggagcttttagcccatttacatttaaagttaatattgttatgtgtgaatttgatcctgtcattatgatgttagctggttattttgcttgttagttgatgcagtttcttcctagccttgatagtctttacaatttggcatgtttttgcagtggctggtaccggtcgttcctttccatgtttagtgcttccttcaggagctcatttagggcaggcctgctggtgacaaaatctctcagcatttgcttgtctgtaaagtattttatttctccttcacttatgaagcttagtttggcaggatatgaaattctgggttgaaaattcttttcttaagaatgttgaatattggtccccactctcttctggcttgcagagtttctgctgagagatccgctgttagtctgatgggcttccctttgtgggtaacccgacctttctctctggctgcccttaacgttttttccttcatttcaactttggtgaatctgacaattatgtgtcttggagttgctcctcttgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttctcgcttcatttcattcatttcatcttccatcactgataccctttcttccagttgatggcatcggctactgaggcttctgcattcgtcacgtagctctcgtgccttggttttcagctccatcaggtcctttaaggacttctctgcattggttattctagttatccattcgtctaattttttttcaaaacttttaacttctttgctattggttcgaatttcctcctgtagctcagagtagtttgatcgtctgaagccttcttctctcaactcgtcaaagtcattctccatccagctttgttccgttgctggtgaggagctgcgttccttcggaggaggagaggcactctgctttttagagtttccagtttttctggtctgtttttttcccatctttgtggttttatctacctttggtctttgatgatggtgacgtacagatgcactttttgtgtggatgtcctttctgtttgttagttttccttctaacagactggaccctcagctgcaggtctgttggagtttgctagaggtccactctagaccctgtttgcctgggtatcaccagtggtggctgcagaacagcggatattggtgaactgcaaatgctgctgcctggttgttcctctggaagttttgtctcagaggagtacccggccgtgtgaggtgtcagtctgcccctactggggggtgcctccccgttaggctactcggaagtcagggacccacttgaggaggcagtctgtctgttctcagatctcaagctgcgtgctgggagaaccactactctcttcaaagctgtcagagagggacatttaagtctgcagaggttactgctatctttttgtttgtctgtgccctgcccccagaggtggagcctacagaggcaggcaggcctccttgagctgtggtgagctccacccagttctagcttcccggctgctttgtttacctaatcaaacaactaactgggcaatggcgggaacccctcccccaacctcgctgccgccttgcagtttgatctcagactgctgtgctagcaatgagcgacacacggtgggcataggaccctccgagccatgtgtgggatataatctcctggtgtgccattttttaagcccattggaaaagcacagtattagggtgggagtgacccgattttctaggtgccatctgtcacccctttctttgactaggaaagggaattccctgaccccttgcacttcctgggtgaggcgatgccttcccctgctactgctcgtgcacagtgcgctgcacccactgtcctgcacctactctctggcactccccagtgagatgaacccggtacctcagttggaaatgcagaaatcacccatcttctgtgttgctcacgctcggagctgtagatcggaggtgttccttttcggccatcttggctcctccgttattatctttactgttgcttattttgaacaggcctacaagcatctcctggtgcacatgacctagagtttctcttggaatagagtcgctgagtctttagttatgcatacttttaactttactagaaaataccaatctgttttccaaacagttgttctagtttaacattcccaccagcaaaatagtagagtttctgtgtatatacattttctccagcacttcttattgtccaatttattatttttgaggacaattaagtgggtgtaaagtggtatcccctagaattttggtttgaatgttcatcttcccttaggtgatttttccagaactggaattctgtatctcctttgcactaacaaagcagtagattactgtaaagctataaaacacaaattaaataatatgatcatctgtaatgcagcagtcaaggagtgattaggatgtgctgtgaggacggaagagaagtcattcttacagtgcagtagaaaaagccttggtcttgaatcaggagagtcagtgcctggtcctagctctgtaagtgattggctgagtgactcacatgaaaacctcatttttcagtgtttccatttcctcatctgttatttaagggtgttgatcacagagagtatgctctggtctacatttttgtcatttagtaaatcataatcatcacattcttttgggtgtttctttaaagcatttggcctccattttctcaggtgatatttccaatacctaagtaatgtaggcagagaaaagatgaaataaaagcctacaaattttggcaggggtctccgtagtgtgactgtggggagaccaggaagctcctcaagcccataaatatctctgttctggcctcccttagagcctaaaactccacaattactgtttcactgctatagttcttgaatgcctttgggtctgttggagtcttccattaaaatgcaaatgtccctggagggggtggggagagcctttaagctcattatcacctaaatcttccacagggattaattgatcagatccttccccatcagacacctggttggaaacagagcctgtgggaatgggcacctggttgatgaggggaagccctgggagggagaagaaaggttataaagagagaggtggaccaaccagggctccctagggtttggccatttgctgcttcccacaggctcatctctagccagaagctcaaaatccagctggtcaaacacactgggctactgctgtctccttggggggaagtttcctcttagaactaactaaaggctgccaaccagcggcaaaccctcctgtgtctgcaaatggctgccaaaagcccctccgcgctacacacttctgtggcagatgcctctgagcagccttctttatgagtcagtgctaaagcctagcccaggttctaatgtggccactctgaggcgtggacaggccttgtcaaaggctgggcatgcgtgtgggtgcctcatctgctttgtttgacatccaaacaactcttttaaaatgtggctctagccccacctcacaaagggggcctgaagggtgttgtggaatgtgcttggacctgctctgttttctttcggtcacccacacaaaaatgtgccttcccctcccctgccaggaaactccctcagcaatgcatggttttgcctccgctgaccctggccccttaacatgtcagaatgttaataaaacactacggctgtcataacgcaaggttaaatgaagtcttcacaacctgtccattaagcggatgtttgtgtgtgtggctttctgcagcttctctctggatacagcctgtctcagtttgtgggcagtcgatcgagccttgggcctttgtctttgttcactgttgtgtttaaatcccccccattcattaatcatccctttgcctatttataccggtggcaaggatagcgaacacacttaacgtctgcttttgttttggtggcaccctttgtgaggaccaaggcagagctaattattaactgcgaaaagacgttaaaacttttagataagcgccaaatgctgcatccactgagacgcagttttgtttaaaccttcgagagcttgcggccaagcaactggggtggctttatttagctttgagtccaggggagtgatgccagtgctcagataattaatagaggctctccattaagacccagccgggcagcagaatccaagcgccctgtatgcacctctgaacacccagctgggtcatccagacctgagcaggcacaggcaggggtggcagcttcagacgtagggctcaagggggctcctccaacctatatgtttacatttcctgtgtacatttcctgtgaagatcttcgttgtcagcttttggtgacttttacaccctccagtaggatcctgattttcctttgctgttggacattttgtggagccaactattttaggtacagctatatcagcttattaaacagttatgcggcttgctactgttcttctgaaagaggtctccccgaccacgttttctaaagcagttgcctaagcccacagccatccctcagttacctctattccattacccagtttttttttcccctccaaggcatctgtcgctatttgaaataatcgtatttgtttgtatttcttgtctgtttgatactagaatgtaaacctcttgtatcctttgcacttagctcttgatcgtcgcctggcacatatcaggggccaaacagatatttattttatgtgtgggggaggaaaaaaatatatttccctctacccattctaggctcattggccagggccctgtaaattagattgccaaaagataggttaacaagagaaaagtattttttgttgttgttgtaaattttatttttgaattgcattttttcctgctgatacatgaaaaagcaattttttgttttcatattatacacaacatcctaacttaacttttgtttatttactagtttgcatttcttaagtagacagtcatattatctacaagcaaaagatttgtttcttcctttccaatccttatagtttttattgctttttcttatcttattacactatataggacctccagtgtaatgtaggataaagtagtaatggaattatatcccaaaagttttcttaaaaataaagaaagcccacattactagtttacccacataataaaatttcttagaaccacataataaaatttcttagaacataaaattcttcgtttttaagtatccaattcattggtttttagcatatccacaaggttgtgcaactgtcaccactattcaatcaaaaacatttccgtcattccaaagagacaccccttaaccatttatacttactcccaatctgcctcttccttcagcccctgataaccttaatcaactttctgtctctatagatttgcctattcttggcattttatacaaatgtagtcatacaacatgtagcctttcatgtctggcttctttcatttggcatagtgttttcaaggatgattcttattgtatcataaatcagaacttcctttcctttttatgggtaaataatattccattgtatagatataccatattttatctatccattaatcagttgatggacattttggttatttctacattttggctatgatgaataatgaataatgctgctattaatattttttgtatacgtttttgtgtgaatatgtttttcagtatcttgattatatacttaggagtggaatttctgggtcatatggtaactctatgtttaattttttggggaaccacccagctgttttccataggtagtgccattttacacatttccactagcaatacatgagagtttcaatttctctacatcttcaccactacttgttattttttcttacagtgatcctgtgggtgtgaaacagtatctcttttggctttcatttgtactactctaaagactaatgaagttgagcatcttttcatgtgctctttgattatttgtatatcttctttaaaaaactgtctattcacattttttggcttttttttttgagacagagtatcactctgtagtccaggctggtgtgcagtggcgtgatctcggctcactgcaacctccacctcctggattcaagcaattcttctgcctcagcctcccaagtagctgggattataggcatccgccaccacgtccagctaatttttgtatttttagtagagacggggtttcaccatgttggtcatgctggtctcgaactcctgacctcgtgatctgcccacctcggcctcccaaagtgctgggattacaggcatgagccaccacgcctggccttttttggctatttttaaattgagttatttgtctttatattgttgagttacaagagttctttatatattctggatactaaacctttatcagataaatggtttctaaatattttcacccattctataggttgtatttttggtttcttggtagtatttctgataaacaaaatttttaattttgatgaaattcaatgtatttattgttttctttgatggcttgtacttttggtgttacatctaagaaactattgactaatccaaggtcatgaagatacacacctgtgtgctcctctaagaattttgtatctttggcttattcatttaggtcttttattaagtttggattttgtatatggtgtgaggtagggtgggtccaaatgtagtcttttgcatgtggatatccagttctcccagtattatatgttgaagagactggagagtgggcattcttgtcaggttcttgattttaaaaggaatgtatgctgttagattttttaaatgtaatatttatcagataaaagtattctatataattatgataatctaagagtttaaatcacatactagcctcttcactggaatgtgagaaccaatgtcattcccttcattaggggtgcagtcctgggatataaccttggcaatagaaatttagtgcttcctgtacctagaacagtcacgaaacaagataaagagaaggtacctattgctagtcctgttcagcagagtgactattcctgagacttggctagctcatagatcttaacttttgtgcctgcttcaaatgttggcagtggccatatggactgttgtgtttagaagtcttaggttgctctgatatcacagcgattgattaatgatatctgaaacctgcatgaaaagagataggcaatatagatatgacacatttgccattcttgtattggtccctctttctctgtcagatctgtcgtacttgaccctttttacattaaattgctctgtggatagaaccccttttctttcttgatcattggatttggccatttttctcttgttcagcttaatgcttagttctgactccttctgatggatacatcctgtttaatacttatgtatcagagaacaaagtcacaagctttgctaaggtagacacatgtgtttgacagtcctggccccaggtattctgttttgttgtcagattacgtgtcagaagaatatatccccataaggagtgagaaaatgagataaaaaatacaatattcagaatgacaattagagcatctagaccaaacaatatcataggcaacctctatgtctttttgaaaaatacaatataaaagatgacttgcagtgaaggaggtagtcctctttcatgagacatgtagggaataaggttgaatgatcaactaatgtcccaaagtctcacatgccatatggaatcagtatcatgttgatggtttggagaatttcctaggaatgcagtctgtggtaccaatattgccctttccgaaggcttaggggtctgcctttatgatcaaggcttttatctgcattacagttcctggcacttgaaagcttctgatatattggattatttgggattaacattcagcatcaaatagtatagaacttcatacctctctcatggcatggtccggacattagcaaggcgggacttgtgcagtggctccattgtggcagggagtcagctcattctagctcattcatgtaccatgtttatagtccctgtggcaaagaagactcatctccccattgttgtatcacattaagcaaaaatgcaaaaagaaggagaaagcatgctcattcttcttaaggacattgcctggatgttgtataagtcatttcggctctcattcccttttgccagaacttaagttacatgaccacacctctttgcatgttcccatcaaaaaaaacctagcagtgtatttcctagagaagaatgagacaatagattttggagaacaaccagcagtctctgctgaataacaatattttgttaaataaatgagaaaagctaaatcaaaataaaacagtgtagaaatatattacccttaagatcaccagatccaagcctttaatgatcttaatggaaaagaacacagatctagtattccagacatccatgaacttttatttcaaggatgtgttgctatggggcacccttcatttgctggcagtaacctgaaacctgggatgaaatgaacatacctgaaatctctgtcactcttctccctaaaggtcatcagaggagttgcttctacaacctaagaggaaggatcattaatttcttaatctgtctaagggtagatcgtcacttacctggaagctgttttataaagggaatatgttagaatggtagacaatattagcatttttcaatatatgattttcatttcctttctgagctgagatatgaaatgcccctgtgcaacttcctatttaacttacatcccagctgaggtcatcttagagggtaccttgtattttgggatggtggaatcacaacatccatctagtaactagcttactagacagctgccctagagagtcattcacatccacgttgatattgtttaagcgcctaaacttttgctgtattagggtgataagatttagggatttctggttcctgcatatgacgcagtctatcctgactatcacattttgcaagtacttatcagcctccaggtgtaaacagagtcattgattatggagtcctggaattgactagaaataggaaaagtatttactctcaaatatcttaaaatgtggctaactcatccaattatagcaactcaaggtctaattgtaagccaagtcttacagaattgtgttcttaaaacaaaagagtgattagtgttggatatggttcatctgggaagacttcctttaacaggaaaaaaaaatcactttctccatctgtgctggaagaaagtaactcaaacacagtcaggaacagagaatgtatgcaatgtaaatggctaaacctgacagcctctggctaattggaagtgtcggtgttattgtgcttaggttaatggggctctttagtttaccatctgagctgcttctcccaaggaatcacagcaaccagcagtctccaagggctcaaaaaccctggaggacttctctttggtccctgggagctgcaccctgggcacttacagcaagctcacaggtgatgagaactcatagttcagcattttgcttctcttctatgaaaaaaaccgactgttttcttcataaattagacccagccaaagatcttgattcttccattattctttccaaacagtgtcataaaagagaagaacaagagggtggactagggacctctgacttctgacccttcctccttaagcagcctgatatactctgcaggctgcccttctgatggccacagatgacaggaagagttgctgaaaaaaaaaatatgggcttaaccaacattcacagaccaactccatgcctggcagtccctgagccacatctttgacttatgatattagaggagtattatgggccattggtttagattctttatgatagcattgacatgtcatagaatgtcagctggggacttaaggctcatgatagctcaagatgacataccattaggcttagactaggcaacaagtggctattggaatgatgggacatttataggagagcaggtaagatcagatttcttccaagatacattctttctcctgtagaggcttttgtcatttcacttatcccactgaattactttccctgttgtgttaggtatgcctcaggggcagagaacgtaatacatttcacttttaggttcttggtgcctggaggagtgtgtaatgcatagttgctgctcagttaataatgtttgtattgaatggaaataaccaagagtctttggtctagagaggaggagaatgaagtgtcatgatcaagatctgttaaatcctacatggggaagactaggttgaaaggggagttagttgctaagtcctaaatacagagttgggagactcccttttgaaaatggatcaaggtaaatttaggaccaatacaaagatgatccagtttccacgtcaggaaataagcttctagatctcattttccaaaagatgatagtggaaagaagcaaatgaatttttgccatagtatatttcaaattgaagaatggcacagcttttaatagcttagaactgggtgcagtggctcacacctgcaatctgagctacttgggagtctgagtcaggaagatcacttgaggctaggagtttcagaccagctgagcaacatagccagaccctgttgccaaaaaagttttttaaaaaattagccaggtgtgatagcatgcacctatagtctcagctactcagagggctgaggcaggaagattgcttgagcccaggagttcaaggctgcaatgagctatgagtgtgccactgcactgcagcctgggtgacagagtgaaatactgtctcttaaaaacaaaaaaaaagaccctaaatgaaggcttaatgtagacctccgagatggacagcctgagcctccaatgactcattttttagcattagtgacaataaaaaaaattatgtgtatgtgtgtataggcatgtgtcacttagcaatggggatacattctgagaaatgatagatgaaattaggtgattttgtcattgtgtgaacatcatagtatatgcttaatacaaacctagatggtatagcatgcaatacacctaggccatatggtatagcctattgctcctgagctgcaaacctgtacagcatgttcctgtacagaatactgtaggcagttgtaacacaatggtaagtatttgtgtatctaaacaaaaaaaaagttacagtaaaatacgatattataatcctatgggaccaccatcttatatgtggtccattgttgactgaaatatcattatgtgatatttgactgtatatgggactggtcaaatatgttttccttttctatgatggcctcagagccatcatagactatctataacttcatctctaaccattctttcatgtgaatcttatgtcctagggactttgatctacacattgtactttagacagaccatttaacctgcatttattctcttttccttttcctaccccctttgcctccttcttcctggtaaccttcatttttgctttcctatataaaaccttctaaaccaggcccctttgacctctctcttcttacgtactaatggcaggtgtagactttactgatggtttgctgatagctgcctttaattattatttatgtttttaggcacttattctacttctccaaacttaagactagtgaatacatggtcctttgtgatttagctagagtagaaagctcagtcttatgaaatgaaaactgatatattttttaaagagaacgtactacgaagaaacaacaaagaattaataaaaatgttaaaatcagtaacatatcactaacaatattactaaagatgcaaccattagattttaaaaatctaatttaatggattgacttgttgaatatcagaactgcaagaaaccttaaagatcatcatgctgaattcttatctcatactggtagatgtacaactccaggacaattaatttagtggtagagttaaaaatgttattccttctaataacctagaaattctcatacatatgtatatgtcctaaagaagcttggatatattcataaagtaacattacagagatatctactaatagcattgttttgtgataatgaaaaatttgaagcaaaataaatgttcattaataggaaattagatagataaaatgcattctattcatgagatagaattctagacagaggttaaatggatcaaaaggaataaaacttaaagaaaatcatatggtaagtagaatatgtacaagctcatatccattattatcaaaacaatgttatttctggatgcacatagatgttgaactttaaaaactgattcgtgttctttattttttaatttggaaaaatataccttaaagtgattatgctgaataaaacaaccatctaacattcttattttcaaataaggaaatgcacatcaagagttgtgcttggtgtatggaccatgtttggaccctattttgaaccaaatgaatattaaaaactttatgagtgccacatcttctgtcatcagggaaatgcaaattaaaataatgagataccactgtgcacctattagaatagccaaaatctagaacactgacaacaccaaatgcggatgaggatgtagagccttagggactctcattcatctctggaggggaaacaaaatgagacagccactttggaagatagtttggtggtttcttagaaaactgaacataacttagcttatgatccagccatcacactccttggtatttactcaaatgagttgaagacttatgtccacatagaaacttgcgttcaggtgcttatggcaactttattcataactgccaaaacttggaggcaaccaagaggtccttcagtaggtggatgggaaataaactggggtacatgcagacaatggaatgctattcaacactaaaaagacatgagctatcaaaccatgcaaagacatggaagaaacttaaatgcatattcataagtgaaagaagccaacctgagttatatgctgtatgattctagctatatgtcattctagaaaaggcaaaactatagagagagcacaaagagcagtggttgtcaggtgttatgggggaggaaaggatgaataggcagagaacagaggatttggggggcagtaaaaatactctgtatgatagtgtgatgactgatacatgtcatgtatctgtctaaacccatggaatgtacaacaccaagcgaactctaatgtaaactatgagctttgagtaataacgatgggttgatgtaggttcatcagtgtaacaattgtgccactctggtgggggatgttgataaggggggaggctatgtatgtatccccccatttcccaggggtatatgggaaatctctgtaccttcttctcaattttgctttcgaatttaaaactgctctaagagaagtctttttttttttttttaaagggaaatctgaagcaaatattagaaacatattagggtggtagattcacatgtgtcattttatcttgtctctggaccttaaatattttataattgaaagtaaaaagttcttaatgtaaaaaaaaagactgaaatgatcagggaaatctgacactgactggatatttgataacagtaattataagcttttttaggtatgacaattgtggttatatttaaaattttttttcttagaggtacctaagagtatgtatggaagaaattatttgatgtctgggattcattcaaaaaaaatttgcttgggagaagagggaatagatgtgagtagatatagttgaaactagattagctgtgtgttgatttatagatacaagagggctcattatactgtagtctctatacttacaatttttttgaaatactcccgccaaatttaaaaaattggccttaaaatatagttttagaaccaatgctccttatccagtgctgtttacaatctatctcattgagaccatgataggttggactctctacactggccagagcaagaaagggtacataagcaggttttgcttacaattattttcttactggaggaagtttcgtacaaagagtaatttttatttatgaaaagcagtcccccgttgagccatcagttctagttgaggtgtatctaagatttctttttctttccaaacatgtcaaagcaaccaagccacgtgattgagagtgtgggggcctgaaacacccgcaagcaaccgcaaggggtgggaggttactcattccaacttttatgatgtcccgagaaacggttgcgataagagaaaagactaaaaaataaacgagagataactgagataatgggaaaaacagagggaaacaagacaacactctccagtctttggcttgagatatttattatgccaagggagataaattggagaaacatgaaaagggaaagagatcttgtctctgactcacgtatttctctttaagtgaatgagcaataacaccggaataaaagagctcaaaacagagccatgtgctcagccaaaatcatggttcctaatgaatttcaacgttggcagaagcctcacacgttgtacttgaacagctttcttgattttgaattatacatgtaattcatcctgaccagaatgtagcctgagagccgagatccgaatgtgagtgggaaatgagaatgctggtcacgtgctagagccggtctttcttcttcacgtcagaaatgtctgtgctgtcatcagtttggacagttctgggaaacaaacaaacaaacaaaacttaggaaatcaattgtttggagtcatcttggcaaatacattgtcatatgacatattttcttttcctaccaggctgttctgtattagaaagacacagcccaagatagtcagactacaacgcatgaaacaaatgttgatgaacagaaagggtcaccgatgaggccaacagtccaaaactgtccacctggccttcctgccctgtcttttaacaggacagaggaggatgaaggggaacaagatagacctagatgtggtggcaccttagaaaatttaaccaaaagaagggctgttgttttgctgattctactcagtgaatgcagtggaaagaaaatcagattcagtgggaagaaaatcagattctgctcgctctgtttttaaatagtgggtgagctttagctcacatttcatagagcaaacttttttagggtataaaataatattctttagtaactaaatttacagtctttgttcactgtaactttgactttacttctgaataactgcagctgacaggtcatttctgactattacatgtgttttttcttgagttcaagctaataacccaaaatgttagtcaatcctgcaagtgttatttgcatgtccttaggttttgttaaggtacttcgtgctgtggtgtttactttgggatagaattaaactgttgtgggaaggtgctttcaagaaagtgcttacgagaacaaaagttgttttgaaggtaggtaggtaggtggagggaagaagaaaggagagagagaagggaaaagatcgctggcagagttggaaaaaccagtaggttccaatcccaaatctaccatttactagccctatgaatttgggcaatttatttaacaagcctctttgatcctgtattagtcaattctcgcattgctacagagaaatactggagactgtctaatttacgaagaaaagacatttaattggctcacagtcctgcagcctgtaccagaagcataacacagccatcggcttctggggaggcctcaggaagctttcaatcatgacagaaagtgaaaggggagcaggtggatagtgggagcaggagcaagagagagggagatgctacacacttttaaacagccagatctcatgagaagtcacttgttattgcaaaaacagtaccaagaagatggtgctgaggcatttgtgagaaatccatcaccgtgatccaataacctcccaccaggccccacctctaatcctgggattacaattcaacatgagatttggggaggacacgcatccaaactatatcagcccctcagattatttatgtagaaaatgcaggtgatcactacctaccttgttgtgttgttatgatgattatagataatggcattatttttaaaagaaaggaatgaaagggaaagatacatattctaaaaatgaaaaatctcccaaagcaaatcatatttataggtctgttgctataattccagattttaattttattaaatgttcagaaaagaacaaatcacagatccttggttccaaataagcacatgggaaattatgtgaatattattaaaacgtgagcttcttgtgacaatagtgacattattggaacataaatggcagctcagtcagcgtctccttgtaactatatcaaagaaaagacagttgcagctttgttctctgtgtgacccacttggggtttggctgcttgttgatggatattatcatttttaatgtcagtaaataatgtgatgtcagataaatgacctgtttcctttctgtggtataaagctcatttatctttagggagcttgagtgtgtagagaaatctgagtgggaccaagggtttctgactatgcaggatgggactttttttattaatcctgcttaacatgagtcccaggcagtcacattcaattctaaatgtatgtgtggtaaatcaatggaagtgatatgcatttaccatagactgttttactgattggagaaaaacagaaagtaaactttttttttcaacttgaagaaaatgatgctatacataaagcattactgtgcacgtgcatgtagtagacagaagacatctttctatgtaattcatacttggcttagctagacccttgttgctttaaggaattacggtggtataaaattaaggatcaggaagatgcattttaattaactttactgctaatagctttggagatcacaaaaatgtgaactatggtagagtcaaaaagattctgagatcacaggaaattatgattttgatttctgggctgtagtatctgcttccttcctaagatgaccactgaaaagtccacatcttttatttctgaagatgagtctcatgaatccattgtctctgtttttcatgactgcacatttagccaaagtcactggaatgccatattctctgatgggagatttagtcagggcaaaaaagggccatttgcttttctggaaacctttagacagggtgacaattattccaatgagtttttcttaatattgtgagctcattttgaaacacttccttaaacaaccctctgaagtttcctaggaaaattcatggactctcagagaaccaagtctggaagcctctttagaaatcatttaattaaaatgtttgatttttttttccgatgagaaatcagaggtaaggaatttgctctaggtcccaaggtgagtttcctgcataggagactgaacacaaaggctttgtgtttttactaaaacattattgttttgtcagatattgaaatgtccactgatgatttaatgattaaaactgagaattttttagatttacttttctcagttccatcatattatagagctggcagagagggtagagtaggtatttattttactacccaatgagtagtctcgagaaagacagtgtccacctgttttttctagaataggggttggcaaattacagcccataaaccaaatatggccagtggcttgttttttgtttgtttgtttttacatatgagctacgaatgctttttacatttgtaaaaggtggcaaaaaaccacccaaaaaacaaagaatatttgagatatgtggtgaaggccatgtgtggtctgcaaagaatgaaatatttcctatctggccctttacaggaaaagtttgccaatctgtgatctaaaatattcagagaaaggttctgtgaccttccttgtagatcccacaatacttttgtgtttatattttttaaatgagcatcacagattgcaggaaaataggaaacaatttaatttaatttaatttttagccttgaaaaaaattccttttattgaatttatttatttttccagctgtaaaattggaggcaccactcagaccttgtttggctctatcattttatgagtttatggattacaacagtgaacaaagggcacgtgtatcagtcctttctcatgtgagactacgtaatttataaagaaaagagggtttgtttgtttatttgtttttgtttttgtttattgagacgaagtcttgctcttgtcccccaggctagagtgcaatggcacaatcttgtttcactgcaaactctgcctcccaggttcaagcaattctcctgcctcagtttcccaagtagctgggattacaggcacctgccaccatgcccacctaatttctgtattttaagtagagatggggtttcactatgttggccaggctggtctcgaactcttgacctcagatgatccatccgcctcggcctcccaaagtactgggattacaggcgtgagacgccatgcccagccaaaaagagagttttttttgagacagagtcttgctctgtcacccaggctggagtacagtggtgtgatcttggcttactgtaacctctgcctttgggttcaagcaattctcctgcttcagtctcccaagtagctgggactacaggcatgcacgtccatacctgactagcttttgtatttttagtagagacggggtttcaccattttggccaggctggcctcaaatgcctgacttcaagtgatctgccagccccagcctctcaaagtgctgggattacaggcgtgagccattgcacccagccaagaaaagaggtttaattgactcacagttcctcattggctgaggaagactcaggaaacctaccatcatggcagaagaggatgcaaacatatccttcttcacatggcagcaggagagagaagaatgagtgaaggaggggaatagccccttataaaaccaccagatatcgtgagaactcatgatcatgagaacaatatgagggtagccgcccccattatttaattatctcttaccaagtcccccccacaacacgtgtggatagtgggagctacaattcaagatgagatttgggtgggaacacaaacaaaccatatcagcacactcattcagcacatattcagtgggtatcgagaggctatgctggatgctttgggtaggttggtgaacaaacagtatggttcttgcccttctagaccaatattcagtgggaatacagagggaaagaagaaataatgaagtaaacaatgatgggcatttgtagcggttaggcaggattcagtgtcagataactgtcaaggggaaattcctgagagactccacccactgatcatttgtccgatgtgaagggcaatttatcctaacttccacacatatttatgggtcattttctatgtaccaggcatgaggctgtctgttaggttgagttctcagtcaaaaccatggacaaaggcctccttttggacattttcccaaacctgcttggttctttgttaaaatggtacttgttccaaccttcttttgtttgtttttaacttttattttaagttcaggggtacatgtgcaggtttgttatataggtaaacttctgtcatggatgtttgttgtacagattattttgtcacccaggtactgagcctagtatccattagttacttctcctgatcctctccctcctctcaacctctaccctccagtaggccccagtgtctgttcttcctctcttatgtgtccatgtgttctcatcatttagctcctacttatcagtaagaacatgtgatatttggttttctgttcctgtgttagtttgctaaggataatggcctccagcttcatccatgttcctgcagaggacatgatcttgttcttttttatggctgcgtagtattccatggtatatatgtaccacattttctttatctagtctaccattcatgggcattagggttgattccatgtctttgctattgtgaatagtgctgcagtgaacacatgaatgtgtatgtcttgatgactgaacaacttatattcctcctaggtcgaatggtagctctatttttagctctttgagaaatcaccacactgctttccacaatggttgaactaatctagactcccaccaacagtatttaagcattcccttttctctgcaaccttgccagcatctgtcttattttttgtttgttcgtttgactttttataatagatagccattctgactggtgtgagatggtatctcattgtggttttaatttgcatttctctaattatcagtgatgttgagctttttttcatatgcttgctggccacatgtatgtcttcttttgaaaagtgtctgtgtttcttgcccactttttgatagggttgtttgtttttttcttgtacatttgtttaagttccttatagatgctggatattagaccttcgtcagatgcatagttttgcaaatatcttctcccattctgtaggttgtctgtttactctgttgatagtttcttttgctgtgcagaagctctttagtttaattagatcccatttgtcaatttttgcttttgttgcaattgcttttggcatctttgtcatgaaatctttgcctgttcctatgtgcagaatagtattgcctatcttgagttaatttttgcatatgatgtacggaaggggtccagtttcaatctttggcatatggctggccagttatctcagcaccatttattaaatagagaatcgtttccccattgcttgttttgtccaatttgtcaaagatcagatagttgtagatatgtggccttgtttctgagttctttattctgttccattggtctatgtatctgtttttgtactagtgctaggctgttttcattactgtagccctgtagtatagtttgaagttgggtagtatgatgcctccagctttgttcttttttgcttaggattcccttggctatttgggctcttttttggttccatatgaattttaaaatagtttcttgtagttctttgactaatgtcaatggtagtttaatgggactagcattgaatttataaattgctttgaacagtatggccattttcatgatattgatttttcccatccatgagcatggaatgtttttccatttgtttgtgtcatttctgatttttttgagcagtgttttgtagttatccttttagaggtctttcacttccctggttacctgtatttctaggtattttattctttttgtggcaattgtgaatgggattgtagggaatccaatttcaaaagaggcctacttgggaccaattttaggaatagtttttgtcctcaggaataatccacctgctttataaattatacattaagccctgagctaaaatatgggcaaatctgtctctctcctcttccatagaacttttgctgacttgttagccacaggactttgaattatataatttctcatcaaaaccacatctatttcctgaaacacttcaaaatagctttgactcctaggaaagtctggttaaggagttcagacaccaccttagtggaagcccatctcagtgacaccagatttcctatgttgattgggaagccatgctctgtgttgggagagaaaaaaacatgccttgtagctagaattatgcccaggggtcctcatggcttctgtttccagagctgggcaatggccatcctcagctttgccactactgttttgaacaactttgctcaaacagaagcattgttctggaacttggcgaacttggtgatgatctgaatcatcaatttcagtttgttttaatctggtactgagtttaaagtttaggtagttcaagggtaaagatagcaaaaaaaggaaaggaaaggggatgatgagtagatgaaactgtatgatgagtagatgaaaggggatgatgagtagatgaaactgtatgatgagtagatgaaaggggatgatgagtagatgaaagatgttttactaaaaacaattggtaaaagttgtcagatctatttccatatatctcttccacacattcttttgctttatgttcttaaaattacaatagatctcattttatccttgacattggaattctgaaacatacatgcattccatgaagtccactgtttattgttgaagccaataagtaagacagaacaaaagcaaagtgaagttagaaaggtatccactgtataggtactttacaaattgtgggtaacaaggtggggagaaaagaaggacattctaggagggaaaaagataatatgtattaaggaaaccatattatggggagttaagaactatgaaaatcagtctttctttccttagaatagctcttttcagcctgccccatagtaattctaaaattattggcaggaaaatttggtgcaggcacagcaattagattgaatctgttgctgataggattcttcggcataaaactggatctttttgctacaactaaccattcattccacagtgctttcagttcccagaataattcagctcaagggaatattgacatttttgtctgaatccattctgagtttcatcctataaggaaaacatttttaaatactcttttagccatggtcttgggagcccctgaaatattctttccctcacagatggcagtgccttttcctgctgcctctcgtgttggatcttctctatcccacaggagcagacgggatgttggagcccttctgttagagcagatgggaagttggtatcagggctgatggttaaatcactgagaccctacattagcatgtctgaggaagacagatttgaggctgtcttcctaagaattttctttagtggtcattaaggaagactcagaagaaagattgggttaatctctgtaataagcccatagtggaggcctaatgacagtcagaatattttctggtctcatgggtcttcaaagaaagcaaactcaaggtcctaccaagttcagtgttttcaaggttctaaaaaattcaaggttctcaagggtttaaaagctagtgaaaaaagattacagcccagcttagtagaaatggtagactccaacacattgggtgtgataggagaattcttcattgtcatttgggataggacagctgtttactgtgaggctgccccatgcattctaagaggtttacctctcagaggtttatcctcccatcacccaagggtatggccttacccttggatgatggccatttctccagtgaagtttcctgtagcctgtgtcctagagtatgcagagaggaagctgaaaggtaaaataatcggaggattggactacagactttgagccagttgtttaaaagattctggtctccacacatattgcaggtcacattcttgctgtacagaattcaggagcggatcagggctggaaaagtaggaacagtctcctcaccagtcacccaagaaggtataaactggccgctcaatgtgttttagactcatataaactcagaattggtagaaaaccaaaactagctcatctaaccaactgctcagtagagatgcctttgccaaatgggcatgtctttaagatataaccataggtatatggtgaagtctgtgccagagatttatgttaaattcttgcagattcttgtgtaggtgctctcagactggtctctaggaaatatggtaaatttgtttacagtaaatattggctaattgactaaaagtaaggcttctagagtttagttcctgcttcaaccactaactagctctttgaccttaagcaagtccgtttgcttctctgagtctagctcagtttctcatacgtaaagcagagataatactgctaccaattttggagatttaactaattctgccctaaaactcttcccttcaaaagcaatggtaaaaattattactggagcataagtaaatgtttatcatataaaggaaactatatctctagaaatgttatacatgtaaaattttaaaattctataaaatggttggtttcttttagaccttttagttttgtgatattttaatccagaaattgaactctggactgaagttcaccttctcttatttgaaaatttatatgaggttagagaggaggaaaataaactaaaaaatattatctgttactactaatcttgcaaggtatttgtggtattggtattcaaggagttaataaatatgaaatgcttagaagaatacctagcacttggtaaatgtacaataaatatcaactattatgagtatatgtactaaacacagcactaggttaatatctagttttgtctcatagatggatgtgcattgcttcctatgaagaggcaaaagtttgtactgatctgagcagctatatctgtgcctagagaaagaagctggttttaaaaccccttgtccctaagtttgtagtggaatgggataagtcatctggctcttatgctatgcctacccttcagatgacactatctcgctgcaacctctgcctcctgggttcaagcaattctcctgcctcagcctcccaggtagctgggattacaggcatgcaccaccatgcctggctaattttttttgtatatttaatagagatggggtttcaccgtgtcagccaggctggtcttgaactcctgaactcagttgacacacccgccttggcctcccaaagtgctgggattacaggcgtgagccaccacacccagcctatctttgatacattcagaaaggaaagggaaggaggcctttctcctcctacctcctgtgagtggttaggctgggttcataggaagctggccaagctcattagcatggcaagcccctccactacccactgctctggcctttagttgcatactggtcagtaagtggaaaaagggaagggggaggatttgaaacgtaaccacagcagggattcctggaggctgtgggtgattctttaagttggtgcttctctttagggcatagcaccaacgtcttcttgtgagtgtatcctaaaaagtgagcaggtggatttctgctccaagccatgatataatgacaaagactggatttaccttcctgccttatacagttaagaaccagacaaaatatatgaaacaacagtgtcttagtctggttagtgtcgctctaacagaacacctgaggctgagtagtttataaagcaaagaggtttatttggctcacaattctggtggctcagaagtccaagactgggcagctgcatctagtgaaggcctccctcatactgctcccactcatgatggaaagcagaaagggagctgggaatatgcaaagagatcacatgcgagagaggaagcaaggaccccagactctttctagcaacccacggctctcaaggggactaatctcttcccaccagagtgagaactcactcaccactgtaggaaggcactgggcattaatctattcatgagggatctgcccccatgactcaaacacctgctactaggtcccatctctcaacactgccacattggggatcaaatttcaacatgagttttgtcagggacacaccccatccaaaccatagcaaacaggttgcaaatattggacaataggtagcacagaacattgatcctcaagagaagaacaaacagggtgagccctacaattgctccagcccaccatctacagagtatatctagactgcagtgcagggagggccaactcaaacagtcctctggtctccctgagttgagatgaagttgagaattaggggagaccaaagtggctagaattcccagggaagaataccagaaaggagagcattaatggagaggagagaatattttataaggggtatctgagtgcttactgatcagagcatgatgtgaggaaactccctgaagcttggggaagaaactctctaaaggagcagatggagcaccctttggagctcacacaggaccagaagtagtgctgttgccaccagctggagcagaaaatcagaatatacagggcatccagtagactactcaggagagtattgtctcaatagtagggcaagattaaagagtgctgtggtcctgcctaacaaaacctaaaaacaagcttcaaattgtttacaaacacttttctttgtcccagaaataaaacacttcacaaatatttaaatgaatatcagatttataatatctggcatcaaagaaacatgagaaatatgacccaaaatggggagaaaaatttgatcaatagaaacatacacagatgatagaattagtaaacaaagacattaaaatagctattataactctatcctgtatgctcaagaaggtaaaggaaagcatgaaagtgttaagaagataaaaaaaaagataatgagcatcagacccaaagcaaaattctagaggtgaaaaatgccatgtctagaccaaaagcactctaggtggaattagtggaagattagacactagcagaagaaaagattagtgaacctgaaactatcgcaatagaaatcattcagaatgaatcagaaaaatcactgaagaaaatgaacaaagaaactgtgagctacaggacaacttcaagctgatggatatgtttgtaattagagttccaaagttatcagaagaagaaaaaaaataaaggtacaaacagaaatcagtgaaacagaaaagagaaaagcaaaagagaaaaatcaatgaaaacaaaaccttgttctttgagactattaataaaattgataaacctctagcttaccagagtgataaggaaccagatagaaggcacagattaccaatatcaagaataaaagagtaaatatcaatgatgttgaaaatgtaattaggaaatattatgaacaactttatgccaataagtttgacaacttggataaaatggacagatttcttcaaagatacaaactatcaaactcctgacaagaagaaataggtaaactcaatagccatttataattttttttttgagacggagtctcactctgtcacccaggctggagtgcagtggtgccatctcggctcactacaacctccgcctcctgggttcaagcaattctcctgcctcagcctcccgagtagctgggactacaggcacgtgccaccacacttggctaactttttggatttttagtggagatggggtttcaccgtgttagctaggatggtctcaatcttctgacctcgtaatctgcctgacttagcctcccaaagtgctgggattacaggtgcgagccactgcatctggcctgccatatgtcatttttgaaaattgaatttgtagttaagaatcttcccacaaacaaaaccacagatctaagatggcttcactgatgaattctaagaaagatttaatgagggactaattctgattcctcattaacttttctagattattggagagaaacatacactttccgtttcattctgtgatgttagcattatcctgatatcaaaactagaataagattttatgagatacctcagtctccatgaagtgcttatttcacattgcatgcctgtatcaaaacatatcatgtaccccataaatatatacacctaccattacccacaaaaattttaaaaaattaatttaattaaaaaatttttaaaaaattatgagaaaattaaattctttccaatatctcttatgaacaaagatgcaaaaaagttttaaagatttttttgtaagtcagattcaataatatgtagaaataataatgtatcatgaccaagttgggttaattctaggactacaaagttattttaacattctaaatgtaaatagggaccttttcctaaaaggaaaacattattcttctccatcttatcctcattgttgtagagcactgggttttctttcttactgtgatgggtaaggaaaggcctcaggtcttaggggatctgctaatgagctaagcagaaggtccctattcatatggcctcatatttgtcacccagagggtagcaacaatctaggacccagcgaccctcagaagtgtgtgagacttgggactagcggaaacagaatgggttttggagtcagaccttggttcaaatacaagtttcaccatttgttgaacaaattatttaatgtttctgagctttagagaaattatgaggattaaggccgggtgcggtggctcacgcctgtaatcctagcactttgctaggccgaggcaggggggattgcctgagctcaggagttcgagactagcctgggcaacacagggaaacccaatctctactaaaatacaaaaaattagctgggcatagtggcgtgcgcctgtagtcccagctactcaggaggctaaggcaggagaatcgcttcaacctggggaggcagagattgcagtgagccaagatcgcaccactgcactctagcctgggtgacagagcgagacttcatctccaaaaaaaaagaagattgttctgaagctcagaggtgagacacataaagcccttggcacatagcaagcatgcagtgcatggtggctgtggtggtagttcattttgttgagaccctgtagcatgaggtttaagagctgtgggtctggatgaggatagcttggattcgaacaccagctctgttacatttctgtttgtgagaccttgcctagtttcctagtctgtgaaataggattaacagtactatctatctcaacagagttgtgttgtagtgaagttcttttgatacatgagtagctcttagaatgatgcctggcccactttcaagtaagtgctcgcattaactattattttaatgctattatcgtttctctggccactggtgtggtcattactgttgttaacaggccagataagggtctgatattctagcaagaaatggtcctagcaagaaggattcacaaaccaaagtgaggacaccaggtaacagagtcactgagtgctcgagtttgctcagcctccagattttatttggctccgttgaaagcagacctgcctggccctgactcatcagagaaagctgaattgctgcacctgggaagagtgaagccttggcgggcaagggcagggcagaccctgcaaacaatctatctcggagacaggaatattttgttagagatgcgcccagttggggttgggccttcctgaatggtgatgggatgcagtgtgaatggagacctgggctataattgagaaccatgtggccatgtcagcaggtgatggcacttgagtgacagtatgacagagaacagaaacagggccacagctagccgctctgcctgccatagcgatgtacactgtgcagatttctacccagccaggaatgagccgggcctggagaggcctgccagacggtgggctgcatgctaccaatttctttcagcacctcctattttgccattcatagactcttgccattaagcagacagaacagctcatatcctgtggacagatgatagatatgtcatatcactgaaaaattgtttgtcttccacaggtgtatgggcttcttctaaagcaggcagctcacatgacacttttcaacactctgtcctgtaccagcttggcatccggcgtctatcaaaaggggaatctttcatatgcaattatggcagaaaataaaggtgatgaagtgttgtgtaccaagaagggataagatcaaagggcggtaatgaataccgattacaatagaagggcagcttcaactgcagaagttgtgtgtgactgtgtagaggctggcgctgcttgggggcatgcactggcacacaccagagtacatgcagaaataatacagtaaaatcataggcactgctgtcataaaattataaattgccggctgggcgcggtggctcacgcctgcaatctcagcactttgcgagattgaggcgggcggatcacctgagttcaggagttcgagaccggcctggccaacatggtgaaaccccgtctctactaaaaatacaaaattagccgggtgtggtggcaggcacctgtaatcccagttaatcaggaggctggggcaggagaattgcttgaacctgggaggcggaggttgcagtgagccaagatcgtaccactgcactccagcctgggcaacagagcgagactccgtctcaaaaagagaaaaattataaattgccaaggtagaccgtaacccaagaggggttacaggtaatgtgtaattgtatcaaggtgatggtaagacacttgtatcctgataattcacgtaatacctgtttcttccagcaccatccaattagtggcaccatttcagacctccaaaagtctagtttatacccattgaggctgattttccaatagagtcttccagagcacaggacctgggcacccaatggtgtgttgtttatttatttttttattgcactctgggaggccaaggggaaaagcacagcctgttcaagtttaggaacagggctgcgtatcattggagacttcacagccatgcagtgtcgccatcccagcagcacgctttttaatcggagaagaatttctctacctgccaagtacttttccttgcagctgctatcatcttgaaaggtacatcacatgatgacatttcaaatcccacaaaatggcttgcccaagtcaattcagcagaggctttaactttaatatctgatcactttctttggaatgctatatgaaaagctgacaattttcaactaatttgtgagtacaccagtttgagttggttaaaaaagacaaaaaaaaaacaacaaaaaaacctcttcattatagattacttaaaattcctttctaattgtattagtttcagtaatgatgactgcagtaatttaaaggaagctagcaaagttttgtcaaatgcctttcagggttcttgctttaatgggaaaattaaatcttctttatcagttgtagtaaatagatgctcaactctttgaaaatggctcctttttctaagtagataaaaaaaatcctgctttgtcttattttaatattggctggattagtaaccattttgctccttttgcaaatataaaaatatattgagagacctcccaattttacaagtaagaaggcctacatcaatgaggattgaggggagagggaaagagaaccagcataggttgaatgtctgctatcttatttaacttcatcttcacaaaagctgtttgttggagatgatagagccattttccagatgagaaaactgaaatgaagtaagctggtctggtctgtccagtggtgttagagctgaattgaaatcctgctttatagagcccccagattggcattccactacctttgctcccccatgctgcttagctcacattggctgtttgccataggctgtctttctctaaccagaagctgctggtcttgtagcacccagagacttgtgcaaatgtcttctgtgagcaattgtaattgagatttccaaatgaaatgtcagtctgctcaccaggggaatagtattacaaagccagtggcccttgcgataccctgtgttttcacagccctcagggccttgtgttgaaaatgtaagcaggcattgctaagaggtctcagtggggctgagtgagcaatgcttcttgcggggaactttatggtagaccaggccaaccatgatgaggactacctggccagctcagaaaggcttcttggtgcaaatctcactcttaagttcccagtgaagtcctctttgtgtcttcgtaggtatggtacatggctgtaattgaatacattaatcctgtggcattttcacccattagcactgcagcataagtccttagaaagaaccatgttttgaggaaaagtgggcacggggaagacaaattccaatataagaaggaaaggagagcagtctgcagtcaaagaggcattccagagggcactggatggtggtagggaaacagggatcctctgaactcagttggggtgaggaataggagaaacttccctacttgacaattttgcctaaggccagctctactcagtaagcctcctgggatcagcttgctcacttcaaaggatctagaccatcagaagaacaaaacaatatttccctctgtggcaatgtggcattgcagctgtcatcacaattgtatccagaaaagcagcgtattcaagtggcagcttgttccttgaggcttgtctcatctttgagaaatacccagtgacacctctcagaggaaatccctcattccagctctgtgtgatcgtttctgcaggcagcaagcactttaggaatatgttcctgggcataatgagccctccgatggtgttcaccgtgtttgttcacaagagaacccagccagagttttgtgagagaccagacagagcttcttgagcccagcaacaggaggcacagaagaatttctggttgtttccttagacttgtaagaactgttatttgaggacttcattgaaaccagtctttatgtccccaccctttccatttccttttccttttaacccacagactgctgttcactgttgtagaatggagttgatgactgattaaaaaaaagtttctgcaaccttccattgcatgaaaagaataggatgcaatcaaggaggggggggtggtggaggagtagaggacatttccctgttctctgctctccccaccttggacttacagaatcctagacctgaaaggagctttttttcaagcatgtagctggcctaattctcaaactgaacagatgaggaaacggaggcctagagagtggaggtgtttgcctcaagtgacactgatggctgatgaccagttccatagctggcatactttgttcagctctgcagacgatagtttaaggcaaggacacatgacaggaggatggctgggaggatcgggagcttatgacgatgttttgaagaacccaggactgtcttgtcggtaagaaagaaaatgcttcaagggattataaagaccatcctcaaacatttgaaccgtttccacactgcagcatagggagatttattctttgtaattgctaagggcacagctagaatccacggacatatttatatgaagagcgagtttgactcaagatgaggaagatgttgatctgccttcaatatgagcctggaatgcctgaaagagtagtgagtccactgccttggaagaaccaactgtccctcaaaaaagaggacatgttcaaagaggtttctacatggggaatctccttttcaaagctaaagtgaatcaacaagattctcatcagagtccctaagagtccccatcaaatagggaggtaagtggaattaatgaaaaacgctgaaggtatcagtttctgcaaagccagtcatctccagagcagtgtatgaatctagatctaccacaggctttggggtcgttagctttcgctgttgtggagcccagataggggatagctttgaaagtaagggctgctgctacttataggatgaaagtggaaatgcgttagtttcgattttgggtaaacttgatgatagggaaaaaaaaggcacccatggctgggatctctagttttagtccaaaggtggtaaatcagtcccaggatagaaagactcctgtgagcccagtagagaccaggcctcagaaaaagccatggccactgctttggaaaaaacttttttttttttttttttttttttttgagacagagtctcacactgtcaccccggctggagtgcaatggcgtgatctctgctcactgcaacctcccaggttcaaacaattttcctccctcagcctcccaagtggctgggattacaggtgcccgccaccacacccggctaattttttgtatttttagtagagatggggtttcaccatgttggccaagctggtctcaaactcctgacctcgtgatcctcctgcctcggcctcccatagtgctgggattacagacatgagccactgcacctggcctggaaggaacctttaacagagacttttatagatacctctgaggtttaaaggccactaaggagaagatccagggcactggaatgcctgaaccccagaatgggctgatgaaataaagtcccctttacccctggttccatcacactggcctgccctttgcctgttgtggcctctaacctgtctatcctttaaggttcagactcttgattctaacttgttatggctatgtatcttatttggaatctctaatgcttgaatctactgcttccagaaagctttcctggccttatcaatctaccctagagtctcctgcttctgagtttaggggtgggaacaggtgacaggcagtatatcaggacacaaggaggtctcaggggttaccctgtcactctgggtcgatgcttgggctgggtgctgtcagcttccctccctagttgctataagagtgccactgtgagtcttctcaaagtgtctcccgctttgctccctctcttttactgtcatgctcccttctaggatggacctggatccccagcccattggaataggctgttcccaagtttgggtaaacaccatgtccaagacacccttctccctttttgcagacatttcttctatatacatttctcaagggcccactgacctcttccaggctgatgatgtgtaacccaaagccttgagctcattctcactgggtcattcagtccatcctcccagaggactgcttcatcaattgctttgtttgtgcttttccccaggatctcagttggctttgagatgtttgactcatcgtcagtacttcccaatttcctcctgaaggtaccaaccatgtttgctaatttaaccatcagatatcccgtccgagttgctcatgagcatgagaaaacactaacgccttttttcccgtgggtggtatttgttggcttgtaaatctgaacaggaagagtacatttatttggagaaactatgaaatgcctacccttgaagagtgtttttgttgggggcagcaagagagtctgtatgcccataagtaccgggattcaggacttgagatcaggctagaggccagagataaggacctctttctaatctttgctgcaaatgaaaatggtcaataaatcagaactatttatggaatgcctaccatgttcagataacaggagaatgagaagttataaaaacaggcaaaaccatcttgactgaaaacttaacctaccacttgttggaggcctttgggactaaatctcacaggggtgcttgttgtctagaaattgagaacataatttagctcctgcttgagactgagaagtcctttgttatgtttattagatggggctgagttttaggatggcagaaatgcaaccttaactttctattcagcacctttaatgtatttctgctgaatacagaagacagttaatgtctctgaccccatttttttatttggagaaaagatctagcaatacctacctcaggctgtagttctgagaagtatattaagttcgttttcacactgctatgaagaagtacttgagactgggtaatttataaaggaaggaggtttaattgactcacagttccatgtggctggggaggcctcaggaaatcatggtggaaggcaaagggaagcaaggcatatcttacatggtggcaggatagagagagtgagggaaagtgccacacttttaaaccaccagatcttgtgagaactccctcactatcatgagaacagtgtgaggaaaaacactcccatgatccaatcacctcccaccaagttcttccctcgacatgtggggattacagttcaaggtgagatttgggtggggacgcagagacaaaccacatcaagaagtaaacaaaacattgtatgtcaggcactttgcaatgtacttggcacccaataggcaccaatgaacagacgatgctattgtagctggaccatcattgccggtgcctcctgggaagcagatgggaaacagtgttcatgttgtgtcctaccttgtcccatggaaaatcctgattttgagttctcttatctctcagattttatagtgttaagttagcacactgtagacagggtacatggaaaaatgtctggtgtccctgacacaagaaaagggacaaatctctctaagagagccatctggggtcttgtattgatgaaagcagtaaagaactgtggaaggagagaaaagctaagtgtctaaatgaagagtttgctacacacattctcaagggtgaagactggacaagacagactggcagaaggagaggagctaaggggtgatggtcccaggaaagaatggtgagcagcatcaagggtagtcaaagttgaaatagagaaggacaagccagttataaaatgagttgactggggcagcaaggctccaccttcttcccagtcagacatcagaacccatagcccagactctgcatgtatttaaagggactagaagacaatatggacccaaaagaggacagtctgcccatctttaggaaggagtcccctctcattttccttgtggatgctgtccatggaagtagacagccctcaactttcttcacagagcaaacttaccttcacctcagttgtgtgcctcacacttacatcagctcaaatagcatgaattctttaaaactacagaaattgttattgttacagcagtttgttcccaaggaacaaaggccacagcaggctggtattattttaatttttccatgacccatttatcaaaaataatgataagatttgaaatagatttcaacatggttaatgagatatttgcaatgcagtttatccgaagtggaagggcctagacatctaaactggttgtctggcaagattaaccttgtgtactttgccccatcttttgagagaaagatctctctaaatttcaaagaaaaaggcatcatttatttgcacctgaatggtacatttctgttcagaaaactgaaatcagctgcatacacagaacccggttgggacaacgtcaccactggggagagggtgagacaggccagatttatgaatacccaaggagggaataagcagatcaagatccatgtgggtacagaaggagatctaaatatgctacacttgtgaaaatttcatttgaataaggaatcaaattgcatcattttattttatttcttattttttagagatggggtattgctctgtcacccaggctggagtacagtggcctgatcatagctgactgcagcttcaaacatctgggtgcaattgttcctcctacctaagcctcccaagtagctggggctacaagtgtgtaccacaatgcctggctatttaaaagaaaaatttgtagagacctgggtcttgctctgttgcccctaggctggtcccaaactcctggcctcaagtgatgctccaccttggccttccaaagtgctgggattacaagtgtgagccaccccacccggccctactttatttattttttttttttttggagacggagtcttactctgttgcccaggctggagtgcagtggcacaatctcagctcactgcaacctctgcctcctgggttcaagtgattctcctgcctcagcttgccatgtagctgggattacaggctcgcaccaccacatctggctaatttttgtatttttagtagagacggggtttcaccgtgttggccaggctggtttcgagctcctgacctcaagtgagatgccctcctcagcctcccaaagtgctgggattacaggcatgagccaatgtacccggacccggccctacatctttttaatgttatgtctattctccttaagactgaagttctgtgtcttgctcttctggtgtatccaattagaagttgaagcaagagatgatcaattccatttaacaaaagaatagagaaaaatgtgtccgacacagcagttgctctcttaaaacaaagtgctatctcatgccttgccctgtagctttcataaaagtattttcaaagtctgcaaaaatgggcaggaaaaagtaatattctggaaaaagtgtatgaagtgggtaaggatgttggcctggtgggtctgggtatagagctaacactgtatagagtagaattttctaagttttaaagtttccccaattgccagagctcaagtatgtgttgtggattgcatttttccagattcaaagctattccctcctttaacattcccgctgtcttcttttcccccagtacgtgtattaatgacccaaacaagaaagacttcatgatggatggtgcttatttaattggccaaaatggaacgatgtgcactttcggaatccctttaattcttgagactaatctacatattggcaacttgtcataagaaatgggtagcaaacgctgaatcaaaactttttaggcttggcagcagtaaaatggcaatgtattaaatattctcttaggagactggagagtaaccattgtataagtgtaatgcagtcatggtaagataatggattaaatggcctcctttaggatattggctttgtatatctcatgtattaaaaaaaatactctttctgattttaatgtgtctctttaagcacacacaaaatggacaatggtcagtaatgagttactgcgttcaggatgaggggatgtttgcaacctgttctgtgcatccaaattccagcctgcctgtaggtttcctgctagagttcacaaggcttcatggctaaacttcctggtggggcttggaatgaaattttcccaggagaccacatggtgatttggaaccagaagagcttgtttacataagatcttctgcatgtaccagttgagagagattgggaaggccactgaaatttgtctctaagaaatatgaatgataatacttggtatttttctttcaaagagattgtgaggactggacaaagtggtggtttgaaaatatttcatatactgcaaagccttgcacaaatattgttattatgattataaaggctcttcctggtctgtaaaaaaaacattttcccaagtcctcccctatcttctatcagccatagtgaatccctgtctattcttagcatgtttgtgcgagggatatgtgaaagcgttggtgtcctcttgtccctctgttaaggactcagacaggatgccgggcacatttgtatccagacatcgttgagatgttttgaaatcggtctggtaagaaccaaagctatgtttccaattaattttctaagtacaaatatgctcaaagtacatttttttttaaaaaagaattcaacaataaagtatggcttgttgctgttcgactgccagaaactcgggatctctatgagtttcactgatatcaaaggcttctgtttaatataactttgtattaaagtgggccttactgtcaacctagcaaaacctcatgtttaatctcaagtttagtgtagtttttttattaatccaatgtgcatctgttaaaaataactccagataatgcaacatttgattaaatggaacttaatacagccattagctggtgggattttttttttccatttacgcattccaagctgagcctgataagatggcactaacatttagcctgaggtgtggaatgttaatagtgggatcttggacagtttgtttattttttatttatttcctgaatgtgccactcacagcaatgtgccagatgggcggcctggaaggcagaaattctctgtttagcctcggagccccaagaaactggcagattagcccccacccccagggcagccccagcttggtagaaaaaggcagaggggtaacattaaatcagagctgcagtatgtttttgttcttttgtcaaaggactgtgcaagtaacatgcttttcagggttggccatgcaaataacatgtcaagtgaaactttaccacctttttacttaggctatatagaaggaaggcctaaaaaatgccctggtcctcttgagcattttgagcccaggctgtcctggtggcaataggtttcctctgttgagaagtcctgcagctctggtgggttaggaccaccctccgcctggcactgagtgggtactctgtcacttcttggagccattaggctgaacagtagccagagaatacagaggccccattcattttgtcggtgcacatttattgggtagttactgtgtgctaggtaggatactaagccctgaagacagggcagtaaaaaagatagactcagtccctgccctcatggaactgacattctatctaacatctagctgctagttgaggatgctgcccatctctgctggtttgtaaaatttggtttctactctattaactgaatttcagctcactgaattagacttatgttccatggaccagttggtcttttgcaataattcttatactggtatttttagtgattttatgttagttttaatttcttcaagataaggattttggtttgatttgattcaacagttatttacaaacttcctattgtgtgtaagacttgacattcttcactactcccagcctctcccagggtgaagaggcaaaatgtacccccttccctcttgcctagcccatccaggaaggccgtcaagaaagggcaagttatataccacacgatgctgtcacatctaaaaggacactatccacatcacagagactgtaaatgtgtatttttatagtggtttcctgacagatgatgtgtcttgttctaagaaaatcattgtatgttaaggatattaagaaaatgtcccccatagcaaatgaaccttgaatcagattctttaaaaagaatcacattctttttaaaattagtataaagacactctgtaagccagtgggccccttgctcctttcctttcccttgtatcagggaccaggaccattcttctagttcattactgcaacagaggggaaaaatagtggagtcagagtggattccagttttaaccatgcaaatcaaccagctgtgtagcttcaagcacaacctataatcattttgagcttcaatttcctcatcagtaaaatggggattatccccatacctcatggagttgttaagaagatcaaatagagtaattctgggaatatgctctgctccatgtgcttgaactcaatggatgttatttcaatctggttgctggtatggggacagaggtaaggaagggaagtggggcatgaacctgccaagagacttgatgggagacagatcttacttctgtgtcctctgagtgactgggtgagttcgggggaccattttgtcctgggaaggctcatcactgaagacttgaaaacctctttcatttttagcaattcagagaaaggcattcaatttttttttattttcatcctggggattgcagtttacatgtgcaagaaaatgagggtgtcattctcctagttcccaggcacctaggctgattcattgcagcattaggagtggttaatggcaattgaagtagcagcagtttttggcagcaagcaggaccccaccagagaccctgggtaactcccaggtgttattgcaacctgtctggctttcgatggagctcactggttttcccatcaagctatctgccagtctcctgctttcatttcctgggcagagattcagaggtcagccggaaacccctttgcattgctgcagaggggctgatgcatccattgattctcatatttggttttgatcacagattgaaattagattgcttcctttcctggctgggattatgatagcactctgtagtttaagaaaatttattcactgtgcgttttgtttcttgaaaagccagataatttgtttctgtcctctactcaaagaaactcagtgaggactggccagactccaggagtaatgaggtgatggtgagaaaaacaccacccaaagacatgaatctttattagacccttcttgttgtgttggtggcaatattgcagtgcacaaggtgatgggtcttgatttccttctggcttgactggggtcggctagttccctcttgcggggcctttgtatcccagatggtggaatgtgtctaagtttggcaacccatattcacctgatggaataacacttccaaagtgtacatacaactgagaagatggagggggtttagcactcacgttctgggccatgtgtagatttgtgttttcattttcaagttgtcttcaagctcctctagggaggatgagtggatggaagggaatgttttatctgtatttgtagggagcttcctgagactccaaaggctggaatcctgtgactgaaacttgttacaaagaataaagtaatagagaggtgttcaaacccaagaggaggaggatggttcccaaaatttctcagttcttcataccctttgtttctcagtcattttttttcacaatgcctctaggcgaatgattgcatgtacacacacacacacacacacacacacacacacacagttctgtttattaagtagttagatcccaataagttaatttatgtcttaacagcttagtagccatttgaaaaaataggtatacattgaaagaaaatgtttttattaggccaggcgtggtgactcatgcctgtaatgccagcacttttggaagctgaggcgggtggatcacttgaggttgggagtttgagaccagcctgcccaagatggtgaaaccccatctctactaaaaatacaaaattagctgggcatggtggtgtgtgcctgtcatcccagctacttgggaggctgaggcaggagaatcgctttgacgctggagtcggaagtttcagtgagctaagattgtgcgactgcactccagcctgggtgacagagcgagattctgtctcaaaaaaaaaaaagtttttattcttaaataaccaaattagttaccagtgagatgtgtgtacctgttgggtactgcacagcatcacaaatcttggaatcaggttggacagtaccaccctgtttttgtgttccccactgattttcatgcagtacttgctttttatcacagcaaccactgaaatctcacttttgaaaagatatggcataatcagaaggaatgtagcatgatctaatgttgacactgagaactacattgacctactggtttgcagagtgacagatgtcatgtattgctgtattttccttgaaaatttaacatatttcaaaattaagttcaaattaatttaaatgtcccacagtgttcctatgtgtttgctgtggtgacccagggcccttcagcatacagctgggagcctagatcctgagcacaagatgctctcagataatccaaaacctggaggaaaggagtgcttgtctagtctcctgtccttatagtggctttcaggctcacctctgacccaccactaaaggaagatgcgccctgcacacagtgcatcaaattttatgattctagagggtgaagtgaaatctggctacgcaccgcaactagtagccctgcactgggttcctccttggtagccagctccaacaggtactgtgggacttgtttcttgtgctagcatagcctcgacctcaaggaagaagcaatcttggggagactgtcacaagctcaaggtggacaaagattctctgtctgaaggctcacaattcaaactggtcatttttgcagaatgcttctctttcctcggcacaaatgagagaaattgaactggattaagtaattaaacaatgattacatttaattaaattaggatttaaaaaaaaaatttccactcggatttttctaaagtggcatcattttcaagctgaacaagaatacgccctggaagtacaggaaaagacttctgtgcaaaattggcaacagaatccctaaatgcaagttctgggggtctagggattaaatgagaataatttaaatgggaaaaggccactttgcctccagtggaatgaaaacctttttcaaggtttacatttctgacaattttggtaaatcttcatgttttgatttgactgccagtgactggacattttcctttggaggcctagggcctgaacacattctgtcaagtttattatccaaggaggagattcctttcagtcccagatgggtgtgtggtagcaggtgggaattgccattgaaaagttgggagaccctaaatctcttttcatcagatctgaatgttggtggcaatatagaaatgcattgaagtgtttctaacaaagctgccctccctgcctagcattcagagggggaaagagggtattttgcaccatgacaacaggtgacctctatttggaattgtcaacaaacattaataggccttccaaaacacatacgctgtaatataagggattggttgcctgaagggagggccgggtattcagcagcactggggcagctcttacaggatgtcagcagacgtggttaattggtaatgattagggctgtctgcaagctgattccctaagtttggtgaacacataattgttgtatgtaaccccgagcggctttgctctttcatctatatgaagagatcagaaaagagagatttacggcttaggttgccccaagccacacatagcaggcttaattttcctttccaagggaatttgaagactgctgttgtgactagttctctgtggcttatatggtatgttgaggtcacctgcgagtttttgttaaatgattgattgactgaaattaattattctgtcagagctgtaatggcggtaagatggggtgcactgataaatacaaaagctaaagtgattcttataaatgcactatgtctctttctatttaaataaatcagacagaatacatagatcctggatggtgttgagtgtcccctccccattttcctctatagccctgagctgttttctttccaaatctgaagctttgaaatgagcggctatttactcaatttaactgcaggatatttgaatcctttgtcacttcattccttctaacctttccccaaacacctcagcccctgataagaggctgatgcccatgactgccttagattaaatcaactgaattgagagtctgtgtttgagctaatggctaggcaacttggggaatgtggctggtgagttggagagtggatagaaggcaggtgtttgcttctaaatgtcagatttctgaggcatggaaaccaccctgtagggcccttttaggagggcagtgaaagcagctgtttagtgacagactgtctgcagtttgggtccttaaatcccatgaagggattccagtggctggttaaggaaatgccaaaatgactctttcgattaccttgcaaagggcatgagattatttataagtgatgtatccaacttacttccaagtcactggaaacgatcgttagaaaaagccttttcccacacaggccctgatcatgacaaaggttccaggacatcttctgggagtggcaccaggttcaaaatgagcaagaacacatgggaggtacagaaaaagacttgtgggcaaattggccaagacagcagaataacaaacccaggtctcgcgtgcggtatgcctgtggggaaaacatctatggagtagggtcgtctagtcctttgtgtaagtgtgaaaaacttgttggcattggatagggtgatatgcttcccaagtctgttaccaacactcctaagttaaaagtaaacagcagtcacttgcttccttggttcttagattctagtgtgctcttttagaatattctagagtgcttgttaaatatgcagattcctgggaaccacctccagtgagtctaatttcttagatatgacacagagcttgggactcttcattttcttcagtaagttccatggtgattttggtgcagattgtcccaactgtccagttctttatttaacaattgatcagaccaggggccaagagaagaaactacagctgttccatttgacaaaaatagccctccaaaaggcctgcgactagtcaacatgcagatggaacttcttgagtttgagtaattttacgcatcttaagatcagccctggctatttcaatgccaatcatcttgaggtataccagctattgaatgcatggctccctgaatatctcagaaaatgaaatggttaaaataggaggggtattgaaaattgctgtttcttgttgatagttaaaatttcattggctggatgtgatttaagcagcaacataagattcatttaaactgtcataaattaagacatcctattatggagggaaattttttagaaatctttcccagcaatttctaaaaagagtaggactaacttggaactctttgtagtcattcctgctaaaggtaagaatgggcgtgctctctctagtctattaccctgtgatttagttaggtagagctcagacttgcactgctccgaacaatgtgttgtgaagttaaattgaaggcctgaaaaggtatgcatatatcccactactttatgaactctgtgactcataatgccttacaatatatttgaaagcaaattaaagactttataaaatgtttttaagtatgcccctcctcttttaaaacatttatggcttctataaatgctatataaaatgctttggagagtggtcatcgctggactaaggctaggttgcataaatatttagttagagatatgagcgtgtttcttgaagctgtacatgtgtcggagtttccttgctgttcctgcaaagtcaggcctgttagcaatgtgatggaagataaaggaagcggggagccaagatggaaatgcatatttgccatcgcaggggatagtgctccattaaagtatcactgtttttgtttctgtacttaaaaaatttaaacatgtctttgattgcagactgttttcattgtgtcattttaaataataattaggctccctgcttcaatcattctcttttaaagtgatttcggaagtccatgactggaaagatccggtatttaaaggaaaggcacctctgaggctaacaactggtggtgtcatttgaccaagaactttcccagaaaattcatctggggatccttaggctcttttagaatattgagttttgttttattgttatttttaatcccaaatacaccagatgttattattatcgcatatctctgggaagagaagaagctaagatgaatgtgcccttattttttatgtacttctagtagctgtgcaatcttcaatgacagtgaacagaatatatgcccatgaaactgaccagaaaacaaaaatgtgttgctgtctgcaatgtgccagtcactgtgataggcagtgagcttcaaaaatgagtaaagcatggccctagggagtcagagatccaagcagaaaattatagtaaaatgtgataaaatgtgtataaggagaggcctgcagcaggagaagctaattctaactggagctttcaggagaaatgatgactgtaaagtgaggaggtagaatctgtgtattcattatttagcttgaaagcactaacttgcgtcaacccatacttgatattttgatggtggacaaataatggcatttattcaggcagggagtagagccagtgcaaaggtacagagacttgaagggacaggatatagcagaaaattagtggtgtgcagtattgcttgagcaacatttgcaaggaggttggggttaccactgggctaagaggtatacagggactagagtatgaagaattttgagtctgttgcagaagtgcttagatttggcctgtttgtagtaggggaaccactgagttatttcggatggacaagaacaggataagatttgtgttttgagaaaaagtttttggaatcaggagcatctcaattgcatcccatgcccttggaaaatggaagggaaaatctgaggctcctaacacttctttcctgacatctgcttccattatttttttgtcatggggcagtcagggatgcctgggctctaacactgtttgggtatccgggtacacaaggtaggatgaagagagaaaggaatgaagagtagaaaaatgaacataatagaattatgagcttgaatctcacataggctcacatgtccaggcattattttgctgctttgataatacttgtggcacacatgggaatcctgaaaggtgcaaagtctcatgttggatctgtaagatgtagcttcttagcttatgaggcagttggaaaacgttaggctttgttctctccagtgcttaagttattcactggaagtgctctagctaccatatcaacctgtctctgcagacagaccatgggtcagacacttggatggaaagtccaatatgtgcttgatgatccagaaaggagttatatgaaaaaggaattttttatcaaaaggccacaaaatactctatcaaacaaagtcaagcaagcttcctttctttgcagcttctcaagcctttaatgttccaaagtacaatatgaatctccaagacaatgatggaatgtgtcctaattttatataatttcctaaaattatttgtgaaaacttatttttttctacaaagcatcttgtgaaacttgtgtttcctgggatgctctttggtcaaagccactcttgagattcatttttacaggcctcctaattgtacattgaatggaattcccttcatcaaaagttgtgcctactcagttcctaaaatgccagagggagtgaaaaccagaccattcagcaaaaacaaaaggtgccccctactaataatttgacatcatgttggtgaaacaaaggcttgcattcctcccattctaactggttgcttttgcaaagacacaacttccggttctggtgggcagaatggggtctgttgggaaggttccagcaaaaggcaactcttcttgaccttgtaccattgaaagtcacagagctattaaagtagcgaccagggcattcagaagagctgtgactaggcataatgtgccttttgagggtgaccattcatttgtccatctaattagcactcagcacctttgattgccccatacatctttaaaaaattcaaataggtagtgaaaactgcttggattgcagggctcagatgaaaattgaggcctggccttgtatttatggaggtttcttctttccaggacgtcttacctgtttccttagccctgttctcagtaatgcctgccacaaagaaccccataaatttagcatttgcagctataagtttgtcattcttttcttgaaataagataagggtactattataaaacagcagaaggctgaatgtgagagcagccgacatattgttgactgattcatctggggcatttagttcttcaaaatggaaaaacaaaatagggtctaaaaagcaaacacagtaaattaaaggaatgttattctatgcatagaacagctgttttaatacttgcttggtagggtcatgtgactgacccacttcttttaggataaaatatgtcttcctctaaggttattattaaagacacatggagacatttactttggtctccttgtcagcattgtgccacattacaagaaaatacaaaacaccatttaaattgggtttagatccttcatttgcatgaaaacgatagttaattgtgtccctgtgatgataattagtgttcagctaagaggaccttttcattgttggcccgaggtgaggcctgagttactaagaattgtactggtggtagctgttttcttttaagtaactgcacagctctgtctgttttgccaactggcaaaatgaattaacaggaagtgaaacatttagtgtttacatgagctaggacattgttacccaacacaaggagaaagctcactttgggccttctttggttatgggatgcttattgtctaatttcttcagcaaacatggagtacctactcaatattaggacctggtgtgccctgcacaattagaagctctcagagagcagggactccacagtagcataattgaaatctctgttcactttgaatcctgaactagaaatgttctcacccacctgaggcttgaccatgttttcagagctgccacgtggcaggaaaagagtccaaatctgctccttctgcagtgatctctccctgtgctacttccttacactgctttgctctgtaccagccattcaggaagatttatcaagtggctagttattatagaacaggacagaatactgggccagatcccccctccatcccacttaactgtgccttaatcattaagtgttctccagttgacctctctgtgaactcctaaaaggtcaagaccaattctgtttcaccttagaacatgcaattctgtagtgcattacatgcatgcaattgcattatatccaacgtgtaataaatatgtgctgaatgcatgaatgagagaatgaatgaatgatcttgccgtatttcaacttagcacagggtccattctctacctttgtgacatctagctacatcttgcgttgtcttctggtggtagggtcctggctaccttatggtgcaacccttttctctatgggcaactctgactgtaaaatggtcctttctctttttaatatccagtcagctgtaacatcacggggtctacctcctgaagccatgtggagtttggtctgattcctctttcacataattcttcagctattggaagacacctggtatatgtttctcatctccatatttaacataacagtttcctcagttggtcctcatatgacatggttccccaatacatctctatctttaatgctttcatatcaacatagtaatttaaccagtggtttaaaaaaattattttattttgttttaatgagcgtggagccagaactgagcatagtatttcatgaaggaatgatcagggcagaatagatacagatcattgccttcctccatctgaccttctgcttatactatttttataattggggactgtacaattcattattttattgcatttcattttcagcagtcatgccattgaattgattcatacaaactagcggttatctaaaccagtggttctcaagtgggggtgatttttatctccctggagacagttggcaatgtttggagaccttattgattttcagtactggcggttggttgtgacactaatatttagtgggtagaagccgtggatatggctaaacatcctacaatgcacagggcagcccttccacaataaagaattagctgtttaaaatgttagtagtggccgggtgcattggttcacacctgtaatcttaacactttgggaggccaaggaaggcggatcacttgaagtcaggagtttgagacccgcctggtcaatatagtgaaaccccatctctactaaaaaatacaaaaattagccgggcatgatgacatgcacctgtaatcccagctactcgggagtctgaggcagaagaatcgcttgaacccaggaggcagaggctgcggtgagtcgagatcgcgccaccacactccagcctgggcaacagagagatactccatttcaaaaaaaaaaaaaattgttagtagttccactgctgagaaattctggtctaaactacacagtctttgtccttggggcctcctgaagtagaccttgatcccaggctacatgagatcttgcaaatctttaaaagtgattcagtaggaccatgtccttgtaggtgaagcttttccaggccctctgtcaaccatttcttccaagacttctactttcttaactttctggtcacccaccttgcagttagagcagtgctcctgggatggaatgctttggttgtcatctgaagcctaggacagtgcttctcaaactttactgtgcctagaaaccacctggagattttgttaaaatcacattctgattcagtgggtctagggtggaggaagactgcatttctaaaaagctcacaggtggtgcctggggcagaaggccagtgggccgcactttgaggaggaagagtcttagcatgttttctcttggcattgtttggacaaaggctttttccattcccttggagcagagtgcaagcctcttatgctgggaacctttgactgtcacactcagccctggccatgtgtcaggacagagtagttgagcaccatgatgttataatgctgaagaagactaatggcctgcttaattgctgagcagtgtttataacttacaggtctttgcatcgccctattctaggttaaggagaaacaataacaaagcgatattactctcctaattgaaagttggagggtggaatgaaggaggagctgcccccagtcacagacttggaggaatgaactatccagttgtgagctggtttctccagattatgcatatgtttataaattatcctaggtgttctttttcctcattccttttattgtagagtgtatttctttaaagtgacaggttttatttttttccccactctgtgcagatttcgaggatgatgtagcttaataaatcaaactgatttctactattgtatgaagactccttaatcagttctttgaattaatgcaatcaaatggttgaattcttacattcatctctgtatttatggctctgttgtgcttttttattgaattggaagaggaatatcttcattcacagccaaaataaaataaatctaggcaggttatctagtaaaatgactaaggtatagggtatgggatgtgtatgtgtgtgtgcacttgtgtgtgaatgtgtgcctaaaaatacagatgtcatctgtgtcgttctaatattaaattttgttttggaacttcatattcatgaagccagcattatgtcaaactctgtgataatggtcctgtttttaccaggtcatgaatccaggggttctcaaacatgttcaagaagcagggcatttgaaaattatggtgtttcttgagtgataccatggatttcatatgccccggtttaagggcacaggctctagagttaggcaacctagaggaattcccgtttcctccatggactggctatgtgaccttgttacttaacttctctattcctcctttcccttatccttaaagtagggataatactgaagtgtctatcttgcagaaccatgctgaggcttagaaccacaggcatttacttgtatccttgacacccatgcagcaagtatgtgctacgtggagaccattattagtattaacccaaacttaaaacggctaaatatagcattttctgccaaatcagaaatgctatcttatggcacattctctcagagacaatagtcacaggcactgaggatgtaagaaaaatgattagaggacaataataaaattgaaatagtgctatcctttaacaaattgggaagctatctccattattgagttttaatccaggatcttggcagacacaggagtttggctgagagagtttgtgcattagccctaccctgctttttcacgtgctctgaagcatcctgaatctacaacatgtgatgcacattgaaacctctttctttctgattttacaatatcagtatggtacaccgatcaattaaaaatactttgtaaacatatgtggagtaagactccacttcaaaaaaaatttttttgagacagagtgtcactctgtcacccaggctggagtgcagtggcacaatcttgccttactgcagccttgacctcccaggctcaagtgatcctcctgcctcagcctcccaagtagctgggactataggcgtgtgccaccaagcctggctaatttttttttatttttagtagagatgatgtttcatgatgtttcccaggctggtcttgaactcctgaactgaagcaatcctcctgcctctgcctactcaagtgctgggatgacaggcatgagccactgcatccagcttagacctcatttttaaaatatggcaggcatacatctgaatgtatgcatgtttaatggagctaatgatagaaacgttagagagtgattattctaattactaaacaattcacaggatttcttaccacagcaaatgcctttcatgtctactttttgccagtttataatatggttcacaaacataaaagttctctgtcttaaaattctgatgccattcatcgatctagttggatgagtttttattacttgcataagaggggattggggtgggatggtcatatgggtttgtaggcatctacaaacagcatgctgtaaagtcttatttcttgagttttcaccagtagcaatagtcttattgctaatcgacttcatcataaaaattgtacttgatattggatagcatgccacatattaccaaccactttcacgtgtatattttttctttttctttttcttttttttttttttctttctgagacagggcttagctcttgttgctcaggctggagtgcagtggcacaatctcggctcactgcagcgcctgcctcccaggttcaagctattctcctgcctcagcctcctgagtagctgggattacaggtgcctgccaccacgcccagctaatttttgtatttcagtagagatggggtttcgccatgttggccaggctggtctcaaattcctgacctcaggtgatctgcctgccttggcctcccaaagtgctgggattacaggcgtgagccaccatgcctggccaattttttttatttcgtaacgcttagtgaccccatattattagtattattatttttatttatttatttatttatttatttatttatttatttatatttagacggagtttcgctcttgctgcccaggctggagtgcaatagtgtgatctcggctccccgtaacctctacctcctgggtacaagcgattctcctgcctcagcctcccaagtagctgggattacaggcatgcaccaccacgccagctaactttgtatttttagtagagatggagtttcaccatattgtctgggctggtctcaaactcttgacctcatgatccgcctgtcttggcctcccaaagtgcagggattacaggcgtgagccccacgcccggagtggccctatattattattgaagaaagatacagagagctgaaatgatttgtcgaatgtcacatgacttgtaagcaccagagctaggtctcataccaagttctgcttcttccaaatccgttgtccagcttgttgggtatgtctgagtccctgttagccacaatgccataattgttatagtgttcttagagtagagctcagagcctattatgttgcatctgtatctcatcctcacctcttcttttgttggatacatttttcatgatttgctgaggatattgtggacttagtgtcaaatatttttcaggtcagaagttttgtagcccttggaaatcaaccaataacctatgtaaaactggtgccgatgtttctgctgagagcttcagaactgctatatcaattagcttttgctgggtaaaaaactactccccacaattagtgacttaaaacagcaaatatttctttagttcccagttgtgcagattggcagtttggactcggttggatggttctttgcaatcagagcggtcctggctcttcttggctggtctttctcacaggtctttggtctcagctggggaccctaggatggcttatatggctggggtctctcttcatgtggcctttcctttttcagcaggttagtctcagtgttgttcacatggtggcttcagagttccatgagcagcaaagaacaagccccgtacctttcaagtctgattctgtcacgttggctacttttttattgctcaaagctagttatgtggccaagcccagagtcaacataagaagggattgttttggcgagaaatcaccagggacacagatacagggagatctgaacaaattgagagccattaccgcaacagtctgttacactgccacatcaagttttcctttccttccaaactttttgagtgaagttctaatgccctgaaaacccaggagatactttctcttcactgaggcatttccttccctgacttcctccatgggacagcttggcattaatgaattgaaagattgtccttagtcagggcttttctgacttcttaatggtgtgcatgtaacttctccttgtcaggtttccctttagaaatgcatgcatttatttggaatccggatgctggagttttctgtttggaaaagaattttaatgaaactttatcaggtgtgtgttcaccaaaatgaagaggactcttttgtgtccagagaaagctatctggcagtcaggagccctttagaaaaaggactgcagaatgaaggaaagctaaacctctctttaatgattttctctttttaaaacatattactttgcatgaaaatttgtgtcaaggagtttagctcatggaaggggaacttgatgtgcaatctggaggaaggagcggacactagatgataattctcaagcagatgaaagagaatatttcacattgctgagacacatgtgacttctttggatgcaaataacagaaaggttgatgacagttatccctgttccctgctctgcggagaaatcaccagcttagcaacactaaatggcaaggcatttgtggctgagttctttctctgactaattggaaacacatctctctattttcctgccattgagaaagagctactctttggtaaatggtattcagtggtttacttttctaaaaactcagccctgtgctgagcttttggtcagaagaatggaaatgctttctaatgccagagagcatgagtactttttgtggagacagtgggatccattagaaagtgactggacattttggagtcccaacttggtagaatctcacaagttctgctccctgtgagttcaacaacttgaacaaatcccttctcttctctggcctcagcttcttcacttgtaaaatgagaagaatggagcaaataatttcaaagggtttaaaaaaaatgtttttgaatagagactgcgtctcactcactgtgttgcccaggctgctctcaacctcctgggctcaagtgatcctcctgccttggtctcccgaagtgctaggattacaggcatgagccactgtccctggcccaaagtattttttaatctctgtcaggtcagactataatttggaaaaatatatatttaatttttggttataaatttaggattttgagatttggtgattcggagaagacattgtgaaatacttactgggtttatggcagaggacactttgtaaaacaaaacaaagcaaatctctattcttgccctgatagggattgtgccacccatctctccatgtgcccgtccacccatctctattccatgtgcccgtccacccatctctattccatgtacttgtccacccatctctccatgtgcctgtccacccatctctattccatgtgcccatctacccatctctatttcatgtgcccatccacccatctctatttcatgtgcccatccacccatctctccatgtgtctgtccacccatttctccatgttcccatccacccatctctatctcatgtggccatctacccatctctccatgtgcccgtccacccatccctattccatgtgcccatctacccatctctattccatgtgcccatcccacccatctctattccatgtgcccatccacccatctctatttcatgtgcctgtccacccatctctattccatgtgcctgtccacccgtctctattccatgtgcctgtccacccatctctattttatgtatccatcaacccatctctccatgtgcccgtccacccatctctattccatgtgcccatccacccatctctccatgtgcccatctacccatctctattccatgtgcctgtccacccatctctattccatgtgcccgtccacccatctctattccatgtgcccatccacccatctttatttcatgtgcctgtccacccatctctattccatgtgcccatccacccatctctccatgtgcccatccacccatctctattccatgtgcccatctacccatctctattccatatgcctgtccactcatctctccatgtgcccattcacccacatatccactaccttcttattttcttcatttgttccagacattagtgttaaggtgcttaacttctttaatttatccagctcttgcagggaaacaagacacagtttttaaatagcaaatgaggaaagtgaggccacaaggttatatcatttacccaatgtcctcagatggtataggggaaaattacgactaatccccaattgtaggtccagggctctttccctaagatacaacacttcttttgtgcctcttctaaaatgtcctagaaaagccagaacctgacatctgtttcttaagtttggggtggcccaaggtcccaatctagggcttaattgttgaatgagaaagaaatagggttatttcctttccggaagaatgttatttgagctgccatcctccaccataaatgaagatggtaggtttttgagcactctgtggctagaagaatgatgaacattatgagagatccagaaaaatcaggagaatccctggcttctggagtttactggcagagtctgatatgacagtgacatactcatgacatcacccatgacagtgatatatttgacaaatgagggccccacataataagtagtcattttcatagtacttaagaaaagggagacagaggcccctagcaaccgtgggatcctctaactgccagaggtagtagaggatgcctaggtcccaagagcgcacttaaaaaagagaggaaaagccacttcttcctaagtaactttctctggaaagctgtgatgtccctccagaggggcttaggacagaggttgttggacccggaagagcatatttcacctaaatcttggggtgaaaacacagaccagatggggtgcctcttctgtgtctctccatataaagaaggatatatcctgggtttcgaggtggattcaattcttaaaacagaccccatcatccaccccaggcaattttgtttgatcccaagttcagtaatgtgaagtaaagtttcccagactttaatggcttaaaatgaaagagaatcatgtttttctgtctgaaactggaaatccaaagagttgctcagtgagaatgttcagacttctaccttgaggctcagctacaggaaattgggaaatttgggtcagatgtctcattcacattccaaattgataaagggtgggaacgtttggagaattgtctgaatcataatgctactgagaaagttagaaaatataggattattattccctaaattacttttctttgtgggggtgcggggtgaaggggaggaggttgaggagaaattgtcagtatgctctagatggcagagagtggtgtttcatttagctattccagtgggtggattgtaccagtgtagagatgctgggccttcctgttgtgaagtaactcttgggggaagttggctggtggtaggatatgcagatctttgctactgaaaatggggtctttgggccagcaacattggcatcaccagggagcctgtcagaaatgcagaatcgttgaggccaccatcccagacctactgaattagcatccaccttttaacaaaacctcccagtgacccatacgcatgggaaactcgagaagcattggcctagataatcatccactgggacgatgaaaggcacacatcctctccttcctcccgtcgatcaaaagacgcatctggattggtttcttgattttgtcgatgatgacctaagagaaagggagtttaacctccaggagctgaactcagcagtgggactgtgctgcctcatctccagctactaaccgttctatccaccctgaccctctcactgttctcagaacaggttggaacctcttacgacgttgtgcttgtcccactgcctggaatgctttttctctctttcctcacacatcaaactcctgtcacctttcataagcttgctcacatggcatcttttctgggaaacattcctcattttccccaggtaggattaggtactgtaccttctgtttacttatgcctctaataaattacagtagtacaggaaagtatgcatgtctgttttcctttctggactgggaactcctggaggatcttacaccccttgtgatcacctctgtgtcctcagcccctaacacagagcaggcatgtaatccatatctgttgcatggctgcatgaaaatacaggtgaactggctgtgaatgccttttgtgggactctgggaagttctcgttcttccaggcagctgtgtgggctgtgttaatcataaatttctggatccatgaggctcccaagttaaagactgggtcagcactgagcaaaattgtcaagggagatgggactatccagtaaccactttcccctctcatgcctggcatacctccgattgccccagactttcatgcagcccctgcactgaggttggttccctgtggctaaattccacccctcccaaatcagagcctacctatctccttaaagagtcagtgcccatttgtccggggcttgctatgcgccaaacgctctacagaaactgctttgtgcacatcatcgcattcagtggccacaacaattctgtaaacataggcgtcatcatttccatttcatatggaggaaactgcagtttgtggtggttaagtaatttgctcacagcaaggtggtcaggcagagctgggattcaaactcaagcctgtctgacttactaattggcactttgaaatgctactctgtgccacaacaggggtaatgaatcagccggggaaacccatgaaggtgctaacctaccattgtacataattgatcaaaacacttgctctgaacagtgagctgttttagatacactttaccagggggaagagaataattacaagtgaccgcagtagatgcctctatctggtcgattctgactttctcaagctctgactagcctttaagacattctgtttctaagactgaggaccactgccacaagtctcagctagttcagggatcctacgtctgtgaagccctgggaagggggctgggagtgtgagctgccattttgcctttaactttgtcctgttagttgagaaacatgccacattattactgacttaagtatttatttttggttgggggatggggtgattttttaaaaaacaatgcccagtgtgtgtgacttctgcacatagtcatgtgagtcacttcctgtttagtggaagccctctttatccacccctacctatccaatgggatcatctcgccttttccacctcctctgtcccctccataaaatatgctcactggtggtcgggtgtggtggctcatgcctgtaatcccagcactttgggaggccaaggcaggcagctcacctgaggtcaggagatcgagaccagcctggccatcatggtggaacctcatttctactaaaaacacaaaagttagctgggcgtggtggcacatacctgtaatcccagctacttggaagcctgagacaggagaatcacttgaacccgggaggcagaggttgcagtgagccgagatcaggccactgcactccagcatgggtgacagaacgagactccatctcaaaaaaaaaagtatgtccactggtgttcctgttcccagtgagaaggcacctccctctagaccttccatactcagctgctctcaccaagatgcagttacgtttattcccaaacttgtttatgccagtttttcttgtacaagattggtaaacatagttcaattaaatattatataaaccaacgaactatgggtacaagactaaagagctgtcattttatgatcactgagttaaatgctttggaaaaatttcataaagcaaatgttaccgagtttttttaaaaaaaggaagccaacaaattatatgagagcaggccaagagagcttaaaacaagaaaggcagaactttatcatctaaagtagcctgtgctcagtttgcctttcaagggtctttatactctgctccattttaaagaaaccctaaactggaaattggcggggggcaacagtttatgagtattttgggataaaaactatgaagtgggactaatcacagggcagccagcaaggaaacatggacctcaatcccggagcccagtggaactgaattctaccagcaacctgactggggctaagaagggacagattctaccccagagcctggtccagccagcaacttgattttggccttgtcagactcaatgcggggaaaccagctgtgcccactggcttttgaccttcagaaataggaggaaacacatgtgcattgcattcagcagtgaagcccagggtaatctgttagagcagccatggaaaaccaacccagcaagcatgtcctcccctctgcttgtgcctatccagaccaccaatcccatatttttcccaggccctttcaccacactctgctcagtatggctttccaggccctcggcactggtgttgcctcagctttgcttttaaaacttgcctttccgctgggtgcggtggctcacacttgtaatcctagcactttgggaggccgaggagggcggatcacctgaggtcaggagttcaagaccagcctggccaatgtggtgaaaccttgtctctactaaaaatacaaaaatcagccaggtgtggtggtgggcacctataattccagctacgcagcaggctgaagcaggagaatcacttgaacccaggaggcagaggctacagtgagctgagatcacacccactgcactccagcctaggcaacaagagtgaaactccatctgaaaaataaatgaataaaataaaaaaaaacttgcctttcacacaaactgtctcccctaataagctaaggagagtcactctcacctaaaaacagactgtgcttccgtgcctctgagcatttgctcagtcctgttcccctcctcacagcctcctagatacatctgactcatctttccaggcccagctgagacccaggcttccctatgcaggtcgcctccttgtgtgactgctgtggcctgctgagaacttgctgctcatgtttccctctgggccttcgtcttctgttgggggtgttttcttctctctctggattgacggcataagaattagtatattgtacgtgatccatggctcctgtgagggactggatgttaccatgatccatacaaacacctgcagagctcttttgtatgtagtggttgatttctggggtccttgctttgagttatctctccttcaatatcaagataaggatttgatctcttctaaagtgtcttgtaaatgacttctttaaatgatttttgttccaaagaagggtgtctctctgaacatggagccagcccctcggatttgtggctgcttccattgctgatgtatcacgtacaatcctgtatgaacatccattgtgtgtactctgagagagtgtcctatagcaccagcacatggggacactatccagggagagatggcaggatgctggggtggggagtaggagccagggaatattttgaaagcatttgacttattttccactgtagctatctattcttcattccatgctaatgggataatttgatcaatgaatgaactgggaaaaggcaggagatgcataaaaagtgtaaaagcgcatagctacaaatgagtgggcagatttaccaccttctccccagaatcagatctgtctgccatccgcaccgggaatgagacaggcagatccgagctttggcttaattacacataatttgggtgacagctgaaatgcaaacctaaacattcaatcagttaaaaatacacaaaattaagcatttcacacagtgtccaaccccttcaatctttattaatactttaattatgttaattataccatggtttcaagccctgctactacaacaagcagggggtggaggtggggaagaggcagtcctcgagctaaataatgattgcattcgaattaaaagtaggaatggaatgcaaagtagcaaagaatcacaaatacataattcagcagtttacccaccctgttcacacttctttttttcctgcctggcagtgtttctgaagggtgggtccaagtctgactcatcctctgagtgtactgtacatagtaagtgctcagtaaacatctgttgaattaatttttcatcaaggatgctgaaattgtatccatagatataaaaagatgtgagcagatgtttgggatatatatattgaaatggcggtggccaatattatggctgacagttatttgtgggttagtgggaacagtggtggtgcagggggtaggggcgagaggaagaaagagaggaacagaaaatgaccaggattgcagagattcatcacccttctatgaagtcacttgatttctttggactcagtttctccgcatctctaacaaatgaggaggaggagattagaccttaatggttatcaaactttgttctcctggattcctcaaaggaacatcagggactccactgcgtatgtgtgttggagggacatctggaggataaggttctgctttaatttatttattggatgtctaagagttttattctaaaagttgcttaaaaatggtttggaaacttctgcatgtgatagcctttttaacctctaactcacccactcacagacagtctcctgtgctctggttggagggtttccattggtccaacacttcacctgtcttgtcctttgtcctgggtatgtgggtcccccttactcatctgcttttctagcccccatgtgattttacttttcaccttccatgtctttgctcatcttgggctgaaatgtccttcctctctgtctgcacctatcaacatcctacagttcactaagcctggtacccagttgcctcctctggaaagacttcctggactgcacttgtcattggtgctctctcctctttccagattcctttgattcacagtgcctgactcacattcctcctttttttcatatgtgctagtcttgtcttattgactagataatcaatttctcaaatgagaaacattcagccttctcttgagtctttcttccactctgccttagactggacacataggtgactactcaagaagtcttactacacatccaatagcatttgacagggagttagccacataaaatccaatgagcctctagccagagagaattcagttgctgaaactacaacaatgaatgactgtactttagattttttactttatagtttgctgagctgaaaccaaaatgtcacttgggtgacttgcacaagataggtttttaggttttgctaggctgacatgtacagaatcatcagttgttgggagtgtctttttaatatcaacagagaaaaccttgaagattcataaatctgaaatagaaatgcagtgtttgcttcaaagagcaattccttagtttgttgttggtgagaactggctctgtgactgtaccttttgcccaagtatccttagctaagctaaatgtcttcagagtctcacaaatagttctcatattctgtggttatcactactgagattctccctggtgcacagaattgacattggagctctccatgtagtttttggtggccggctcaagttgctgtctcatcactccttaactctacatcctacaagtcaccaatgtgggggcaaaggttcaaaaaggaaccaattcactagcttcttggttcagcaacaagactctcagcatcacagaatcttatagattatcaaaaggaaacatagcccaagtccattaacctacaaatgttgactattatttaaaaccaaactttattacaatggagaatacagaattaacataggatacagattttgcactacagatttttctttttgtatggtgtgaaaattaaaacacacacacacacacacacacacacacacataaaaaaaaaaaactatagagaaatataaaaaatgaccaagtgctaactatggttcccaggtactatgagaatttggaaagaagaaaaatcattatggaaaagtagaaacagctaagttgttgggtccatttttcacactcaaaagattttttttctaattattgcttctactcctgggcctcccttttttttggaaggaagtgtctgccaaggtacatctgctgaacaataattcattcacaccccaataaaagtatgaatattaccaatcagccctcttgcaaacaagaaagagataaccggatgtccacactgaactaatgataatttcagccaaaaggcaaagaagcttcatgtttttatcagcctttgtatcttattgcaagtggatgcattatttgttgtcatttgttggtttcagatattgaaattagctttcagaaaatctgtgtactacattgtggggaccactaagaatcttccacatggattgggaatcctgtgccaaggagtttgctcataatcatggaagaagatcaagatcagtgtaggtggaagtgacttggatcttgcaataactagggcttggtcaagcaatgtgggggtggggggatgtgccaaggaatcaggcaatgtccataaattcagtcccttttgtgcaccattgctgactgttccaaggccacacatctgacttcccattcctcctaattttgtgagctcgtactccatgagtgggagaagatggatcaccattttgtgaactgtgctgttttgcatctcaccccaaaaacgcatcccaaattgagcatatgtgatcttcagtaacattcaggaatttcccatcacttgaagtctttagttacagccacaccttttaaaaacaaaatagatgattttgaggatgtcattggctaatttgcagacctgctttgcattggcatctagaccagtgttcgttactggaggcacatctctctgtcgggtgattcagactgtatatgagattggggggtgtaccttgaccacatcaagttgtgaatggaagatgctgccttggtaattttacccaagaccctggttgtatccatttaataaaattagaacatgtatcatttgagaagggaaagtaattatctctgttagttgtaatctcctcaaattcaaatgcatgacatagagatttctcttcaatggcacagttatagacttggtggttaattaaacatcttttctaatcaaattagctttcatttcctaagtggaggtttttaacctggaagtggctttgaaacattgtttctttcagccatcacctatgaaaggaaagataatgtcccttcaaaggactcctctaacagtgaataattattctttgtttgactgcaaatgcacattcttgaaataatatattcgtaaagtttcataaattatttcaagacatattaaagagcattggaaatagttctactccctccaggaggttgccaagaaaaagttttgtcctttaaaatttgaaacaaattattattcactggggggacatcattggagcttcccctagctccagctgacaggaacaatttgagctaacctgttaatggtaatgcttttaaaatttagagatactcttaagtggagcaatttttaaaaattaaaactatagctagggggaattgcctttggaggtcatgcaatgttagggacactgcacatctacctggatcagggcctggattccagctgcctgggttgcatgttacatcatggcccatggaggtgagggagacaggagtgtctctggttgaatttcaactaaatgctcccaggcataattctcctgagacttgcagcttggctataaaatacagcataatatagcacaaaagctactgtaattggggttgggaaaacggagttccagtcccagaagtcacataacgttgtaaaaaatccactattttctcatctgcacaatgaaagaattggcttaaataatctcccatatcccttctaactccaacattttgtgcttttactgtaagatgtcacttgaaccaaatttttttttttttttttttttttttatgagacggagtctcctctgtcgcccaggccggactgcgtccgcagtggcgcaatctcggctcactgtaagctccgcttcccaggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccacctcggcctcccaaagtgctgggattacaggtgtgagccaccgcgcccggccgcaacatcatttcttaatagctcattttgtagcttacctggtaagtgataactacatttctgaagacttattgactagatagttatggcatggaacaagccttatatcctcatctgaactgaaatctctgaggaaaacaagaaaacaagaaagcaaaggagaccagcacttgcttgggcactcacaatgtggcaggagctgtacttggtgattttggggcttttgttttctgctattggagttgaatgaagtgctgggaacagcagaactctccataaattctgcctggattaaatgcaaccacctgccacataactaatggggcccaagtttagaaagaaaatcagtttctttgcagctgttcttacaacctgcctgttgttcttcagaaaccaaattccgaaatatcatctcacaggcagttaaaatgctaaatgaggagcactgggttgagaatggtgtagtaaggtgatggttgggggatgtcagcaggactcaaagacctgggcctcagctgtttctctcatcagtttgctattttacacattgacttgagcatggacgagagtgttcaggagcaaataccttttaggtagcagactgagcatgtgcaggtttgactcttcttgtgctcctaggacagagcaagtttcattttgagggatgggaggaggtgtaccttgctgtatctgagatggcaaatgcaaggcacgtgttcagctatccccatatctggcagacattgctaatctatgatggctctctttctgagctccaatagcctcagaatcctttcaacagagctttctggacagccattatcaaatggcaggtgttggcacaggagatgaagtctgtttgtcaagatttgggctaagtagtagattctttcttgaaaaaaaaaaaagtgtgcatccgtcacatttgtgggtaatccaaagcccttttttagtttaagtgcaggacaggacttgactttatagaaggacacagtggggatcatttttcttctacatctgaagttatccatgtcccaattctacttaaccacgttgttcttgaaaaaagagaaattgggaggaatttcttgtgaattgatctgtagttgcctgatttataaaatgggtgtaagtgagaatagattgataaaatgtggtggataccatggactatctacagtgactagaatcagcaaagcagaggtttatatcacagcacaatgaatctcagaaataggggactggatgaaagaagaaagaggatgacacaataacaatatgacttgcataaatttaaaatgtacaaacagcaaaaagatttccttaaaaagacataaagagggttgactataaaagattgctaattctggtccatttaaatgaagaaacttgctcatcaaaaatcagctttaagaacagaaaaggcaggggccaaatgtggtggctcatgccttttatcccaacattttgggaggccaacacaggaagattgcttaaggccaggagttagagaccagtctgggcaacaagcaagaccccatctgtacaaaaaataaaaataaaaatagctggacatggtggcatgtgcctgttgtcccagctacttgggaggctgaaacaggaggatcacctgagctcagtagtttcaggttacagtgaggtaggatcatgccactgtactccagcctgggcaacagagtgagaccttgtctctaagaaaaacaaaaaacaaaaaactgaaaaggcacattgtaaagtagattttttcattatatgcaaatgataatggatcagtattaagagtatgtaaagaactcctataaaccagtaagaaaactacagataactcaatagagaagtaggcacaagatggagacattttgcagagatggaaatatttatagccaattaatttgtgaagagatattcccaacattagtgactagggaattaaaaaggaaatgtaagatatttttcatagacaagactggcaaaatttttttcaaaatcaaatgttggagagtatgtatatctacaggaaccctgctatgttgctgatgagagtacaaattggcacaatactttgcaaaatttctcttttaaagttgaacattaatgtagctcatgacaccagcaattccactgtacaacaggaggcatgtaaatgttcgataggacgcatgtaaagaaagtctttagaatactctttttcgtacctaaaaaccaaaggtctaccaatgagtgaatgaatgaattgctgtatgtattttcaatggactattatacaccagttaaaacaagtgaagtggcatatgacaatattgtatatcttgtaataggtagaaagtgaaaaacaaatatatttggtaaaaattaagataatagacatatccataccagatgcatttaaacaattgcttgtgagggggcaaatgagaatggaaatgaggagaaaaggaaaaattttaaaatacaaatgtattattatatacatacattttatatatgtgaatgtgtatgtatcgatacaaatatgtatgtatgtatatggtataataatatttttccatcttcctcattgttaagttgcatggctcaactgcaatatagtgacatgattgaagagatttcatggcttcattcccccaaactgtattccatacacatagcagctataccttcagcttcaacattaacaatcctttgaagccaagacattgtatctctaggagcgacctcctgatttgctattaaactagaccataaccaattcttcttgtgtgacatgagttatttggtgacaatagaacctggctgggggggaatggttatgagagtgatgagttctgatgtgaggcaaatccagagttccttgtagatacagaatattagtgctagggggacacagcacaacttgggaacttctggggaccaggagggtactcacactgtgatggggaagaagaagagaatgttattttctattacgttcacactgctttacgatgagtcaaggggaaacgcgttgggaaagggatatgggtaaggttggagaatatggagaagtaattttactttttgaacagtttctccctcatgtgctgtgtgagattcatatcctcaataggagcctcatctgtttttacttcccatattaaatacaaacagtgcattaccctcttctcttacttttgtcacctgttcctgtaggatatgtggtgtctagagttcttagggagtcctttggctctcccaatattgctatttcctgtacaagaatttcaagcttctaccagaatccataagaagccccatccaggtgtaatggatagaaggaagatctgaaaacatgaatctgctgccatctttgtgaccttcccttctccctgcgtaccctgtagtttttcatcctgatgcaatccaatccagggacattcagtggcaatggcttctagagtggaaggcctggcgggagcatggaacgtgtgtatttggagtggagttggctattgtaatacttagtgaatggaatttcattaggtccttatctgtgtgcactgaggaaaagaggtccttttacacagtgcttgtaatggagtggaaaattgcatttccctcttgcccgaacagtgccattagtggggaggcagactgtctgctgagtgcaggaagccacctcgggcagtgcagggctgacagcccaaatgatggcagtgccgagagacccggaagatattaaaataaaaacagcttgtggtgttctttttgtcctgtagcagttcttccctgcaatgcagggagtgattggatttgaagcactgagaaaaacatgttaagtaagaaattgtttaaataaagttgtttgaggttgaaactctcccccaggcatggagggaaatgtagttagctgcgtgcaacttacagatatccaagaggcaccatggtttttttgagtcaggcaagtatgcagtacacttaaaaaatgaaatggacaatgagatctcttctttggtcatccaggtgggttccagccccacctgggaggtgtgtaggccctctgatggcctgttggtggatcaaatcaccatttttactttccttggttctcagaattgcaggtgagaatagctgtgagtctcactgcaaaaaacagcaagagaattactcagctctggggaaattgttgtttctaacctgatagggttcctttcttgtgggttggtgttagacacagtcccatggggagcagccagtgtgatagcagaggaggtgcacagcctgtccttgccgaggaaacagaatctatgcagctcctgggcccaaatacatccaaatacaaagtggtgcagactaggaatgttgggaggaactatgagtgcaagagcctttcatgattgcccaaaggcactgggagaatgcaattaaagattttgtcaccaccaggcctgccctaaaagaactcctgaaggaagcactaaacatggaaaggaacaaccggtaccagccacggcaaaatcatgccaaattgtaaagaccatcgaggctaggaagaaactgcatcaactaacgagcaaaataaccagctaacatcataatgacaggataaaattcacacataacaatattaactttaaatgtaaatggactaaatgctccaattaaaagacacagactggcaaattggataaaaattcgagacccatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagaggcaaagaaggccattacataatggtaaagggatcaattcaacaagaagagctaactatcctaaatatatatgcacctaatacaggagcacccagattcatatagcaagtcctgagtgacctacaaagagacttagactcccacacgttaataatgggagactttaacaccccactgtcaacattagacagatcaacgagacagaaagttaacaaggatacccaggaattgaactcagctctgcaccaagtggacctaatagacatctacagaactctccaccccaaatcaacagagtatacattttttttcagcaccacaccacacctattccaaaattgaccacatagttggaagtaaagcactcctcagcaaatgtaaaagatcagaaattatagcaaactgtctctcagaccacagtgcaatcaaactagaactcaggattcagaaactcactcaaaactgctcaactacatggaaactgaacaacctgctcctgaataactactgggtacttaacgaaatgaaggcagaaataaagatgttctttgaaaccaatgagaacaaagacacaacataccagaatctctgggaaacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaataccttcaaaaaattaatgaatccaggagctggttttttttgaaaggatcaacaaaattgatagaccactagcaagactaataaagaagaaaagagagaagaatcaaatagacgcaataaaaaatgataaaggggatatcaccaccgatcccacagaaatacaaactacgatcagagaatactacaaacacctctatgcaaataaactacaaaaatctagaagaaatgggtaaattccttgacacatacaccctcccaagactaaaccagaaagaagttgaatctctgaatagaccaataacaggctctgaaattgtggcaataatcaataacttaccaaccaaaaagagtccaggaccagatggattcatagccgaattctaccagaggtacaaggaggaactggtaccattccttctgaaactattccaatcaatagaaaaagagggaatcctccctaactcattttatgaggccagcatcatcctgataccaaagccgagcagagacacaaccaaaaaagagaactttagaccaatatccttgatgaacattgatgcaaaaatcctcaataaaatactggcaaaccgaatccagcagcacatcaagaagcttatccaccatgatcaagtgggcttcatccctgggatgcaaggctggttcaatatatgcaaatcaataaatgtaatccagcatataaaaagaaccaaagacaaaaaccacatgattatctcaatagatgcagaaaaggcgtttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggccattaggcaggagaaggaaataaagggtattcaattaggaaaagaggaagtcaaattgtccctgattgcagatgacatgattgtacatctagaaaaccccattgtctcagcccaaaatctacttaagctgataagcaacttcagcaaagtctcaggatacaaaaccaatgtacaaaaatcacaagcattcttatacaccaataacagacagagagctaaatcgtgagtgaactcccattcacaattgtttcaaagagaataaaatacctaggaatccagcttacaagggatgtgaaggacctcttcaaggagaactacaaaccactgctcaattaaataaaagaggatacaaacaaatggaagagcattccatgctcatgggtaggaagaatcaatatcatgaaaatggccatactgcccaaggtaatttatagattcaatgccatccccatcaagctaccaatgactttcttcacagaattggaaaaaactactttaaagctcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcagtggaacagaacagagccctcagaaataacgccacgtatctacaactatctgatctttgacaaacctgagaaaaacaaacaatggagaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcagtggcaacaaaagccacaattgacaaatgggatctaattaaactaaagagcttctgcacagcaaaagaaactaccatcagagtgaacaggcaacctacaaaatgggagaaaatttttgcaacctactcatctgacaaagggctaatatccagagtctacaatgaactccaacaaatttacaagaaaaaaacaaacaaccccatcaaaaagtgggtgaaggacatgaacagacacttctcaaaagaagacagttatgcagccaaaaaaacacatgaaaaaatgctcaccatcactggccatcagagaaatgcaaatcaaagccacagtgagatatcatctcacaccagttaggatggcaatcattaaaaagtcaggaaacaggtgctagagaggatgtggagaaataggaacacttttacactgttggtgggactgtaaactagttcaacccttgtggaagtcagtgtggcgattccttggatctagaactagaaataccatttgacccagccatcccattactgggtatatacccaaaggactatatatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactattgcaagaacaaaaaaccaaacaccgcatattctcactcataggtgggaattgaacaacgagaacacatggacacaggaaggggaacatcacactgtggggactgttgtggggtggggggagtggggagggatagctttaggagatatacctaatgctaaatgacgagttaatgggtgcagcacaccagcatggcacatgtatacatatgtagctaacctgcacattgtgcacatgtaccctaaaacttaaagtataataataataataataaaaaagagtctccttaaatactgaatagagaaaccattaggaaatttcatattcaagctacagaagaattacctggtccagccatttcttgtagagatgaggaatttctttctctgaaggtgcaagtatcaaagcagactcccttgaggctcctacctctctctaatggatgtgtctataatgttatagactgaatcatgtgttcccccaaaattcatatgctgaaatcttaaactgcaatgtgatggtaataggaagaggggtcctcaggaagtgattaagtcatgagggtggagccctcataaatgggattaatgcccttacctgtgggctcccagagagctttcctgctctcttttggccctgtgaggatgcaatgagaagtaggcagtgcagctccagagagggctcccaccagaaccaaccatgctgacacctgatttgtgactttagcctccagaactgtgagaaaattcctattgtttcagccacccagtctgtggtcctttgttatatcacctcatttgactgtgacagcatctcttcgtggtcttttctctgttttcttgtccactctttcctccagctactcttctttcacttcctctttgggagaattgtctttctacttggtctatcccttggcctcagccttctgttcttgcctgccggatatggaaggttgactgggatcagctacctgccaaccattctgttctctagtttccccaggtattccttatgtctacataagttagggttgggaagttgtggctgtgcctcagtagggcccctcagcatcacagtggttgctaagccctgtcctaggacattataattttctaaaaatttatatgactctcaaattctatatgaacacatatatcattatgttaaaattattaatatatttaaattagtaatgagggaaccagtgatgtggtaaagctggttctaagagcacttgaggaactgggtatgtataagcactgaaaaaaaaaaaagaatgggggccaggcatgatggctcagcctataatcccagcacttttggagaccaaggcaggcagattgcttgagcccaggagttcgagaccagcctggaggaaatggagaaatcccatctctacaaaaaatacaaaagttagccaggcatggtagcatgcacctgtggtcccacctactcaggaggctatagtaggaggatcacttgagcctgggaagttgaggctgcagtgagccaaggtcatgccactacactccagcctgggcaacagagccagaccctgtctcaaaaaagaaaaaaaaaatgttaggcaaggattgctaggttagattcaaagctggtcagtattctacagagcaataaaataataatgtctaggactctttttttttttttttttttttttaccggacaaaaatctacaatttaacatgtaacttcattgtatctaggttgtgatcaagtaatgagcagtgaagtcaaatataggtatgatctaggaagaattaactaacccttgggaagacctgttcacaaagataaaatatgccattgaagggatattgtgtccttccttgtccccctacccctttacatccaagttttggatgctttttcttaacaatataaacccagcatttgagtctatatttctttgtaaatgtaccagatatggtatatctggttctgttatgactccatcttgaagtaaagtcccagctagtatgtcaggtatccactaattaattaaacgtttaacacatttattgagttgtctctgtgtgctatggtttggaaatatttgacgccgccaaatctcatgctgaaatttgatccccaggccgggcacagtggatggctcacacctgtaataccagcactttgggaggctgagctgggtagaccacctgaggtcaggagttcgagaccagcctggccaacatggtgaaaccccaactcaactaaaaatataaaaactagctgggcgtggtggtgggcgcctgtaatcccagctactcaggaggcagaggcaggagaattgcttgaacccaggagacggaggtttcagtgagctgacgatgacacgatgccaccgcactccagcctcagtgacagagtgagactccgtctcaaaaaaaaaaagaaaagatatttgatccccagtgttggaggtggggcctaatgggaccactttttgggtgatggggatggatgcttcataaatggattggtaatgaatgaggtattgctctattataagttcctgtaacagctggttgttaaaaagagcctggaacttcctcacttctctctcttttcttctctctccatgtgatctgtacatacattggctcctgtattagtccatgttcacactgctgtaaagaaatatctgagactgggtaatttattttatttatttatttatttatttattattatatatatatttttattatattttaagttctagcatacatgtgcacaacatgcaggtttgctacatatgtatacatgtgccatgttggtgtgctgcacccattaactggtcatttacattaggtatatctcctaatgctatccctcccccctccccccaccccacaacagcccccggtgtgtgatgttccccttcctgtgtccaaatgttcctattgttcaattcccgcctacgaatgagaacatgtggtgtttggttttttgtccttgcgatactttgctgagaatgatggtttccagcttcatccatgtccctacaaaggacatgaactcatcattttttatggctgcatagtattccatggtgtatatgtgccacattttcttaatccagagactggataatttataaaggaaagagatttaattgactcacagttccagaaggctggggagacctcaggaaacttacagtcatagtggaagggaaagcaaacacattcttcacaaggcagcaggagagagaagtgtgagtgaaggaggaacttgcctaacacctataaaaccatcagatcaggccgggcgtggtggcttatacctgtaatcccagcactttgggaggctgaagcgggtggatcacctgaggtcgggagttcaagaccagcctggccaacacagtgaaactccgtctctactaataatacaaaaattagccgggcatggtggcacgtgcctgcaatcccagctacttgggaggctgaggcaggagaattgcttgaactcaggaggcagaggttgcagtgacccgagatcacgccattgcactccagccttggcgacaagagcaaaactccatctgcaaaaaagaaaagaaaacaaaacaaaacaaaaatcagatcttgtgataaatcactatcacaagaacagcatggtgaaaaccgcccccataatccagtcacttccctccctcaacatgtggggattacagtttaagatgagatttgggtggtgacacagagccaaaccatatcaggtccccttcaccttcctccatgagtggaatcagcctgaagccctcaccagattcagatgttgtgacatgcatcttgtacagcatgcagagctgtgagacaaataaatctcttttctttataaattacccagcctcaggtactcccttatagcaacacaaattcactaagacattgtgtcagattttaacgtatactgatgaataaaacaagcaatgttgtgaggttcatgataagagaaatacatggcatatactttagaaaaaaatattatggaaagcctgtcaaagtgcctctacctgttatctgaatcacatgatggagtgaattccccatgcctgtttgcctgaattagttcagataagcaggagttggttatgttctatcaaattctgtgaggtatgaatggaaaaaaggaatttagaatggtttttcatgttggtgtgaccttgtttactgtgttcctccttggattcaaagtctacccaataagtaatatcagtaaatatatcggtaaagtatattgaagcactagctgtggacttttttttgtttatttattttaagatttttgataatcatcctaaatctattcttatgcaagagtcttaaagtagaaagtttctctgttttttcttccttcctaaactccttcaatgtgattgacaactggctccatgaacgtggggcattgtacctaccaactgtaatttttccatcagtggaaatcttgcaagtctttgacagacagagtagaatgcagaggttgtggatagtagtgaatttcccaaggccctgatagttttagggtgatttttgtttctcaagattcttttagccaaattgtaaagccattcttgtaatcaactgaatttcccctttgatattatccccaaggaagagtaactacattagtgttaagaccagagaatcacagggcatatcctatagtctctcatagtatgtcctattactggctctctgagaaagggagacaggttggttttaatatcgcatcagtatgtacagtattttttattaaatactggccaagtataagtcacttttaggccataagagggatatagaggtataagaagagaaactcacagagtagttgaggagatgagatacccacagaccacatagatacttatataagaaaatgtgtgcagaattttgactcagcattccaggctacagtgctcacagagttcaaccagtggggactgtggagggcatggaaggttcttaatggaaattgttagtcttttttttttttttttagacagagtctcgctctgttgctaggctggaatgcagtggtgtgatctttgctcactgcaacgtccgcctcccgggttcaagtgattctcctgcctcagcctcccgagtagctgggactataggcacacgccaccacgcccagctaatttttatatttttagtagagacggggtttcaccatgttggccaggatggtctccatctcttgaccttgtgatctgcccacctcagcctcccaaagtgctaggtatgagctaccacgcccggcaggaaattgttggtcatttaatctattttaaccacccaaggggttccttggtgccctctgcataaacaaagaccatggcattgtaatagacggagtttaatagacaccaggccaggcatgccatgtgggagatgaagttcatactcaaatcatcttgtccagaattcataggattggcgtttttcagacagtttggggtaaaggggtaaaggtgatcaggtaacagacacttgccgctgattggttggggcaaagatgaaatcatagggggttgaatcggtcctcctatgcactgaatcaattcagggtggggccacaggagtggggttggcgagtccaggtggagccatgggtgtcagacatgcaaaaaacctggaaagatatctcaaaaggccaacctacaatagttgtgttatttgcaggagtaattggggacattgcacatcttataacctccagaataatggctgacaatcatttatgcctgcaccttagcaggactcaggttctcctctgcatagcctgataggctcccactagctttacaaaaagcacttgagttttgggcaaggcctattatttaaactatagcttaaatgttttccaaagttagcttggcctaataactcaggaataactaagggaaaggcaagatgtggggaaggttagcttagcttactgttataatttttctcactgatacagtttttgcaaacatggtttctctatgaaggataaatgcaatctggattatagtagaagcaggagatgttgaaattctaaggagaatggagctgggacaatggaatgcgaaggtttggacaataatataccaagtatgtctttgttgggcgagaacgtctgttgaggtttggtatttgagtctgagaattgaaatgacaatagaccaatcaacaggagaaaaggtacataaatttactacaggcatggggcatcacaagagacagagtgcccaataaccccgtgagattcgaagcttatatgcccttctccatgggagagagtagtgggggtctgcaggcacttttagaggaaaaagtaaatgatgtttaggagagaagaatgggcatcaagaacagatgatgtcctgggacgaagtctgtctgggctctgagtgtgctgtgtactctagtcttcatttctgcaagttaatcttccctgtttgatgagattatagagaggtgatgcaagacaattgcattccttctagaggaacttcccttagtcagatgagggaacttcagaaaaagccgccctctgtgcttggcaagaggtagaggggtgagagagggtgggcagaagaaggtcagactctggttctgagactgcttctttagttcaaaatactcagcatatcaacacccccacactttgaggtatctcttccgagcccgtgtctttgcgggtgggaggttggggaggatccagtctgggcttgggagttggtggcatccttttttatagctgctccaggagcacccaacctgggtgtgtttactgaagttgtacgcatgctcctttgagccattttcgacttcaccattttgccccttagttcactttcttaagcccattcacccaactcctgagatcttttcaggaagctgctgataaccagtttcaggtatttctatctattggtaggctgcctttccctggagccccctgggaccaattattattttagcgaggcagtgtaataactgcctgaccatcacctgatggttgcctgacattcctggtggggtaggggtgggtctctcctgccctgctgatgtctgactgcctacctactgtaacaccctaactaaaagttgagttaactctgaaatcaagcaacaccaagcagaaagcagagagggaaacttgtccctttcaaaacagattaaatgtttcttattaattcagttgcttccacacatattcaagtttgtatccagaattaagcgagtcagtagttttaaatcaaattacaaatacagcatccttcatatctgaaataattgtgtatctgtatgtaaatgctgggagaatatacttttttggatattattctgactgtagtttcaaaaaaaagtagatagaaatctggaaaaatgagtaaacactattaattagatgagatatttatccttggcttaaattagaaaacttactaagagaaactatgaaaatatcaattaaaacaactagcatgattttatttttcactgttaagagggcaaaaaaaaaaaaaaccccaaaaatcccatgcatgaataaaataaatatatatttggggatgacaccatcttggcatttccaggcattcttttctaaacatattctttatctgagctgtcttgcaatacttttaatataattaaaagcacataatgagtgccagacttgtcaatttcaacaacaaagtgctgaaatttgcagtgaaactgagagatccatctcccatacattgtaatgaataggttcataaaaggaaaatagtttaattacattttagttcatggattgttaataggctggagtatctaaattgaataatgtgattctggtaataattatgtgtaaatgaacttgtttaaatgatattttacagcttctttataaaattacagctagaggcaatccagtgatagacagacaaaggccatgcaaaaattatcataaactattagcttgtttgcaaagggttttatgttaatcttttagtacttaaagcaatctgcaattaacatatcatggggagctgcctccgagcaaaggcatgcaaattgaagtgcttagataaaaagccattcatgttgtgggggaaagagaaagaaagaaaaaagaaaaagaaaaaaaaatcaaagaaagggtggcaaagtactcagagggtgctggtttttatatttgagattaaggaggtgtaatgattgtgttatctaactatggctgtaattaaagcttttctccagcagacatgacaatagatactgcattgatttcggtgttttaattgtgaaagtcattttatttcagggcagaagatatgaatagcctgaatcaaagggctagaagattgctttgttgatagtacttgttcaacagctgcctggctgcttaatacacaagtgtggagaatgcagagagacccaaggaggtgctgggtattgtgattctcctgctggtttcctttccttttatgaaaaaggcaaggatcttggtgctgactgtaaacaaacagccttttcatacctcatcgatgtttttcctccccaactttgcagaacaaaagaagtcataaagggccttgaactaactttactactgctccttttaagctacagaagtttatgcaaagtaataaaaaccatctttgctagtggagatatcacccctctaatgatgaaaaaaagtctctgagtgactgtggtagttattatcacaaatagccttgtgacagaaacagtttgtaggagagaggttggattatttacattaagggcatatccacaaaatctcacacacagttagtttgagattagtgctttcttatcagtttctatatacaaaccacaggagggaaattaagtgaggggaaaacatatacaatcccagagcaaagagaattctaaagagaattttagggagatcagggtagacttaaaataaaaatcacattcttggctatttcttctataacacttcagtgtaaatggaggtgaaacccagtgatttccagtaattcctattctattgatttatctcttctttgttcctagaaatatcaaatagcatgtttaaaggagtctgaataataataaacttggttttagggaacactgtttctttaagtgatatgatttaaaataaccagacaccaagatattacaaacataacaataataacataatcatttactgagtgttgtgctatttttatttatatttctgatgatataagggagtgaaaattttccctctgccctctgagagtttgataattgaatctatggaataaatggacattagaccaattaataggagaaaggacacataaatttattacatgcataggagcatcatataaaacaaaggtgaacacccagtgagatctagaagtttttataccctcttcataggggagaagagagggggaatgcagacaacttagggaaggtacaagcataccttggagatattgaaatctcaattctagactgatgcaggattttcttcttggtcaccgtgcaagctggagacctctggccagcgatgccctaccctggccttgctcgaccacactagctgctgcaggagatggcctctacctgctgtaggagacggcctaagtctggcttacacactggttcccgagttcttgtcttgcacccaagaaaaataaggatgtactgacaatggaagagtgagccagatggggagttttattggtgatgaaacagctttcagtggagaggggacacaggggtggtccccctacccaaaggtgggaaagtcccctgtgtgtctgggcctggggccttttatggactcagaatggggagtgtgtgctgattggtttgggggtatgcaaaaaagtttaaaccaaagacaccactcaaaggtgggcatgacagtgaagaaaaccaattacgaaagggtaggtatatgtaaaataggtgaaaggtggggacagtcagagaaaagtgcgccaaatgggaagacaagttctcagtctggtccaagaatttaacttgtagcttggctttcaggcttcaaactgtaatcagcttggaggtgggatttcaccggggacccccactgtctgcctaggcatttggctgcctcctttcactatcaagactgccccaataaaacaaaaattgcaataaagcaagtaacatgaatgtttggttttcccagtgtgtataaaagctatacaatactgtagtctgtgaggtgtatgataacattatgtctaaataaacaatatacataccttaattttaaaatactttattgttaaaaatgctaataactatctgcattttcagttagttaccatctttttgctggtgaagggtattgtttcagagttgctggctgctgactgatcagggaggttgttgctgaaggttgggatggctgtgacaatttcttaaaagaagacaacaatgaggtttgccacattgattgactcacgaaagatttctctgtagcatgtgatgctgtgtgatagcattttactcacattagaacttcttttaaaattagagtaaatcctctcaaaccctgcctatgctttatcatctaagtttagtaatattctaaatcctttgtggtcatttcaagaatgttcacagcatcttcaccaggagtagattccatctcaaaacaaacaaacaaacaaacaaaaaacactttctttgctcatctataaggagcaactcctcatctttaaaagctttatcatgaagttgcagcaattcagtcctatcttcaggcttctcttctaattctggttctcttgctatttctaccacatctgctgttatttcctctactgaagtcttgagcccctcaaaatcatccgtgagggttggaattcacttctttcaaactcctgttaatgttgatactttgacctcctcccatgaatcacaaatgttcttagtaacatctagaatggtgaatcctttccagaagattttcaatttctattgcccagatccatcagaggaatcactatctatggcagcgatagccttactaaatatatttcttaaataagaggacttgaaacttgaaattactccttgatacatgggctacagaatggctgttgtgtgaggaggcattaaaacagcattgatctccttgtatatcttcatcagagctcttgggtgaccaggtatattgtcaatgagcagtaatattttgaaagaaatcttttttttctgagcagtaggtctcaatagtgggcttaaattaatatttaagtaaatcatgctgtgaacggatgtgctgtcatccaggctttgttgtttcattgatagcacacaggcagagtagatttagcgtaattcttaagggccctagaatttttggaatgataaatgaacattggcttcaacttaaagtcgccagatacattagctcttatcaagagagtcagcctgtcctttgaagctttgaagccaggcattgacttctctctagctataaaagccccaaatggcatcttcttcccatgtaaggctgttttgtctacattggaaatctgttgtttagtgtagtcaccttcatcaaatcttagctggatctcctggataatttgctgcaatttttccatcagcacttgttgcttcaccttgcccttttatgaagacagcgtctttccttaaaccttatgaaccaacctctcttagcttcaaacttttcttctgtagcttctttacctctcagcctttacataaatgaggagagttaaggccttgctctggattaggctttggcttaaggaaatgtcatggttggtttgatcttctatccataccgctaaaactttctccatatcagcaataaggctgtttcactttcttatcattcatgtgctcactggagtagcacttttaatctccttcaagaacttttcctttgcattcactgtttggctaatcgtttggtataagaggcctagctttcagcctatcttggcttttgaaatgccttcctcactaagcttaatcatttctagcttttgatttaagtgtgcctctttctttcacctgaacacttagaagccattgtagagttataaattggcctaatttcaatatcgttgtgtctcagggaatagggaagcctggggagagagagagagatggggaaacagtcagttggtggagcagtcagaacacacacaacacttattaagcttgccatcttctatgagcatgattcatggtaccccaaaacaattaggataatgaaatcaaagatcactgatcacagatcaccataacagatataataataatgaaaaagtttgaaatgttacccaaattaccaaaatgtaacccagagacgtaagataagcacatgctgtgggaaaaatggtgttggtagacttactagatgcagggttgccacaaatccttcagtttgtagaaaaaatagtatctgtgaagtgcagtggaatgaggtatacctgcagaggatttctgggaaagatgaatgggccctcagaataggtgacagcctgcgacagggtctttctgggtgtggtgtcacctctattctcctctcttgtgatatagataattgtccctggctgataagattctacgggagggaattcatgactattgagttacaggagtagaagcttggaatttctgggggctggcagggacatgagttttgggaagatggggttagaaactgtatgacgaataagggttgtcttcttatacagattaaaagactctcaggtcataacagttttctgcagctagcagactttttctgatccagatagtttactaatgtagatttcctttacagatgtaagtttcttttacaaaaggacaagttttcagagctacttccgtgtgtgcagttcctcagagtaaccagctcgaaatatgccaaagaaatatagtttggggtggtacattctgtttggcgagcccaaaaaatgacctccaataaccatcccaaagaagtcgatgggatgatccattttctaaaacgagtgaacttagcctcaggccaaatatattgttcaaggtcacatagcaagggaggggcagaggcaggttagaacccagacagtctagctagatctctaggaaagcctgatgccatcctcacagggttaacaagaattctggacagaaatgtagttataattaagcattaattaagcaggctgcactttgacccagttccttgtaactgaaagtcaggtaacaccagatcctgactatttgcatccccattgttcctatagacaggatttctggagttacatcaggcttttaagatagataggatctctgacactacaatcataaggtttatgtttgagaattgcagatgcagattctgaattccagtggaacagctaatgctaaccattttgaagaccccaacagaggaactgaatcagcatgagaatggtttcttcatctccctgtcccatgacttactctgcactctttaaccaatcaatggtctccacactttggcccgctcccagacctttaaaaaccctagccccaaactccttggggagatggatttgaggtttccttctgtctcctcgtttagtggcctatgaccaaacttctttttctgctgcaacccagcatcttggtgtattgacttgccatgaacatcaggcagcaaacctattatggtcacaagcccttagacttcttctctgattaatgttttctaagtgcacaaaataaagtacaaagggttacaaagcaaatgtagtatattgaaatactgttatcaaaatatttaaaaataaaatttatgacttagtaatttatgtgcttacagccagcagcaactataatttcaaagctatgctaacatctactataatttcaaagtgttgataagcataaacagtgttttggatttctgcaataatgtgacatgaaaatacctgattttttatcaatgataaagtcacagatactccttaaactccagtcattttgttgcctacatttataataaaagaaaatggggctgaggccagaggattgcttgagtcttggagttggagattgcagtgagctatgactgcactactgcattcgagcctgggcaacagagggagaccctgtctcttaaaaaatagcaaaaacagaaagaaagaaaatgttaagttccccataaacattactgaaaataaaactatatttttatatatgtcagatattatacaaaaatacatgtgtagataattatacataaaaataatttttcccaccaaaattcacagacctctaaattctataggtgtacaaggcttaggttaagaacatttttggttttacagatgaggaactgaggcccagagaagggaatttagtgacccaaggttatcagtaatcagtgataagatgtagattagagctgattacactaagagaacataaggaaaacttaaaatactgtatgttgatcttttccctttctcctgtgactttggtggcttttgctgacatgctcttggaatgttgaacctttctttgtctttgcaatgttgtctttttcaaagtgggagcagcaagcaatttccccagccctgagatcagttgttggcaattcctgctttcagtggcagggctgggaggatcccagaaagcgcagccatagggactccagggaagcttcctgtgattgcaacctaaatttgaaaactttctatttaaagggacaagagtgcttttttttttttttttttttttttaagatggagtcttgctctgttgcccaggctggagtgcaatgatgtgatcttggctcactgcaacctctgcccctgggttcaagcaattctgctgcctcagcctcctaagtagctgggattacaagcacgtgccaccacgcctggctaatttttgtgtttttagtagagatggggttttgccatattggccaggctggtcttgaactcctgacctcaggtgatccaccctccttggcctcccaaactgctgggattataggcatgagccacggcacctggctaagagtgcatattcattatgtgtctcctctacgcgaggtctttgtatatcctcttccagttaatattcagagaggcctaataaatagtccccatccttgttctagaggggaagagagaaactcagagattgccatggcacatggtgcttgtggtgagccggggttgagttagactttagctatgtcctcacagcctaatgacgcaggcaatttggtcctctatttacttattaggaaactgaggataaaagacttttagcaagatggccaagttcatgacttattaagtgacagagccacgaatttaactgaagtctgttgcctgtaatactcatctttgttccccagactctgttgcccttacattgaaggaataaggacccccccgccctcccatcttctctacccaggggtcttctcctcaggtgtctattgcatatctgttatttacagggcatgtcccatgtgggcatgcaggaggggaagggcagcaggtagaaacacataaggatatacttgattttgagctgactttcctaacgtccctaattggataaataaagctaacacaaagggaacacacagataatgttcgatgacaaacacggacaacatcaacaatgtaataataataattgtgatgatgatgataatagctaacatttattgaatgcatactattttaaggattttccaaaagttgtttctttttttttttaatttgatcacatatcccataaagaagagtgtgtgatggcgacggcacccttacacacttggcaggaaggacatggctgagggtgccacagtcataaacacagaaacacagagatatatgttctccttattgattttgtaataatattggtggcaatcttagctatgaattgagtgaacaggtattatgggaaaggaagggggtgagatggatcaaccaggccaactcccagggggccatgttggcaaattttcctgcctcatgccttgccttggtgacgtacaaattttaggcattttaaagaaataccccaaactgtcagccctgtgcagagggagcatggttcactccctagatagtcaatttgggtgatagggggtggccagctgcttgcttgggtctcaggggagaggccctgatctttctggtccttctcccccaatcctaacctcagcccagacatcaggtcatttctacacactgcattaggcttctctaaccaataaggaacatttacccttaaacatggtcaccatgtcattatcacaactaaaaaaagaataataattccatagggcttttcaatacccagtccatattctaattttcccagttgtctcaaaaatatctttttgtatccagttcgtttgattcagtgtccaaacacagcccataccttttattgcgttgctgtatccctttgatcttttttagtctttaatcatctccctccccttctcctttttcatcttctctttgtctcttatgctctctgtttctctctctgtctctctctctctattatgcattgatatttttgaggaattgaatgagttatcctgggcaatgacccacattctgctttggctggttgcctccttgccatgccatctaacttgttcctctatcctctgtactttctataatctggtgtcagatcaataacttgtttgaattcaaattcatttttttttgtatatggtgctgtatacttcctattgcattacctcctgagatgcataattaatatctgatcatggtaactctgtgaggtgatgggtgtgttaattaatttgattgtgctaatcattacattttatgtatatatacttatatataatgtatatatacatacacaagcatatgtcgaattattacattgtacaccttaaacactatatacagttttattggttaattatatctcaatatagccgggaaatttttaaaaataaaaacaaaaacaatcccatcaaaaagtggactaaggacatgtatagacaattctcaaaaaagatatacaaatggccaacatatgaaaaaaatgctcaacatcactaattatcaaggaaatgcaaatcaaaatcgcatacacacacacacaccacacacacacacacaccacacacacacatacgcacaccatagaatactacttaactataaaaaggaatgaaataatggcatttgcagcaacctggatggaattggagaccattattctaagtgaagtaactcaggaatggaaaaccaaacatcatatgttctcattcaccaccttactcccgcaagaagggccataataataaatatatgtaatatatatatttgtgtatatatatgttatatataatatatacatgttatatattatatatatgttatatttatatatgttggcatggatgtggtgaaaagggaacacttttacattgttggtgataatgtaaactagtacaaccactatggaaaactgtggagattccttaaagaactaaaagtagatctaccatttgatccagcaatcccactcctgggtatctacccagaggaaaataactcattatatgaaaatgatacttgaacatgcatgtttatggcagcataacttgcaattgcataatatggaaccagcccaaatgcccattaatcaatgagtggataaagaaaatgtgagatagatagatagatagatagatagatagatagatagatacacatatatatgtatatatatacacatacatatatatgtgtgtatatatatatatacatatatatatacgcacacacacacatacacacatacatacacacacaccccatggaatactacttagccataaaaaggaatgaaataatggcatttgcagcaacctggatggaactggagaccattattctaaatgaagtaactcaggaatggaaaaccaaacatcatatgttatcactcataaatgggagctaagttatgagaatgcaaaggtataagaatgatataatggactttggggtcttgggggaaaggtgggtgggtggtgagggataaaagactacaaattaggtacagtgtacactttgcaggtgatgggtgcaccaaaatctcagaaatcactactaaagaccttattcatgtaaccaaacaccacctgttcccccaaatcctattgaaataaaaaattaaaaataaaactgtatcttatcagtaggttcagatggttcttccactgaaagaatcagctggagtcttccattgtaaggttcccaaccaaccttttacctaatgtttgagcatcttttgatgatggtgacctaagtccattatttcattacaggtgggagaataattttctaattttatcatccctttgtatttattacctggaattctgccatgaaggattttcttccatatagtaattgcttgaaatcttttttttctcacagcagataacttggtttgaaacatagtttctgtgggcattgactgtatgaaatgggaatatgaagtgtttccagatgcagcggaagtgggaggctgagggtcccctgcaggcacaggattcccttcatcctctgtacctgtagcagaggagcccttgggctccagcagtacaattggggaatgccctggtgaataacactgcctgacccccatcctcaccaggcttacaatgtggggtcctggagactgaagggtatgcctgtagtacagagagggtagccactcaccagcttcatgactttggggctgttggccacagtcaacattgcttccttatctgtaaagtgagaataagagtactaacctcacaggatggttgtgaagattcattatgctaatgcctataaaatacttggcatagttttggctgtataacagtgcttaataaatgctggcttgattattcttattgtaataatttttttttaagagacagagtattgttatgttgcccaggctgtagtgcagtggctattcacaggtgagatcccactgctgatcagcacaggagttttgacctgctccatttctgacctgggctggatcactcctccttagtcaacctggtggttccctgctcctgggaggtcaccatattgatgctgaacttagtgtggacacccaatcagcatagctcactacagcccagaactcctggactcaagtgatcttctcacctcagcctcctgagtcaccaggactactgactattgcattggtttgttaggattgccataacaaagtatcacaacgtgggtggcttaagaacaacagaaatttattctctcatagttctggaagccagaaatgggaaataaaggtgccagtgggcccaggctcctccaaagactctgggtagaatcctctcttgcctcttccccacttctggtggtagctggcaatccctggtgtgctatcacttatagatgcatcgtgccaatatctgcttttgtcaccacatgcccatcttttccttctgtctcttcacatggtgttctcctctctacatgttcacattgtcctcttagaaagataccagccatattgagttaagggccaaccctactccagcatgacctcatcttaactcattacatctgcaatgtctttatttccaaataagctgacattctgaggtactggggtttaggactcaacatatctttctgggggatacaactcaacccataacaattgtgtaaccatacaacaccgagttgtcctacatcttgacatatagaagggttccttgtactttattgttatgccacatttcttgcattttactgttttcctactggttttctctcagatatgagatgctatgtagtgcagagtgaggataagatgagcagctcttccacgtttagacccagagcagacacttgaataagtcgttctccacctccaaagacaggataggagcaggaaacatcagccagaacatctcgtataaacagcagaagcagtacagccttagagaacccatccacacctcagaacttcccagccaagctcatgctggcaggcacccagtgattctcccgtccgtatcacgacaagcctcggagtgaactgtttatttatcaattcttaattgagttgatgtttactcatgattgccagtggatgagtaatttactacagagttcgaggagtcagatagtgaagagatcattataaagagaaattataatagagttccctgtactcatgggtctggtaataaaagattgatataattagatggggcttggtaacaaatactattacattatgtctgaatcttatttaaatatattggccttttatcttaaacttattagtgggtggctgtagcttacgtcgacaccagctagctattttactcttgcaaaaggagggctgagctatacaaaggagtcaatcatttgatgtttagaagcaatggcacggtatttaaggcagttctccctgttgatttttagaggaagagcaaggtataaggggaacttaagcttccacttggtcacaaactttctggataacaaattcaggggctgtgtttctctgtactgtggctgtggctaccttggaacctttaacttggccaaagtcatccttgagaaagcagataaaggaaagggcaggaaataatctgacaacgtagtgagaaaatgagctgtggagtaagacaggcctgagatgaaaactttgccatagtgggttgagtggtagcccccccaaaatatatcgctccatcctatccctgggacctgtgaatgtgaccttcagtggaaaatgagttgttgaagatgtagctaaggatctcaagaaaagatcatcctggataatccaggggggctataaatcgaatgacaagtgtccttggaatagacacccagaggagagattaatggagaagagatatgaagatggaggtagaggctggacttatgtagagctattagggaatagatttctgttgttttaagccaccaagtttatggtagtttggtgcaagatccctgggaaacaaatataccagttttataataaattgcttatatgactttgggctagactcttaatctttacaaacctcagttttctcatctgtaaaagttgggttattacacttgtctctcagtatcgtgaggaccgtgaaagctcacccaactcagtgcctggtacatgacaggcattcagtacacatcagattccttctcccatcacctcctacccattttcctacatgatgtttcaacttgaaatctttttcatcttctacgcctcctaaaatgtctgcaaaactaacagccctcccctgaagaatgttccattcttcaggagctgttcttaggactgtcaaattagaggagaaagcatggtacagctggtgtttttgcggcagttgggtgagagccatgtagatattaaaagtttttcaaatgcagttcattgaatgcagccctatagagaagcagctgaagtccacattgtagctgcagtgtggctggccagctggggtctgtttccttcacacaaggaggtctcagggtacattcccagccatggagaagagacaacacatgggaggggagtgcgtataatactctgggctgcagaaagaagccaatgtaaatggctttttgcttgatgtctttagttcattgattttaggcctagaaagtcgtgattgattacatcccaccaaatgcaggctggggaagtcagtgtgggaatttagagcatggctgatttaataaatgttttcagaaccatgtattcttctgaggcatgagaacgatgagaaaaagaacactggtcaagagctagcagagctagggtctggcttcatttctgtccttgattagctgtgtgactttgagccagtcatttaacttctctgaggcttcaacttcacagtgaggttgttggagccgtacatctcagtactagcattcaatggttccatgaaaattcacagtgatccccatgaggtcagtgtccacccatgtagcacatgtattttgtttggcatgcttgctggggagaggagaatcacaggaaggcaacaagggaagaaaattttaaaaaatattggatgttctcttatatatatcatccagggcttcatccgtcatccaggggagaactagagatgttttaaagacttgagacctccactgcctggtcctattgaggatcctgtgttaatgacagttttgccatctctaaatggcattgaaaatccagtgcctgggaataagtaggcaggggagtgcctggggacatggccctgttataaggtagtggtgtttgtttttgggacattagccctcttcccattgtctgttatgttgaggtcagcttccatgtacatttccctatgtctccgagcacattctgatcaattcattgatggtgagagggaaggaaagggaaggaaatagacatttttaaatgcctatgatgagctccctactgggaaggatctgtattcacagccatcttatggggcaatcactttacccacattttatacattataaacctgaggcttggaggtgttaggtaagttggataaagtcactaaattattaagaagcagagccaggaattgaacacatgtctgtgtgagggcctgtgttttatttgccttggcatcctgcccttatactatgacagctctgggcatgcattgtatacaatacaccagactgatggaaagtagcagtggaggaggggaggatggggataaagacaactatgtatcattcttattcttgaacatattatctaattagacaaataaaactaacataaagggaatacctatgacaagttaacaattttatcaacaatataaaaattagagatacgatactagcagctaacatgtattacacggtatatgccacatactaaagactctacaattgttttctcaattgtcaccatgatcccatgtccatatttcattgacgaggaagctgagacataagagagttggaaactctaccaaagttcacagcctttgggcttccagcagtgagccaggattccaatccagcccaactggttccacgcggtactactgctggtgttatttgtcatcaaataagggaacccaaggcccactgtaggctcattaggaggggtgagtttggtctgaaatggtcctggcggactgaagggaggaaatgaaactcaaaaagcctgtatggaaatagccttgtggtcatatcagagatcaggtttctaacgcaggttcttaccacctcatggtaggaccttgcagtaattgcagggcttttcccacacctcctctcatgtctcatggctaacaacctgttttcttctgcattctaatctcctgagaattctctctaaaatggaggggtcattagaaggcagatatttttggagcatgtcttccctggggcaagcaagtgcttggaaccaggggtgcagggaaagccgtacgaatccacacctgactgtgggacagtaatagggtctgagagtgttaggtcctgcaacctttcttgaagcacagataggagtgagtacagcagaattacggccctggattagtccaactggcattgctcatgtaaaagcaagagctttgtcaactgcaatcccactttaaagggtgtgtgggattgaaacaagatggcttgaaggaagagaccagtgcctgtgctctgtctttgcattgcacacaagtgtcccttgtcctgaaagaccaggtggactggataactgcataacaaagatgggtgctgctaagggatgaggggatacaaaaggggagaggctacaaatggcagagccaggtcaggtcttggagagtaactagtcacagattgcagtcagatcctgggctaacatattttaagtgaaaacaatggatttaaatgccattaacagagcatgtattctccaggttcttttataccagccagcttcactcattccagtgacgatcttgtcttacctcctctgtccctcactccttcactcttgccccagctatcccagaatagcttaactacccagagttgcatatcaagaaattgtgagttgaagagaataaagtgacttaaatagatgactgtttatggggttaaaatacaaaactacattttctgatttctagtttgatatttctccacaatgctgtactgaaagctggatttttctgtctttaaggcatggagaaaagtgagggagtcttggggtttctcagaatttgaggcaacatccttaacattgggcgaggtagtctggctattaaccatgaaaccctatggagtgagcttagttgaaggggactgagcaagccatttcagagcccagggcctctgtgacaaccaaacacatttgctatttggaaaataattatagatccttttgagagattcagctgcggataaaactggaatactctggctagaaaagtacttgctatgaaatccattcacctagtgtgatagattgttaaaaatggccacttttattctatccctgtatgcatgaatcccccctgcctcccgcaacccaacccagcaaggtgtctgtaatattcctcctatcaagagtagagtttctctacccacctcttgaatgggggcttgaccttgtgacttgttctggtcagtagggcgttagcaaacatgatgtatcagaggcttagaaagcatttgcatgtggggtcctaccctcttcttgacaccctaagactgccatgtaaagagattggagtgccttccggaggttgagaatatttggagcagacaaaagtcatcccagcagagactccctggaccaacagtgaaggtacctgcatttttgctaaaaagtccaagtggaagggtattgttatatgcagtcctatcatgttttctcaaataatggggaaaggacacaggtgtccatatatgctcgtgaatccagccgtcttcattggaaaacgtgtggcctgcagagattcagtggaatgatcttaccccaatagtccaggacagtggctctcaattgggagctattttgactcccaagagtcatttaataatgtctggatacatttttaatttttgtacccccagggcaggagtatgctactggcatgtagtagatataggctagggatgctgccgaacatcctaccatgcacaggacagtccccacaaccaagaatgatcaagtctgaaatattgatagtgttgaggttgagataccctgatctgggcaattgttgacttcatgtcaggttttacagagttccttaacatatctaggcaatacttcaccagactccaaccctagcctcatcttcttcaagagcaagttctctctttgggagtctctgaagagtccgtcaaaaacatttcttaacatcctaagacatgcctctttagggttggataaagatgattttctaattttaaaatgccttcctagccccagattttgtgcttatattgcagagaagtagattgaataccggagggaaggacatggatcaaggtggaaagtcagacgtaagcagagctacatttgcagaaagtatgagttcagtttagtttttgcttatggaccacaaagatggccctcacctctaaaccttgaagaattccagaatttttctgggagaggaacatctctatcacatctgccacagcggaaggctttgtgcaggataacatatcattggcttgagaacagagtgagcatgtgtggaagggcctgtaattattaatatgacattggccataatttatcatgtcataccacccacttacagcagcctcatcctatgaaatgctaaatgcctttcttatcaacacttgatgggaaaatgctgttctggcatcttcctctaagggaaacagaaatctaaccatgttccttacagcctagaactctgtacacaaagatcagacttgtttttctccctgaaaatttataggtatttacaaggactcatatcctgtttgctatttagaggggcaatggagtgagaaagaattatgtagcaagtttctttttcttgagatttgctcaagctgctctatgacttaaaaaaactcagatattactccccatttttatgggcagcttgctgttttctattcttgctttcctcaccgactttcttggcaaagctatgcttgagtactcctagcgggtggctagattctcagtgagatgcttctgtcataaaataccctagaaaaggaggttcaattcatgatccagggtgaagtccttgtgttttagtcctattaaattaaagaaccaacttttgctgagtgttccaagactggattctttcttccctgttgtcgtcagctctcagtaggtgcagaccttctgcagaactccgatggcacccatgaaggaagaggaatccactcttatggtatcagagctttatgaaccctttcttaatattagaatggaatcctacagccaagagaaaactgtgtctcacattcaaagaggcagacattggaaggaaaatattcaccttctgacaagttttaaagaaacagaaaatattgcttctttttaaatatttgcctgggtttgatcacttaatattttttaataggtcacaatactgcatttccaggtagatcgactaaaatgcttggagaatggttctgtttaatttatttgcctagttaacttacagcaaaccacaaattatttatttatgtatttatttattttttgagacagtttcactcttgttgcccaggctggagtgcaatggcatgatcttagctcactgcaacttcagcctcccaggttcaagtgattctcttgtctcagcctcctgggtagctgggattacaggcatgtgccaccacgcctggctaattttgtttgtatttttagtagagatgaggtttcgccatgttggccaccttggtcttgaactcctgacatcaggtgatccacctgcctcggcctcccaaagtgctgggattacaggtgtgagccacctcactgggccacaaatttttcatttaacacagttgaatatgatttcatgactaaggttctcattgctgagttatcattcttcagctggagaaggggagagggaaggtgcactgattcccaaagatcccctggcatattgtgaagcaagattgaaagatgtatcctggaaaaaattcattagtttgactctctttttaactgcattcctataaattgagactctactcatttaaggtggttatgagaattgagtggatataatgggatacagagggtggcacattgcaagctttgatgataaattatggatgttatgatatgtatgtactttcatttgtaagtaatgatttttataaaatattatgatacatttctaggctgaccttgaaggagaatactaacataactttggaaaaccaaaaaatgaaaaaagggtatccgtttctcatcatgaataggtttcaaatctcgtatttggagcatttcaatttaagtttgaagaagcaggactgaggtcacatttttctccattggacattctttctgatgaataagtattaaaactgctttgaatttggtttcccccttagataagaaattattttttccatacagtcttttctttgcacctgaaggagcattgagggtgaaaaatagaggcctgtttcctgttcctaactggagccctccaaggttgtcaaactagagcaacaactttgtgggatttatgcctgggacctgtcaaagtagaattatcatagcaaaccctctctgctatcaatcagaggggtattggggatggcaagggcaggcatttttcaaatttctttactgtgcatatttagtcttgtgcctgggggaggaagagctcctttgaacagttcttgtagatttcttttccatcagatggcagctcacaaaactacttaatcttccccaaagggcttctctcattggcctgctgagaaaaacagccaaggaagagagagtgggggaagacagggacaatccaacagcaaatcctagaaaataacgcattgctttcagaggacgtatggtctaagtctggtcacactgatatcatgacttagaaaagcacactgtccattgaaggttatctcccgtcgcttctttttttttttttttttttttttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctcccgtcgcttctaagtatcatgtggacatttagcaacagcacaaagctgacagtgctatcatagcggtgtgagtattcttctgtcctccagagccatttcccacatttgtcaagacaaaggttgaaggggaccggacaagggaaatgggtcacccattcattcccatctgtcagaggtttgctttgtcatgataacattcaaggagcatgtttatctatcccgctactggaggttaaggcaagggtaacaagaagagaagaaaccctgtttgaaaagtttacaaatcctgccgtgagggctgtaaacagagtccagccggtggtggagcgtgttaaatactgccacattgatagggacctggttccccggcactagaaatccactcatgtaaacagaggaactgttgctgtgaatcgggtctgttttgacttaaagtctaagaaacacattgccttcaaagtgaattcttaggtgtcacttcccataagttatggcagaagattacaaagctactgatataacatattagtttgatggacagaattatacccccaacgcttcctgctctccccaatgacgcacactaacttagtgtactgtgacagctgccttgatttaccaccagtccgggaggccaaccgggagaaggaacgttcacatggacgcagggcctgagactggcctggagcctagtttataaagctgccctgtaattcaccacaaatgtgtcaccattaaaagaggaaaaaaggattgcagataataaatactctttaatttattagctaacaacaaagagatcagagccagttgtgatgtgattgtttgacataatattgtcaaggaaaaaaaagctaagttgaccagagaggtaaattacacattcaagcagatgcatcaactcttggcttgtcataagcccagctaaacaaaacaccacacagaggggaggactggccaagagcagagccatttatctctgaaagagacatattcaagagcaagtgaaataagacatagttcttttggacttggtcagaggccaggttttaactgttataaattaaatgttttgtgtataggatttggcaattctagttgcctttgtcatggtagggagatgttaggtttttctgcctgtcttaaactcatggtttggtcagctggggtgtgtgtcctactgctagatattggaggatcactaccttttggtaattagcagatattgggaaggtttctgtatgtggcttgtgataaaatcagtggctttagaaaaacttgtaatcgccttcgttttctgcaattcttcctctacagttgttgagcaatactcacacaggtcaccaggcaggaattcatattgatattagactcgtggaacctgaggattggaagaaacatttcatcccgcatcccacccaggacatgcagacagttgtgtatgagcggggcaacttccagggaggccaggcatctgccgtgtgttattgtaacatagctcagagtcaaccagtgctttctgggcttttatttttatataagcgactgcccagcaaaactctcccatcccttgcttgggaaattgagttttcagatctaagtgggtacttttgctttgttttgcatattatgggtctttgggtttagcctattgttagaacagatttctgggttttattcaacagtctggaggcaaggatagagtcctgtgggtaggtttaaggacattgattcatggatcaacatttttttgatgtagttaattgatctgctatgaattgcatctcatttattttatttgttgcaaagcaatatcatgggggatttttgttagatgtcttattgaaatcaatttataatgtttatggtctcactgatctaccagctgaataactgtttctaaaagacagagctagaaggcagggagggagagagagagagagaaagggagtggagaagagagggggagagagagagagagagagagattgatttggcctagctcattctaggtaaaaagatgtactagctcttaaaagttgctactatcttttcaacgtgctcatatatcatatatttaacataattttttacaattttagtgtcattatttttagaatcttctgttcctcctttaaaaaatcaacaaaaatatttgcccaaatttgctttttatctgtattttttcaaatattagtaacattgtttccatgagcagatctataagaatttttttgttgttgctattgtaaaataagatactatttgtataggtctagacaccaggcatctcctatgtctcataagctctctagggcctcattcttccatttcttttttcttttttacttttcactcatcagtctagcccaaggatataatttcatgatggagaaaataatgacaaaacaagagcttagttttaatcattctgcctttcctctgtcatttgggatttctttttttaacaaccattttccaacagtagacttattttcttcctttgagcatggttttcataagtgacttcttaaaatctgaattcactagaatatgccccatacagttatactagtttggtttctttcactgcttccctatcctcaagcttccccaaccttccttccttgttgtcaatattcataattatatactcagaatttcacttttagtagcatccttccttcttgaatttcatgtcctattaggatcaatatctgtggaaattactatactatactatactataccataccataccataccataccataccataccataccatcctatcctatcctatcctatgctatgctatgctatgctatgctatgctatgctatgctatgctatgctatgctatactatactatactgaaatgctatagtctcttaaaaataaagcaaatccaatcaagagtattcatatatttgtgttccaaaatatgcaaagttatctccaattaggcacggtcactttctcctaggggtctcatatcttccataccaccaatctttttattttttaagtttgatcatgttggcatttgttctgctatataatgtatattatgttgctactttttgaatatgttcactaaatgcacttctgcctgattttcctggtttccaaaaaggattttccctcttcacctcttctcctctcctctctctctattggaaatacctttcttttcagcaaggtgttctcttccactgtcacattctgggcatgattacccaccaccgtgagtttagttcaagttcattttattttagaagttacgaccggttttataggaacaatgtgcctttatcatgtcaactccatgttgaaaaacctttagggcctcctcctcgcatttgggttacagccacaaacccttagcctggcttctgaggtccacttaaccttgaactcaatgtacttttttggcctaaccttccagactttccctattttcactcagcctttcaaatcaactgatctgctcatagccagcaacatgatttgttcttttattcgttcacctctttgggctttccccccagaccttttctagttttcttaattagaaagtgagtcaccaaaaaggtcattaacatcaagtctttcattgccttttgtttttttctctatgaagaataaaataattttatggtgcaaaatgaacttttgaaggctaagaaagaacataaagtttgggccaaccaaaattaaaagtgactcacaattaatactaccaaagaaggcaatcttccgctgtccttaagtcagcaaggatttatgagagtgcttgatgattgtgtgttgcatttcctctgttggaaatgatacctagaattttagaagcatagattctgaaggatgacttcataataaggattttaggagcccactgttacccatctcaaccttggatgcctgaaatacactgacattcctacacatggctacatatcattcttattattcagtccacagccattgccaggatagataaaaagcaactgtcatttcacatcagaccaagctaggaaagtatatctttcctcaaccaagaagatggagtatgaaccagaccacatggcccagtggatgggaattgatagtgcatacagtagctttaaagcagcatggagcaaaatagatttaaatcattccgaaagaaataaatcctaacaatggatacattgtgctgaatgaaatgaagctcacaaaagaattgattaggaagtataccaaatggaataaaatgtagcagaaaggcacatattagagagaataaaatatgtttcagtctgaaggggatttaatttactaagatacaactgaccagctataaagcagatgaataacatatgtagtcaagtcaaatggacattcaatggaaataggtttatatagatcaatggcatcatgtgaccagtttcattcttctaattctatggctcattgtgtaatatctttagctctctcaagaaaatctgaggcttttcctgaatcctgaaagagggaactcaccttaaaggagtgtatgattaattggaaataggttattgtttgttggcttgtcttggtccagagaaccataataattttctggaattagaaggattttacagtaaattgcaatagagtatcacagtgaagactatttaagcactttttcctccaatgttaagttagttctactggtcactgtgctgaaatacttagagccatcaatggtcttcatttctctttctaggaaacttggaaattttaggtcaatattgaaattatcttgctgggaattttctcccacatgcaaacatattcattaaacactctgttgtgcttcagtcggagtcctttggagaatgtaattctcaacatgaatgaagcttatttccagcgttattcacagtggcatatcaagggcaggggggaagacagtggtctgctccaggtacagacaatgaggggatgcattgtttgtagaaagttttaaaacaataataaaaccaactaaaattttgtgtatattctgttatcaccatgaactggcaattcaggcaattaaagtgataaaaatactcatctctggaaaaaagctgtcaatctaagttctaagtaattgccaggagttctgttgtattttaaaataatgactattattgttaatatttattacattttaacacacttaaaagtttatcttttaagacacatcgtattctatatggagttactctggggaactcctagctctccaggaagccttagcatacatgaacttagctgtaaattcacagtggtttggaatattagagatcacatcacagtcagtgtctctaaaaccttggtagcatatatttctgcatttgaacaatatatttgaactaggcagtcgtagaaaaatgattgagagataaagaaacaggtcttgagttagttctgtcattcaatgagactacttggagcatttacttgtttttaatatttaaaacaataaaataaaatacaaaccatgaagtgtactattttgtctttggtaagtgcaaatttaagtttatgcatgaagatctctaatatatttgaataatagctttacattaaaaatttaattttctttttaattgttaattatttcaaaacaaaagcaaattaaaaaaataataattactaattacgtgcttataactgaaaagaattttgttttatggaggaaggggtattaataattatctgctctgggtatcaaatatgctagctatggcactgggtattttctttttcttttttttttttttgagacaaagtctcactcttgttgcccaggctggagtgcaatggcatgatctcagctcactgcaacctctggctcccaggtttaagcaattctcctgcctcagcctcctgagtagctgggattacaggcacccaccaccacacctggctaatttttgtatttttagtagagacggagtttcaccatgttggccaggctggtctcgaactcctgacctcaggtgatccacctacctcagcctcccaaagtgctgggattacaggtgtgagccacggcacctggccagcactgggtatttttatttttattttggttacagatgataaaacaattcaaattgctgaaaaaatatgtaatttaatactttatcaatttccttttatcttgcaacaaaccacctcgaaatttaatggcttaaaataagagttatatataaggtcacagtcctgtgggttggctgggtgcttcttatctggactgacttggttggggctggatggtcacaaatggcctcacatgtctggggctcagttgagatggctggaatagctttccatgtgatctctcttcttccagaaagctagcctgggcatgttacctggtgggagaaaggttcccttaacaggagaaggaaaactccatgctcaagtaccttttaggcatttccttgtataacatttgttaatgactcattggacaaaacttgttacatggccaagtccacatacgaggggtggagaaccagactctacctcttgatggtaaagcagtaaggttacattgcccagggaagtatgtatagaggtaaaagaaatttttgcagccttttttgtgaataatctaccacctacccataagggttgtgttatctccaggtattcaagtaacattggcagtaatttccatcttcatacttcgtctcagttctacttttttatgtagttcatgtagcctttttaaattaaatgtattttttttacttggcatataatacttgtacatatttatgggatacctagtgatgtttcaatacatataatgtattgcatgatctgatcagtgtaattagcatatccctcatcgcaaacatttttcatttctttatgttgggaacattcaatatccttcttctagctactgggaatgatataatatattattgttaactgtaatcatcctacaatgtttttttaacatgagaaattattcctcttatctggctgtaatttttcatcctttaacaaatctccctaaccctctctttgctttacccttcccagcctcttgtatcatctcttccacttttcatttctatgagatcatctttttttagcttccacaatatgagtgagaacatgtggtgtttagttagttctgttcctgacttatttcgcttaacataatatcctccagttttatccatgttgccgtgaatgacaggatttaatttatttttatggctgagtgatattccattgtgtgtatatatatcacattttctttatctactattccgttgttggatacctaggctgagtccatatcttggctattgtgaatagtgctgcaataaatatgggagtgcagatgtctttttgatatgatgatttcctttcctttatatacattcttagtagaaggatttctggatcatatggcagttttatttgtagtttttaaggaacctcgatactgttctccatagtggctgtacaaatttacattcccaccaacagtgtaaagagttcctttttttctctatcctcaccaacatttgttattttttatctttttgataatggccattctaaatggggtgagatgctatctcattggtgttttgatttacgtttccttgatgattagtgatgttgggtatttgaaaatatatttcttggccattcgtatgtcttcttttgagcaatgtctgtttagatcatttgcctattttcattcttaattttttccttcactcattggttgttcaggagtatgttgtttaatttccatatattcatacagtttccagcattccttttgttattgacttctagttttattctattgtcatctgagaagatgcttgatataattttgacttatcaaaatttgttgagacttgttttgtggtgtaacatatggtctatcctggagaatgttgcatctgctgataataatgtgtattctgtagctgttggctgaaatgttacctacatgtctgttaagtccatttggtctctggtgcagtttaattccagcatttctttgttgattttctttctagatgatctgtccaatgctgagagtaaggtgttgaagtccccaactactattgtattggggtctatctctccctttagatctaataatatttgttacatatatatatatgtatatatcagtgttctggtgttgggtgcatatatatttacagttcttatattctcttgcttaattgatccctttgttatcatataatatccttctttatctctttttagaactttttacctgaagtctgttttgtctgatataagtgtagctacttatgcttgcttttggtttctctttgtgtgggatatctttttccatcccttcagttcaagtctacatatgtctttacatgtgaggtgagtttcttgtcaacagcatataattggatcttttttttttaaacccattcatcctgtctatgttttttaattggagaatttaatccatttacatacaaggttattactgataggtgaggacttactcttgtcattttattcgttgtttcctggttgtttggtatattttgttctttacttcctctcttattatttaattttggacttagatgttccctgtagtgataggtttctcttcttcttttgtgtattgccttgcttcttttctctttcttccttgtgtattgtccctaccagtgagttttatagccattttttgcatgttttcatgatgatgatgaagattttccagatgtaaggcttccttgagcatttcttgtaaggccaatctagtggtgatgaatccacttagttttagcttgtctgaaaaagattttatttcttcttaatttctaaaggatagctttgctaggtataatattcttggctgacatttttttttcttttagtactttgaatatgtcatcccattctctcttggcctataaggtttctgcggagaaacccattattaatgtaatgagagttcccttatatgtgacttgatgcttttctcttgctgtttttaggattcaatctttgactttgacttttgacaatttgagtataatgtgcctccaagagaacctgtttggggtgactctatttggagttccttgatcttcctggatctggatgtctatctttcttccaagacttggaaagttttcagctattactttattaactatgttttctgcacccttttccttctctgaaatatatgaactacacaaattcatatgccatccttgtgcaggggccatgctaatcttctctgtatcattataatttgagtataggtaccactgaagtgagcatttttaagaaataaattttgataagatggccaatatcagcaaatggattacttcttgccagcttagcaaccctactggaaagagagcttgttccaatagttcaagacaaaatttcaagactgacttttattggctggattgacttgcgtttcttttcttttcttttttttttttttttttgagacggagtctcgctctgttgcccaggctggaatgcagtggtgcgatctcagctaactgcaaactccacctcctgggttcacgccattctcctgcctcagcctcccaagtagctgggactacaggcgcctgccaccacgcccggataatttttttttttctgtattttttagtagagacggggtttcaccatattagccagaatggtctccatctcctgacctcgtgatctgcctgcctcggcctcccaaagtgctgggattacaggcgtgagctactgcgcccggctggcttgcgtttcaatctaagctaatcacctgggtcagacccacacctcgtaccaggaactgggctcatgtccatcagaatcatatgaaatgaaaggtggaaggcactggttctaaaaaaaaaatgacaccctagttgttacaaaatgaacagtgaattaatgctgggcatgcaaaaataagagcctttgactaccctcttgtgcttaggtcatagtatcaaggagataactagatttaggctttcctacttaggtttattgttatttaaactcacttctcataagccttgaaaagcaacacacatgccttcaataatgggtctgcaagttgaactttaaatatttgctttacatattttttgaaagtcacatgtgcaaacatttttatatacatacttacaaaggtagataacatttctgcaggatgaacccgtcatataaactcattgatgtgccacatgtgcacaataggtggattatgactaaaaaacaaatttagaatgacatttgagcaatcttgataagtttatggagttgttggagaaggaaaaatattagtggggaagaaaattgttggcaataaaattagaaaacgagcctcatgtaatcccagctacttgaatggctgaggtgggaggatctcttgaggttaggaattcaaggccaccctgggcaacaaaacaagaccccatctctaaaaaaaaataataataataaattaatcagatgtggtggtatacactggtagtcccagctacccaggaggtggaggtgggaggatcacttgagcctaggagttcaagctatgtgcatgccactgtacttcagcctggacaacaacgtgagactccatttcttaaagtaaaccaaaagccttcaaatgcatataacctaaaatcaggaatcaccggggttctcagtgattgaaatctttaccaccagtgttcactcatgctagcctcatactcccagcctgctccactcatgtacgcgcttctcatcaacatgctttattttctgaatgattctccgtgaaaagaacaaagtggggtgatggaaagtatagtcacttggcattcaggtttaggttctggctccggcaccgtgtgaagtttatgagtcttttcccatttctgggtctcagcttcatcttctgtcaagtgaaagattagggtaactgatctcaaataactctctggcatatatgtgttcggcacctacatcttctctgattggtcctgggttattcaacatctttcctctgcaacttatttagccctaggtttggggaatgggcactaacttctcctgtacagattctttcccaagcttccaaatccatggcctttagttttgaggttctgctggcccctgtttttttccccaaagcaaaccctcttgacaaattcatgctttccagcaagcttaccagggtaagtcatgctggccagggtgacttgtgacactctgtttccacagctggctctggcctgtgcctgactgctgctgtgtctgattgttaccagccatttgccctttcttaagcccttgctaaccattttctttacagaatatatatgttatgtgccctagcataatttttctcataatgaaatagaatcattttcatagaactttgcaatgttgttaacattagcattttggggaaagtcttctttatagttgtttataatctcattttcaaattgaaaaaaaattcaaatgctatttttagaaggatacattccaaacattaaatgattgatctttactttggaaggtacctcttgggtcaccttttcatctctagggagttgattccaaggcaaacttgtttctgatgaagtgtttcaatatgctttattataatctgggaccacaaaaggaacttctaacaaacttttttttttaaaaaaagatcatctgtttatctcattctctctctttcttatgcttttgcaaaaactttttatcagtttacagcaatatgaaattcaaagaaaaatcaaaatagaaaaaaactctccagtttgaaaaatggagttgatgtgctattttaatttggtgatgattctactgaggcattgtttccaggtttgcatgatggttactttatcttttttgccttttagactcaataagatatttctccatagcacattactcaagcttctacataactcatctcacatagttacgaagttttgtccccttggactgtaagcccaggcagggatgggagcttgttcattcttggatccctaccgtcttgcatagtgcttgctatgtagaaagcactcataggctcaagtggaagaatactgtgtaggagcaagaataatatgtaggggtaaaatgttgaacatgcataaatattgaaacaaagaaataaattgattttggtgataggtgaccctgagagggataaaagtgtaacccagaggccctcctatgttacagtggcaaaacctctgtcaactctgatgtcttctgctacaggttaaacaagaatggaaagctctattcaaccatctaaaactctgccttcataataatgatggatttgctgtcatcataactcattcgtaggtaatcttgcaagagctgaactttggaactactgccatttggaagggttccattcactctaagggaaacctgagaatctgagttcatttactttttattcccccttttagcagtaatttgttcatttacctttaatgttgaaaggaagcaggttgaggccagccatgatggctcacacctgtaatcccaacactttgggaggccgagaccggcagatcacttgaggccaggagttcaagaccagcctggccaacatagcaaaacactgtctctaccaaaaatgcaaaaaattagtcaggcatggtggtacatgcctgtagtctgtagtcccagctacttgggaggctgaggcatgagaatttcttgaacccaggaggcagaggttgcagtgagctgagattgtaccactacactccagcctgggtaacagagcaagactctgtctcaaaaaaaaaaaaaaaaaaaaaaaaaaaaaaaaaaaaaaaaaaaaaaaaaaacacggaagcagattgaaataatgtgttttccatttgcaagtggcatggtcattttagttgaaggcatgtccactgcgagtatttcggtcagcttggctgcttctcatgctgtttgcccaattcagcactacagattttgctctcttaaattccagctttatcccataggagaggtgcagatttctatttctcatctctcgtctgttttaattctttgggagaggagtcctgagtactaaacagaaaggtacgcatggagaaatgtaaaacatattttcaggcacctttgtgaaaggaaaatttaatgggacattatagtactatgggaaatggagagagataagaatcatgccccatgcttaaccttttggactcatctttgccaatttctatgtgcagttcagtaaattaaataagctttccttagcctgaaactgtctgtgatagtgcaacctttcactgaggtatcacagacagacattcagcgttcaagacaggggcctgacacctttcaaaagtgaaggaacctgtggcaattttaaacattccaaccatattaattccagtgacagttatcctctaagttatttgaaatggattctccctcttcaactttcgaaacttatatttgatccccatggcctctggggcctgcacaggggcactctctgtgactgagtgcgtgaacagcaggaggcagaagcaggaaattgttgatccggtccgtttatgtctttcctcctcctttagctgttctctgtaccttattcatgtttctaaggaaaagccttgcatttccaaaagaagggttgaataacggtttggagttctttctttgagggcaatgtttttattattgctcttccacccaggctgaaagttgagtgtcatctctcaagcataagcaactaggcacttcacaatcaatactgggctcagtggttgagccctggttaatagagctgcttcttttcaggtgctcacactcagcgcagccgaattctgccttctctgtcctgggaggacacagggacctgtgcccttctccaacagtgggatcattctcgggaagtgctcctcactttccacatggtcaggaagttttggatgtctataacaagcacaggcgaggcttggtatggagcccagtgtttatacttaagagagtgctgggggaatggtcacagaagacccatcaggcccttatgggctgagttccaaggtgactgtacattggttattgttggggaagagtcagatcttcagctttccatgtgtgttggtttgatgttattactagtcatccatgtgttagaaatgaccttattagttcatgtctaagaaactaatttacaaaccaaaagactaacatgttatttccatttgggtgagggatagtattcaggaaaccaccagactgttcacatttgcattctagggacctcccttcctggtattagactaactggcaaagtaaattaatcatctgcaagatttctaagtgagaatggatgattgcatagctgttaaggttacaagtcaaatagcctgtgtttggaatcctggccatcacccttaatccctacatgatctcagaccagttacttaccctctttaagccttgattaactgatctagaaaatgagatactaagagtacttacctcatagagttgttgggaggattaaccgggataataaaaaagtgtgtatgaaaatgcttggcatataataagtacacaataaatattcacactagtattagtagtataataataatcatctttttttgtaataaaggtaattggatatgttcctaggccatttcatcctataatgttagaatctggagacttacacctgcttctccatagaatactcctttgcaaggacaggattacctgttagctgctagaggaaggctgacaatttcttatttatcaactcttctttctctagatcctgtgttgcttttttgtgtttatgaatacatatttaactactgtttatagaatatttgctatatgccgtaatattgtgctcttcatcatattacctaatttagttcttgcaatacctgtttgaggaaagagtcattatctccatttttcacaataggaaactaagtacagagaagtaagaaaagcgaggaggtagaacagctggggcttcagcttaggtctgtctactaaattccatgtctatgacactaggctatcctgcatctttatttataactcagtatattagaccttgagttaattagattattactaattttatatttattacaaagtggcatttttgatgagttttgagaaatgccctagtatatttacatacattgaatggatgacaatttgaaacttaatttcaaaatttcacaagttagaatttaaaaactagacttgtaacaggagatgagtttgttttgattccggagaacattcaatctctgggtgatgatccaattaatataggctagagtttcccaggtagatcttatgggaaaatgatacaggagggacacattatcaagagtgctgataaattcaaattgtaactaacctcccttagatagacccaagatagtcatgcctccttctatagggactctttggggcatgatagaccagatgccatgataaagaatggcattcccacagttgagatgaatttccacaggtcaccatatgcagcttcctttctcagcaagaatatccttaactttatgcacataatttttttttgttttttttaaacagctattttgaggtataattcacatactatattgtttgcccattcaaattatataattcaacaatttttgacatattacactacaacttttaaaattgtggtaaaaatatatataaaaaatttaccatttaaacttgtaagcataaaattcagtggcattaatgatattcaaagtgttgtgcgaccatcacaactatttatttccaaacccttttttatcactccagtagaaactctataattattaagcaataactccctatttctccactttccagccctggtaacctctattctatttctgcctctatgaatttgcctgtctgcttcatgtaagtggaatcatgcaatatctgtccttttatgcctagcttatagacataaaccttgaaaacaagatttatctatgtggaagcctatttcagaaatacattccttttgatggctgaataatattccattgtaaacataatattctggaatgaagatgtggattccatctatagctgtcaatcttgtgagtaaaatcaccagttttgtgtgaaatgtctcatttgacacaaccaacttggaaaacatgttgaggatatttctagaatggtacccaatctattgacccttgtattattatttattcggtgtttttcttgaaatcagttcacttttaaatgtcttaaatatttatcttattttgtcctaattaatgttcatgaagtccataggttgacgtaatattacatattgctattaaaatgatttacatatatttgttctgtatacctcctaaaatgtatcttctacctcagccacatataggctgtcaataacttctctaattctcaaacttgaggggtgggctgtgtgtcagaacatactagagtgccagattccctatggaacagaaatgaagaggagaggaattgtaacaaatataacctggtgtgaaggccaaggttaaccctaacccaaaccctaaccctgggagtcaattagtaggttcaagtctgggctaaaactgcttctaatcagctgtgtgatcttgacacatagtcctctgtgccttagtttcctctctgtcttaagcaggttgaagtagatcatctcctcctgttgctcattcctggatgtcctgcttctctcccacattcaggaatgacagggctagtgtgtgcttctgcacttgccctccatggggctgtactggagggatttccatttctttggcttcatggtatttacacctctctcttttcacttctctcacccctcttatattagatcaaactcgatctgatgtaactcttaatgatttcctttttaaggaggacattaggaaagcctgcatcaaggacatcacttaccttcatttagaactgtgggcatctgcactgtgtccatttcttacagcgataaaatggcagtaaatcagaaaaaatgccatgcccttcagaaccttgagaatgagctcctgagcattctgcttacggggatgtaggcttgtcagtgagtaaatcagctctgtccttacgcccccattgcatcagggaaatctctgactttgtgggataggtttgacgtgtcagtcaatctctctctacccccatttgagactgagagtgtatctctcctgtgttttctctgagcgtgtttagtgagcttattggccccctaggtttcattgccagccacagcttagtccttgtcagagagattattatatgaaccctaggtgacttctgactgcagaagggccctggatttacatttttgcattccaaagtcaggaatataaatgactaatggaacactgggccaccgaatatttatatatctattttgaaatttacatttctccctttcttatgatggggtttgctgctcccggggtcgtagttcatgggccagtagcatccgtggtgacaaagcaatcatctggggagagtgcttcccagccccagtggcacactgtgatgtgctgcaggttattatgccagcaattcagcagtaatcgaaccccccatctccttggccctatccctgcttcccttttatgatgtccaataaattttacatgctccaatttgcctcatccaccacctaatactgtttgaattaagaatctcttccatagctttcaacaatgggaactttgctttctccaaaattatttataaaggccactcatgactgtgccagaacggaggctggactgtgcaggtagagacagtgcacatatgctggtccatatagaagatggggttgcccagttgttgaacttgctgactacatgatatattgagatggaagaggatgtctatagatacatactatatctatatgtatgtatgttttgaatgaaaaaattgtgttaaattaggaattttttaaaaggtagagcatccatttgaaagttccctggtccctgatacttttcacgatatatggtacatttaataatagcagtaacaacaataatagcaacactacttaagcgtttactactcgctgaattattctaagccctttgcatgcattttaaaattccaacagccccatgagattgagcctttttgtaaacctgcttataaaggtggaaataagttcagagaggttaagttcctcaagattacatagctagtaagcaacagggctaggactagatgttgtattgtctgatacctgtttttaacatcacctaataccaccatgtggtgtaggcaggaagcagagatcttgagatgaatgttagtacatttctcattcactcaagccactcaccttttctcattcactcaagccactcccctttttgttccccgtcagtatttacaaagcatctattctgtgcacaccctgttctgaacactgggtatcaatacagcagtgaagatgacccgcagtccctactcttgtggagttaatattttaatacttgtagtcagacaatagacacgtaaagaaataaaccatgcactttctaacattggtgtctcaaagaaaatgcatgagagcaacgcaatggaaagtgtccagttggggaggggagctattttcactaggatgccaacaaaggcttccctgaagactgggcatttgagctgagacctaaatgtgaagatggctgggagctggtgtatggagcatagggttcgctagaggaaaggcagctgtaaagacccaagtcaggaatcagtgtcttgtgttggaaagccaggaggaagaccagagtggctgaagcattattagctgtagagagagagtagattatgaagtcaggagattggcagacctcaaggcgtgcagagcagggcagggagtgtggatgccgtggtgttttcagttctttcaatcaatattttactgcctgcagcccattttcttttacagcctgtcttcttttccttctgctttgactcgagtcttacctcataatgggcattttaatcctctctgtgatgcaatccaatgcttcttgctgggcaccttgctttattccagctcagggcagcattaaaaaagaacagaggaagtctccagccgagaggggctcaggaaggggtgcaggttgcaatctaagagctttaattaaatcaatgccgtgcacatcctgtccacaaagctgggggcaattgcatgctctttactgacgccatgatatacacttaagagctgtgtgacttcacagaagcaattaaattggcctgtttaatcagtggtaaggccaccatcaataacaattattatttttattgatttgataagtgcacagtagaaataatcacagagaatagctgtctctttccccctgtcctttgcctaaatgctaaaccctaggctacccaggccaaatctatagtgacctcttgaacagttttactacagatccatatgtaatcaagaattcctaccttggctaggcggctcacgcctgtaatcccagtactttgggaggccgaggtgggtgaactgcattaactcaggagttcgaggccagcctgagccacatggcaaaactccatttctacaaaaagtacaaaaattagctgggtgtggtggcatgcacctgtaatcccagctacttgggaggctgaggtgggaggatcacttgagcctgggaggtagaggttgcagtaagtcaagatcatgccactgcactccagcctgggcagcagagttagaccctgtcttggaaaaaaaaaaaattcctaccttataaaatttccatgctaaaaaaaaataatccatgctttttcattgaaacagaaattttcaactttccagtcctttgattggtaacaaaggaatgctccctatggcaaataattaaatctgcattttctctttcagcctcatccatcttgtttattgttttcctatagctcaaactatgatctcattttggccagaaatataggttcagtgacagaaaacaggcttggacattgcatagctgtggatatatacacgattatgtggatgttacagaacctaaaggaagatctaaatggcattataagaagctgcttttaccccaagacttattatctttctccatctcacttatagtttagcatctttgcatttgtagttccaaaaatctgaattacttcccctcgccttcttgtgaattaattccatatacttgtgaccatgggagagaagcagactcaaagtataccaaaattggagtccagccttggggaatgaaagagtgaacctttgttcagggagaaagaaggggccctgatttatgtgtgcagtcactcagtaagaaaagctaaaatgtgtatgggctacatccctctccactatcccactgtgagagatccatgaaggaatagggagggattgttggtcttccatggtacttctcctggaggatagcatatgttattcccacctgacttcattaaaggtaaaggtctcaggaatcttgaatgacaatcacagagatgcccccattccaccattcaccttggatttttggccaggttggcttcctgggggaagagggttacaatttgtctactaatatatggacacattggtaaactgaatttaaatcctcctcaatggacttgatgccacatgggacttgtatggggcattgctctcacagttctcattcaagagctgctttgtttccagatagttctacagctcttcaatagaacctggaatccatggtctgtgaggagaaacagtgacccaggttgtgtcagatgtttttatacgtaccatgaatggcttctgacatcacaaaggtttggaaaatgcattaaattcggtttacctcttaggcattaacaagatacattagcatgagggctttgagattctagaataatttctcagcattttccaaacagactcagtcaaggaaccctttgtcagagtaggcctattccccagaatatacattggaaaagctggtctggaggcctgtattagtttgttctcacactgctataaagatactacctgagtctgggtaatttataaagaaaggaggtttaattgactcacagttccacatggctgaggaggcctgaggaaacttacaatcacggtggaaggcaaaggagaagcgacacacaacttacatggcagggagagagagcaaagggggaactgccaaaaacttttaaatccatcaactcttacgagaactcactcactatcatgagaacagcatggaggaaactgcccccatgatccagtcacctcccaccgggtccctccttcaacatgtggggattacaattcaagatgcgatttgggtggggacacagagccaaaccatatcaaggactaaccacttatttttttttcttgtaggcttgcatatgtacctatacatggggtgagcatcctctcacttagggcaaaatttttagtgaggaattctatgacagtgctacatatattgtatatatgatatccctgttcccaaatgtaaacatctccacatgtatcccttctagaccaaaacctttttatctggcttcatggaaagctgtagtgttttgggctagtatttaccattagatctaaaaacggtgcatccttggattccttttgttgaattttgtgtaaatatttagggtatttacaccttgacaaccaatgactttaaagtttaaaaactgatatttaactgacttttatacttactaatatcacattatagatgctaaagaatcattgtaaccattagacaccaacgatttctttcagagtttgttaaaatcacgttgccttttttactatttttaaatagtatgatatctaatctgttcattgcttgtgtgtaagtttcctaaactttgccatacctccatataacttgtactattatgtacccagtatgtgtgacagggttccctgatggcaatctccaaagaaatacaatttgggcataaagtaatggtgcctaaattctgcccagaaatgttctgaaatgggggatagggttgaggtgacatgtagttccctctccagaagcaggggagtggaggcaggctcctgtgtcctccagtatgtttcccatccagtatccctggatcaggtgaatgaaaagggcattaactaatggggatattacaggatgaggtcaaatgatccatgtagagttcataccagagtacctgccatataggaaatatccaagtaattctattgttgtcatggttttattgtcttcaaatatctttattttcttttatggatttttacatactacctttttttagacagagcaggatttacttttttttagacaaagcaggatatatatttctaaacatttgaagatatttgaaggtatttgtcatcatcacttagtatcccaggtatcccaaccattccatcttaatagtatctgagtcattcatagtatatcctagactgtttcaggatcaccagttccaaatattggagtaagttattaaacaagtcttttaagatcttatgaagatcttaaaatagaccaggaagagaagtatacttgcccatatttcctccatttagttaatcccatctaaacttgctgcacataaattggaagaattaaataaatgagttgtgaaaatggtgtttttaccatcaaattagatatggatcatctggctataatgggcctggggcacaatctatgcatattcatttgaaaaccaactgggatgtttaaaaaagtgagcaggtcaataagaatacaatgatttctgtagactggtaatgcatggccaggcattaaaagtggatattgtatgcatctgtgtgtgtgtcttggaaaagtcaagtagaacttgatttgggtaaaacccaaatgtttctgtgttctttctagtcagttagttattttgtttagttagaacatagtaccactgaggtaaaggttacgtattttattcttgtgagagctgctttgctatgtatcagggcaaaaaaagaatgatggaacatctctactttttataaaaattagatcaacaatcactgtaatggtagaaaaagagagtatatgtgttttgatattggagcggtttttacaaaaatcatatatgtcaattttacacaggatcactcactgcttttctgctctgaaggatgaagatcacaactttccctaccattcccctacctctcaatttttgttagttacattgttatcattatattgttaatgacaattgcattctcctctataacaatgctttccatagttgtttagtgttggctccatatttaagtgaactcagagctcagtggaagttctttggatgatagctctccactcctgaattcttactccagccctaactggctgggctttcttctatctttttcaaaaagggctcatgaggcctgaatttcttaagttccatgcttgttgtatttgaatgatattttagttgggtataatagttttaggctatatatgatttacatatatatagaaatatttcttcattgtttccttgtattgaatgtgattctggataagtatgaggtcagactgacttttcttccttgtaggagattcttttttcttccatctggttgtctagagatttttttcccctgaattttagtaacttaattaagatttatttgattgttcttcattctttgtatcatttttttaacttgctaaactcttttgaactatatttttttcttcattttggggacttttttaagtatatgtttgaatatattttctgtcacattaattgtacacatacaaatattactgtctttatttcctatgagtcttaaattatctaattattttattttatttttcatatgcattcactgtgattatgtcaaactgttgctctgtcagtaatttgatttttagtgtgacccctctgctctttgatctttccaaattgctttttacttctgaaccatattgctttggtctttgtttctttaggtcttctttttaaatccattaaattgtgtgtgtgttggttttttgtttcatcctatttgtagttggctgaggttcttgatgaaaaaattttgcagtagatttggtgagtttttgcacagtatttctttaaatacttttccttcacaacctcttcctcttctctttatattaacaccatatacatatatgttagatcttttcatattgttccacaggtccttgaggctgtattcattatcattgttttcctgttttccaggttggataatttatttttatgtatcttcaagttcactaaatctctcctccgttatcttcattctgttattgagacaatctagtgaatctatctatctatctatctatctatctatctatctatctatctatctctttctttctctctttctttctctctctttctttctttcttttgttaattcttttgttcattctgtctttctttcgttctgtatttctgtttttgctgttgttgttgagaatgggtctcctgttcacccaggctggagtgcagtgatgcaatcgcggctaactgtagccttgaactcttgggcttaaagatcctcctgccttggcctccctagtagctgggtctacaagcatgtgccactatgtccagctaatttttttttttcttttttgcagtgatggggtcttgctctgttgtccagactggtctcaagcccctgggctcaagtgatcctcccaccttggcctctcaaagtgtcaggattacaaacatgagccactgcacctggcctctagtgaattttttgtttcacatgctgcatttttcagatctaaaatttctaagttttttatagcttttgtatctttcctgagagcttctacttttctactaatttaaagcaagctcaactttatctcatggactatgcagctataataggtgctttgatgtgtttatttgctaattccaacatctgagccatatatgtggattattttttttacacaaatgtgactaatacttatttgtatatttagtaatttttggcttgtatcctgggcattttgaacattatgttgcttcaatattggatatattacaactctgtgaagaatattaatatttacttttttgttttatgaagaattagcctcatttctttcagactatgggttctgtcttgcctttcgtgggttccaatcttggtccagttttcaaagcctttgacatcctcctcttgatctgtctgtgcctgtacactcaagagttagtatgaaacctggatggtggtttacgatcctcattccgttctcagagcccttgctaatctgctttggatatgtcccgcacatccaaatgcacagctcagagatgagctgggaacttgtgtagtttcatatacagaattagagtatccccttctccagctctctcactctgggattccctccacaccttccagtccttaagggctgtttttcacagctcttcagcccagaaatttgaaatagaaatagaaagtggagtttgagatttccatggtactgctgtatcagacgactctgtgattggggcctgcatttggggaaaagccacattaaaaaagaacaataaacccagaaattcacctcttggtgggtagcttctccataagccactggcttttgttttacttttccccatcctcagtatccttgtattttgtgcagtgtttagttgtaatcagtggaagagataggaggtagtgggcttaccctctcatgcaagaggcaggctcacattcaattaaactgcattcagctgagcccctcttttattaaagtcttgttcttactaagttgttttatagcataaagctatttggatttttttttctgctgttcctttagttgttgggtcctttttgtgtcttttgcatgatgtgcttctgtcctccttttcctggttttgttgttagtctgaattttttgctgtgctgtttgttttctctctgatcatgtttgagtaactctgaaatatacagtgtgaatggcttcttaattatcttcccacctctcataatatgagcttcttttaccctcaaagttgcagtttgagaagtaagtatttcatgttttgtccatgttctgtagcttcagaaaatggggtagggaggagaatagttcaactgagaagggatgtgatctttattggaatagccagacttaattctctcatctgacattctgttaaaccttcattagggtttacttttgggctttggatgatttctctaattcactgggtcatcatggaattttcatgcccattagagggtgtacccagttgttagttttctgtgtttcatttgcttttcccagtggttacttaatccattactcagtcagaagaaggagaagagaagaatgcctagataaagtttgcttctttctagatttggatgcattaatgagaatttttcggattttgcagattccctgtataatttctggcactgtctgggatgagctgtactatacctccagttaaccctagagtcttctggctccttcattgaattccagtttctaaatctgtgctcatgtgtttacccaactcaaagtagatagcttttctcaaatcaggaaaatgtatccctgaaaagtgaagtgttcctcggcaggtttggtcattactgaatcttccgtaagaaattctttaaaaatataatgagataatgactgtgaaagtgctttataaactataaagtgctcaacgcatgtaaaactgtgatattatcatcactcatgtcccctatgctgctaatcgtcagtggatcagccagggaggcaggcgttcctcgcttctgctttgttatactgtcttatcccgaccttgacactctggcagcagtgaccctcaacaagataacctgacagtcagcggtgtctcacccacactattacctgcctttgttagtagcactcagacagcatataggtaattccccatgtttcttgttcattgtctctgtaataaaacattttcttttatagaaatcctgactctaatttcacaaaagctctgctatggaacctcctctggcctctcccttcctcctgaaatacagtagtgtgtgtttcatatttgaactcacaagctaattgaactttattgaaagattcttttactttgcccaacatctttaaatagtgatttggtgctatgattagatacactctcaaaaactattgttgctgggtagagagaagcttcaaggaagaatgaaataaacaagcatgatggagttggatgggttagaacaagtttgtttttcttatgtggatatgcttttcatatccacatttattttgtttccttgtctgaactgcaaggtccttggggataggaataatgactgactcagactgttctggaaaaatggagtatgatggaggacatgagcaatacctataatattataaatgagagaaataaaatgataaggaattgctgaccaaatacagtaacactaaattgcagtgattaagagcatgaacttagagtttgaccaattatagctgtatgaccttggacaagttacttaacctttctaggtcacatctgtgatttggagataataagaatatttgcctcctaaggctgttgataacgaatgtaaagtgtttatagcagtgcctggaacataatacaggcaaaaatgttatctgttatcatcatcatcatcattattcttttatgaattcttccttgaagcttcacaaggcaagtacaggacaaatgaaaagaaataaagtttacacagcatgggataagaatatgagatttactatgccaaaagtggtatagacgggctaaggattaaaaactaataacaaatgcttctttttttttttttttttttttttgagatggagtttcgctcttgttgcccaggctggagtgcaatggcacgatcttggctcactgcaaccgctgcctcccgggttcaagcgattctcctgcctcagcctcctgagtagctgggattacaggtgcccaccaccatacccagctaattttttgtatttttagtagagacagggtttcaccatgttggccagtctggtcttgaactcctgatctcagaataaatgcttcttataggcattgttttaaaatgttacatgtgttgtctaatgtaatactcatgacactatgaggtagtcccattttatagacaaggagactgaggcactgagaagtgaagtaaccagcctaaattcccataactcataaagggttgagctaagatttgaatccaatcaacctctgcatttaatgcctatttgtgagtgagtgtgtgtggcagaaaggatccagagtagatgactggtgaaattagatgtttaggcaatgtcttcacatttaagatcattgtcaaggagaaaattttgaaatgtattttgtcatcagaaataatccagggacacgtagagccaaggcctgagccagagaagaggtatttatactttgattcaaggaacatgaaattaaccaggaaaaactgaaaagcaatttaatccttagactttataggagtaaccttgttgggtttggtggatgtgatggaaagaatgaagggcaggtattgagcacagctaggtatgattctctttttgccatcttccattttagtgaccttgagcaagctggttcagcttggggtaggggattttgtatccacagtagcagagtgaagaattatatggaatcacttttttgcacccttcagattctaaaacacaaacgtttttgcattgtctaccctgatactgaaaattattgatacccttgatttaacatttatattctatcttattttgtattttgcacattgatcattcatttattcagcccctgtttgtttggggtatgctttgagctcactgtgtgacttttttccttaattaaaattagtctgggagagaatgtatttgcctcctggaattctcagaattctagcaaggtgccctaaacatcataagcacacatcagcactgttcatattgattatcatggtacagtagtgtatcaaatgccacctgaagttgagtgctgcaaatatgagaaaacctccgtaaaatcagccctcaataacttttctagggaatgtgccttaaaaaaaaaggtactggactgtgtgctgagaaaactgtaaatatgagtaaaatgatccctgccttcaggaagtttaccaacaagggcacaagcaaccattgtagaattgcttgtggccttattgatatacaggctaaggattaaaaaattataatcccagggatgaaaagctttagcagttatttagtccaactctccacacacattgagtccccgttacaacagcccaccaaatggttgtctggcatcttcttgaacacttcagtggctgtgaactcaaactgctcattctgctcgtggtagaatgacaggctctcaatttttgtgtagaaggaagtgtcttgctgaagagcaaaggtcttttctaggctgaggaaaagccaaggaggtcatcttggagataaaaatctggaaagtggaagtatatgggaacagacctcaaaggtcctttgttggagcaaagttacagaagtacaaaagccaaggcacgtggtaggaacattaagtagtctagcttggtcatttggcagtgacaggttgagaatagggaacagtgaaattgttaaagatagactgggactataatttggaggaccttgagtgccctctacttctggggtacataacggccctattgaaaaccctaattctatatccaataggtggctcattgagtaaatcactgttagcagtcagatctgatgtgttccccaaatccacatcctttatactcacctggacaactaccattcccccaacccccccatcatccatgaattttcttcagttcaaagagacatggttaaagcaggaattatgaaaagggccctctgccggccttatttccatgtagatctattttatatgcataataaccctaaggggaagctgtgtcaatctgccttacctgacagacccctaaatcctcccaatgctgcctccactattggacatgtgccaagtggcttgcaacctcaaagagagaaagcatcctgattttttgtgtgtaggaaggtggggggcagtgataaacaggtcttggcctgttattgtcttcctgcatgataatgaacccatcactagcacaggaatttaatgcaatgatttttccaagaaccatccagccccattgtagccctgcctgaaaatgtaaatacaccctttctggggacagatttgcattttttggtgaaagaaatgcatatatatggcaaagatgcctctgtaattatagaaagtttatttctgtccccagatgtcagcaatcaaattccacataaatatattttgtgtaaatctgtcggcagctggtctccattcaggtttctggagatattagcctgtctttgagtttatgacaaagttaaaaattattcattaaactgacctgcagtatattcagtaactggaaaattgccttgcagttctatttggtttgtagatgtgatcacaagtaaatttttaacttaattaattggccgtttctgttgacaagaaatttatgtggtaataatttgctcgaaatagatgccgactgtaggaaatgagatatccatcataggcttgtgttccaccagctgcacagtggctattatgaaagtatttcagcctgcgtcgaccccagtgtttgtgcagtcaagattatatatacccacgatccatagcctgccagagaggcgctggtggaggtctatgataacaaagactttgtgatttatggcttgctgtgaaagcagagcttgatgagattaaacaatttcatagcacaagtgtttctcaagacctgatttgtagttgcaagctgatggtaaatcacatttatatatctgcaagcgtgctcagcagaggactgcaattacagtttaagacagctactttttatttaatttttatcctggttttgtctcttttatatccccttcgtctgcaaaccattcaccttcacaagtcctttcctggttagaaggccaaagattgaagtcaatgatgttcttcgtgtctttgtgccagcttcagagggaggtccggcagatttcagagccgtgcagactggttcaaactggctctgactggtgtgagctctttgttcaatttcatgtccaaacagaagtctgtttgctattttcccttggtgtgttgctgatacttaaacttcttggtatacagagggagaaagaggggtcttcatcatcctgggatatagggaactgtggagcacataatggaaaagggagatgaggactaaattcactttagaacctcaacttcaaggttgcagcatatcttagggtgtacagttagctcccctttaatgggaaatgtgaaattgtgtttccccacagatctgggaggaataaactctgcaatgagtttatttaaccagtttattgattatctactgtggccacatgtcttcactgagtactagtacagcagtatttgccctcaggcagtttgtaatctacatatggtgctaaaacataaaaataagattggaagcagcaagatcagtgatagccttacacgagtggtgcacctgttgttggaggtcagaaggaaagggagatagagttcttcccactggggaagcatgaaggagcatgaatgagacaagtgcttgagggacagatcggatttcaagtaaggggaagaggaagttctggaaatttcagtgatctgtactgaaggaggcctctaaaatactcaggtgtgagttcaagtccaggctgggtggccagtgattgaataattataataataacataataataacatcgattgaatgcttactatatacaacaaagagtgctatataggtattatctcattaatcctcataacaaccccagaaagggagtattattgtgatctccatttggggaacaggaaattgaggttcagagaggttaagtaatttgatcatgttcatccaggtgtttggttgagctggttcaaccaataccctggtgtatttcaccccacagcctgtgttctttgccactgtgtttcactgcttttctttttctttttaaatggagaggaggtctcactctattgcccaggctgatcttgaactccttggttcaagtgatctgccagcctcagcctcccaaacagttgggactacaggcatgcaccaccaccacacctttcttgttttactgctgttagacagagaatatgaatgtaattagggaggcaattccactgttctgcatcctggtcacatcttcaagagctcaggtcatttctttttccacgaaagtacctaaagtttgggatgttatttttggtctttgtgataggctgaataacaatcatccgaatatgtccatgtcctaattcttagaaactgggattaccttatatggcaaaagggactttgcaggtgtgattaaaaaatcataaattgtggaggttattctgcattatccaggtgggcctgaggtaagcacaacggttccgaagaggactcagggaagtcagagtcaggggagaaggagatgtgatgaagcaagcagagattggagcaatgtgcttttgaaaatggagccaggggtgcaagacagggaacacaggcagccactaggagctgggaaaggcaaggaaacgtgttctcccctcacctcaattttgcctctatagggcctttttcagacatctgacctccagaactctaagacaatgaacttgtgttgtttgaagctgctaagttcatgtgaacttgttacagcagcactgggaaactgattctgtcttgcaaattccaaccagcttgacagagagtttaaccctgattttgaaatcttgggttttttttgtattatttgtttaagatagggactgatatggtttgactgtgtcccacccaaatctcatcttgaattgtggctcccataatccccaggtgttgtggtagggacccagcgggaggtaattgaatcttgagggtggatttttcccatattgttctcatgatagtgaataactctcatgagatctgctggttttataaagggcagttcccctgcacatgctttcttgcctgccaccatgtaagacatgcctttgctcctccttcaccttccaccatgattgtgaggcctccccatccatgtggaaatgtgagtccatcaaacctctttttctttataaattacccagtctcaagtatgtctttgttagcagtatgagaatagataatacagggatgctttttgatttccatgtttccccattctcccctcttttgtagccataagggaagtgatcatgtctgtttcattcactcatgaatctctgatgcctagtatggtatatggtatgcagtaggcactcattaaatatttgttaaatgagtcaaggagattacttcatcctatttccaggatatagttggccaatctgtctggaattcagttttttccacaactcaaccagcaaatgtcatagcttgctctttatgaagtcacaaagggagtagtcaggcactctacttacagttgtctgcaaacttggatatctcagtggagggagggggcagtaaggccttaggaaagccgaggctggctgaagaatctctaataagtcaatgtgagtggctaattgtgctaaatattaaaaaaaaaaaaatagatgtaaccctttatcctgatagcaggaaggtaggagggtttaataaaaagcatattgtctctgagaccctcacatgttttcatgcccgcattggctttttgtcttttatgtgataggtaggtagggagtgttttctacctatgtattattccaggttttatgcccctgagggtcttttagctggagacttataggcatagtccactccactgagtacagatgttaaagttgccaatgaagctctttatgagggatggagacaggccagtatctttggcctggattctagagacctggtttgaaaatcctgggaaagctgagagcttcgtttctccctctagagtactagtgtattagcctcccaataaaagttaattgaatttaattttatgttttaagtgtgatgcattttaaagttctccccagtgctagagtccctcttgaaaaggcagtaaattcatattattaaactaccaaatgtaattcagctcaaataagcatattcggcaatctttattctggatatgtgggactgaccttgcgttgaggctaaatcatttcatcccagacaaagtctgtttggagttaattggggaagcagtgtgggtgtacagcaggtcactctgggctttttattctctttctggccctcattcaaagagtcgctgtagcatacattttctgatgccagttcttccattattttataaatatcaatatttgacacagtatggaaggtgaaaaagacaatgaagatcttcccgctggagattcttcattagatgccctactttaccatattttaaaatgggcagtttgtcaccgatgcattaaagggctgtaaggagtggagaaagcacattgggctggaaatcagatgacctggattctaacccctgcctgtccattaaccaacccggtgaccccgggcttttctagtcttggggccttcattgttccacatttttaaagtgagagggttgtgaaagaacagtggttttcaaactgcatttcaagaggtacgaatattttgtcactgtatcttagcagctctgctgagtgaccagagaggggatggggtgagcagcagttaaggatgagaccagctgatgggcttcaggctctcagactcccacccctttgtgcagagtagctcacttcaatagcaaaaatcaacccaccatggcctaggaaagcttcaaagattctgccaaacactttaggtgtctaagatatttggggcaatttctccctaaagtttgtcaaggcagatgttggatcaagcacaatgaattgagtcatccattcttttgggagtagaaataacttaaaggatttgtttattcagatttgctgatttgtccagagttttaatgtttttccaaatttgtttctccaaatcctagctttgccagcccataatgtcatagcagctctgcgcatcttgacatgggggatctatagtggtaaaagcaggctggcatcctcttctcaaatgtctagcactctctttactattattttatgtacctcaaactttattattatgtcctctattattaatggcagagacaatgatataattatttatgctggaactcatgcttttgaatttattggatagagatcttctgaaactagaagatataacatatactaaatgtcccctcttatccctaagggatttcttttatctgaaacctcctgtttcacttatctctacattttggtggtgaatctggttgtggcttcttctttatttgccatctgcctgccccactctcagcatacaggtggctgtggactatctttattcatgtaatcttagttttgtttctatctaaacatcccatttgtcaagggccagaccagatttcatccttataggaattcctgcccagccactctagattccacaaagatcctgttctgaattccttcagaacctaattgggaccaaaaatgctcctactgtataacacagtgtcttatactattcattattggtttatttttcttaatctaacttgactctaagcaatttgaggacagagatcctgcaattctttggtatcttctgtagtggtagatatttaacataataacaaaagtatttattataataaaataatatttatgccagcctgctcctgttaggaaaggcaatgcattcttagtgagtggaaataaggtgtgttttgtttggtccactttttaacattgtattcataaacactctctggcaacaccatcattaattcatttccaagaggaaaaaaagttcttgctaaaaataaaattctgttccataaactctgtaaaaagaccagcaaacaaacaagtctcctctggaggaaccacagccacaccaggcccttcagatctaataagaaccttaattccatttgaatatctttgttgtgctgcactacgtggtttgggattcattttgcattagagaaatgacaaagacccagaaaacaagcactgagtcaggactggtttcaaagagctcagcttcttcgtttaatttccagttcatttatttgagtactgtcaaaaaccaaaatttcaacatatttaggttaacaatataatggccttttattagtgattcatgaactaggcagcatcttaatctaaaaatagaagtgctttgttggaaatggaaaaaagtcagtttttgaaaaataacagatgctgatgaggttgtggaggaaagggaatgcttatacactgcttgtaaattagttcagccattgttgaaagcagttcggcaatttctgaaaaaacttaaaacagaattaccatttgacccaacaatcccattattgggtatatacctaaaggaatataaatcattctactataaaagacacatgcacgtgtgtgttcatctcagcacatttcataatagcaaagatatggaatggaacctaaatgcccatcaacagtagactggataaagaaaatgtggcacatacccactatggaatactatgcagccacaggcatgggcaaagatttcatggtgaagacgccaaaagcaattgaaacaaaagcaaaaattgacaaatgggatataattaaactaaagagcttcttcacagcaaaagaaactatcatcagagtgactccattttggtttggtctgttctgttggggcctagtgcaggagctcagtctaaaagcatggcttcccataaattttatttaacagtagaattcttcagtactactacaattctttttaaatgctatgaccagatttgcacctccaaccccaaacccctcaatgttagttactacaatataaggagaaactgtggtttccgtaggagaaaggaagagattcttggaaaattgcttgggatgtacaaagccagagccaatcagtcaatcagaaaacatgatggagggccagccccttgcaaatcaaatgaagccttgctctctgcccatgatgataaagattatgttacaagaacagtttcctccaataaagtagtagttatggaaacaaacaaacataaaagatatttaatatgttcattccacaagggtttattcaataatttaatgaatgaataatttattaatggtttgcccaaaccaagggcaaggacatattacagtggaaggtggaggtgggatgttggatttgcataagattagagaacattgatggtatctttctctaggaaggacaaacttggcctgtgtggtgctgaagcagatatttccagagccttcctcaatgagggggaaattcggagaaaagaaacaaaaagtggacttggactttactgaattgtttcccattcccaagtttttaatatgtacagacagaaaaatagacagtctctttttgacaccctaagttgtacctgccaaatcatcagagtggcagaattggcctctgagaatgtgaggtcgccttcttttatgactatttccaatgttatttttttcaacatctcctccttagtgtttgtaatgcagagaacacttaaagtgctccacagacatggagcatttccattaccctatgcagtattacaggaagtagtttataaggagttcaatattaggaagagttatctaataaaacgcattgtctaatctccctattacaggcgatatttggatagatcctggttaactatagtctggcattttcaggaatacatttatgtgtacggtgaggcattgggcttggtgtcttccaattccatacatgtagcaaaaacctggtggctgtttctcaaatgtgcctcataactgaccaggcaaaatggatcagtaattgtcctgatgaattgccctttaattaccctctttcaaaccaatccttttcgagcatctgatggtgccaggttattgacttcatgtctttaggtttggacactttttgggcaggattattccgaagaaccacgatcatctagaggaaaacagaggaagtttcactgttgattctgagagaagaattttgagggggagcatttacatcaggttctccaatgcctgcaaggcttctgcatttctagtcccaacaaattcttcaaaatttttaggacaagattaaattgtaaccactattaactgtgtgcctaggtccatattcatgcatacctatccctgcctactttggcagaatgagttaccagtgtatgtagcagaataaaacagacttttagggtatcctaaatactcccaaactttattgttacaatctctttaatgggccttatccttcaggtgagtcagctggtttaaagagttatgtaaggtacattagcccttaaacatatttcccaaaatgctcaattctgaaaggaatttatttccttgttaagactgagttgaaaagcatgggtctgcagcaagactgaattatttatattagtgatttcttatgacaatcttataagtaactgtacaatttaggtttattttctctttttttttttttttttttttttttgagacagagtctcactctgttgcccaggctggctggcgtgcagtggtgcgatttcagctcattgtaacctctgcctcctgggttcaggggattcttgtgcctcagcctccccagtagctgggattacaggcgtatgccaccacagctggctaattttatatttttagtagagacaggatttcaccatgttggccaggctggtctcgaactcttaaccttaggtgatccaccagcctcagccttccaaagtgctgggattacaggcctgagccactgccctcagactctgtcctctattccaatggtggtggttaggtggacatttctagagaaacctgtcttacttcttataaggaggtgctataccttcaaggtggagacataccttgcttatttagtatataatgaagagatgagagaccagttgactctgagaagtagtatgggtatgtgtgatgtgaaaaagagtcatgaactactttgctagtttcagatgtaaattaatgttgacctctaattaaaatctttcaatttatatataatagctcaaagaagagcgagtaccatgacactttagatgatggtttcaaaatgacgggttttgggagcacttttctttggtacttcagcctgatcctccaaaaaggaaacaaggatttatttttgctcaaggagcggtcaatgagtgttactgcaaaatgaatctgaagtttttctctgtcttaggagggatgcaacattcacaatttctacttgtctgtctgctgtcttcaccctccctcctccctgtctttcactgttgggtctcaaaataaataacacagacacttcatctttaacttcagataatcagagtcacaatcatctgggatattgtgatgaacaatgtacatttcatacacatgatgtcataataatttaaaatgtcatctcaatctatttatgatcttctaatgactgaaatgttttacaattgtgggggatattttataactgaagttttaatggctgaatcactaacacctggctgtctggaatgcttttctttctcctagttaggcatttaaatgcatttctggaaggcccaaggggtgggatgtgacatataagctcttaaaaggaggaaaattagttcttgataccttaatgatcagtcaggtgaacgtttgcatacttagcattaatgctcttaagtggaatagcttgattaagacccttggtaggattttttttttctttaaacatccttctatgtgagattacagagggaaatgctgctattatgcccatcccttaaaaaagatcttagatttttcttaagtgttttattttctaactctattgttttcactactttttagttttctatctttggtttctaagacaatcaagttacctctttattgagaatttagtgtatattttcattttgctgggctaatatgtatatacagattatatatacacccacacgtgcacacacacacacacacgtgcacacacacacacacacacacaaattcttgtccctggatgagcatacagttgcttaaagaagaccagacatatacacatgaaaatgtcagtgaaccatacaagtcaatgtataattaagcccatagcaggcccccggtggatgtttactaatgatgatagtggcactaaattatctggtgcaggccaagagaggtcagtacaaggttgcccagaggcctgcattaaacaatcactgagataaagatgcattttagttcctcctatctgtacaacatatattaatatatagccttccaatgcaacatcccacttaatttccatagtaatccactgaaggaattcgaggtgtatatccacagtttggcagaagggaaaataaaggcttagagccatcagatcacttgcacaaccaagctcacagagctgggtggtgacggagcagagcctggactccacatccttgggaccctagtctgcttttttaccccaccatgttgcttccagttcacagggtttctagcagagtctctttaggctaaattgttgccttgaatgggcaatttgcttgaaatgtagctggatgtgcagcatctttgctcatgttgtagccaggaatataatggcaaatctctgtatatttgtttccaatgaagattgactacactgatgaaataatgataggctttacttccatttttatcaactaatggtgtttctggtgacaagtccccatgatactactttatgactctttatgcacacgcttgtgtcgctcctgcattctagatagattgggctgatgttacacaggcctgctttgactgacaccagaaagccgtgtgacaattggcttgtagattggacagttaatatagagaagtgtcatactatcccaattgggcattaagatgccatagacatggctaaacagggtggctccatctgtgaacaaaaggccactctgaaatgtcagaaaccaaataactaggactgctgtgcttgcaaatttgcaaaatggggaaacagtgtgtgtatttaattatttatttatttatgatggattcttgctctgtcacccagtctgtaatgcagcagcacaatctcggctcggctcactgcaagctccacctcccgcctcccaggttcatgcaattctcttgcctcagcttcccaagtagctgggactacaggcatgtgccaccacacctggctaatttttgtgtttttagtaaagtcattgttttgccatgttggccaagctgtttttaaactcctggcctcaagtgatctgcccacctcggcctcccaaagtgctggaattacaggtctgacccaccatgcccagcctagtctgtgtgccttaatcattgtatatctttaggcaaatatgttatctctttagccccatgtctgtaaaacgagagggtaatgtttgccttatgatgctcatgtgttgattagactacccaaaatggtaattttgttgaaacatttagaaaaatgtgaagaagagtgatacaaatgatgtctcatgtttgcattgatgtcatttcagatttttgcttctaagtatcttcctagtggcatcatacaggtgatttggcctaggttggtagccatagtttagcttttacaaaagactaagagttcccataaacatgtggtttggttctttaagttcaagccttagggagataactatgaggagttaggggtctttgtaattagtcaaattaatgagccaaaggccacatgtggcagagttatctatgatttctgtaaacattataaaattctcatgttaccttatctcttatatataggattccagctgggctatgaaaaatggctcaaaccaccatctattcctcccatttatctctgagaaataactcaagacccttaaatctgtttactctctggtttgttgtaacattgtaatatttagcttcatgtcactcagtcataattaaacagttcacattcatattctccattattggatttagtagccattctttagccacagtgtgcacttggaggttgttttggtgcttgtttttaataatgctttcttgaacttctacagtaaatacactttcccactccactggataggagaggagttgacaagctgggtgttctgatattggctgtgctgatgtttgctcataaattcatccagcaatctcttgcggaaaatacgttctaaacttggtattaagtttttgggcctatgaccagagtgaactcattttgtgtgtgtgtgtttgtgttaatccttccaagagcaataggttcacttggatagttcttagtttctctttttaaatttcttgattaagctgagagagttcacactggaaactctttgctttgctgattgctccagacctaatacaagtagatcttcaggggaaaagcaacatggctcatctaagtatttacctttatactggtgaagtcatctcttggtgtctatcttcatatttcccaaagaacgtataaaacacatcttatttcctttcctaagtctgaggccttatccatatattttaacttcagacttgaatttgtccttgtccctgacctagtaaacatttttatcaagaacatgtaaggagctggaaaaaggccttttttattaactttcaaagtataaagttggagaggtcagaacattccacaggttttagatcatggttccaagtggtcccagcaagctaaaacactgcctgacacctatcagacaaaatttaataggattgtaagttagaagtcctagctttatattttcaaaaatctattattgaagtatgtgcttgaaaggtctggcttggcagtgtttcaaatcaaaggcattgggatattttatttgactgaggtttgatatataccagcgtagactatagcttgggaaggtattgccaacttggatgtgatggaggctttgggtcacattgtcttcttgggattcatacagttcacccatcatctagaggactaggttcaggtcagaggttcatgttttaggaaaaccagaaaaactaatggggatcttcaggagaggcactaggctgttgagtgttacggaaatatttggcatagaatagaggagattaagatggtacatagaacattatctcaaatagttgaaacattattgtggggatgaggatgtagcatttgtaaaggagaaacctaggactatggtttaatggtataaggagggaagttttggcacaatgtaagaagaaagttttattaaaggatcttattaaacaaaatgatattcttccttacaaagatgtgggtgctgattgttctggaagagctaagagcagagctggaagaccatttttgtaaggcattgtagaagagatgtctacgtctgtgtgggaagctggacaggtcaaccttgcaggatgcaaggactcatttgaattcaaattcattgttatactgagaatttcaaagtttgcctatacattttcagtcatttccttgtttgtattcaggttattatatagcattctcagttagaaatatcacatggtcactaaacctggataccaggcacagtttgagtttctaaaagttgaatgagctttcatggacactgctgccgccacctctttgggtgtgccctctgctttgcttttgtggtagtgtcacggacatgcactggctgattctagctctcctctctggtaacccttataaccaataagtgctaaaaggactatagtatccctattgcctttcactgccctctaactcttgcttaagctatctctgccccacctcctctagccctcttcagttccactttcagattctcccttgacccttcattttctccttgcaatggaaatcctaccattttttccaaggctcagctcaattccatttccttcctaaagtcacctctttgctaatcttcactcatgctaatcttcactcatccctttctttgggactgatacatctttggaattatctagcatagtgcttaattgttttcacattttcctgtctcttaattttatctcccaatctccatagtacgtaatttgggattagggactttgccttactgagtactgcatgaatacattttattgatttactgatttgattacaaatatgatcaccacacagaaccaactggctgaaaagaattgtgccctgactttggcttcatcagcacaaggtcaaaactaaccaatttatttaagtatctaaaggatagggcatcatgtgaattatattaactatcaaataagcctagtttgcttattatttagacattcttctaaaccctaataaccccttgtcatctctgttatgaggccaaggttgcacgtttagaataggtttctggaaggctaagctgcagagccataggcagatgtgctgccactcctgcaggcttattcacgaggtggagaaaaattctcttccaagtccctggcttcccattgcaaagtaaaatgatctctggtttagagctactcaaagggttaactttgactccttcaccaaacccaactatttaatgtttttaacggcataatgtgttaatagccatacagctgttgtttctcagcctcttcctttattgagttagacaccatttagtaggctgagttcaaattgtaaacaaattatttttgcatatggatcaatggaaatttaataaagtttattaaaacagtatattggaccaaggagtgctgttttctctcatggatataaaccaacctcattagaccaacccatagtaacagaattgcagggaagaaagtatttctggtcatttaaagattattttggttcaacagatggtgactagcatcagagtatagtttttcttgtttgttaattcatttgcatgaacatatttgatggatacctagtgatcccaacatgcttgattttagtgcctagtgtgctttctagcacatagcaggaagttgatagagttgtcacagaggggattgtgatctcaagtgcaaagaagtggcgtgagatgctgagagtcacacagctgttgatgggcagagccatggaagagcctggagctctgagctctcagtccagtgctcctatcactcacacaatggccctcccttgattcactgcctgtgaaatgtcttaaatgatccgcagataccttctgcctgttctcatggcaatcccagtttatgttgcaataaatgttatcttaatctcaattgattgatgagttcttaaaataacagcattaccaaagttcccactcacattgtaaatcgcaaatattccactctttggaaagcattcagggtggctaaccactatttcagatatggcttgggcagccccactcttgtaagaggtatctgaaggggcttttaccagaaggagctaaatggttatcagataacttagagtgggatacagggaatttgtagtaaaggcctagattccgcaacacaaatactgactgccctgtggatttgaagttaaagcagaagagaactaagatgggcctacttttttggccctgagtgacagcagttggcagaagcaaccctttggggtagtagaacaagcttggagttgttcattccagcttccttgtgtcagagtcactgttaagtaggaggtcgttctgttcgactctggttggaatcattctgtgtctgggggcctgtcgtttctgtcattcttcctggaaagtagaatcctaaatatgggcagctggtttggactgaaaccttggtgacttctgaaagttataacaaatggaagtcattatcaccattgcccccctttacctttgtgctacttgaggcagaaaatgatttccccctcccccggtttgttttggagtctttcatccagagagaaaaggattagcctatggctacaatagagctttcagggccttttggcgtgctgcaaatgtttacttatccaggtacaaataggtaaaagcacatagttaaagcttccagctgcaaggtcatttacctttttaaaatgcagccgcatgtgccgactgaagtcgagggcttgctggtatgagccattaactgcctgttgtacgtaacctctccttgtcttacacacagctgcgtgcgagctgctggtgccatgcagccagcccaccatgcatgccttgcgagcaacaaaagcagtttaacttgtgatcactgatcatatgatccacttacagggtgcaggctcagtcaagtagaactggtaaatcattaaaaatgcgccttgatgctatgcctgctgagtaaaacatcatgctaacatctctgcctcccacccccaaccagttagcagcatagggaaggagctggtaccagctgcatattggagaaatccagttggctgagctggacgtggtgagagattgtcagctgcttccaagcagcattggagaggaaggcaggaagacagaaataatctggagtggctgccatcctctctccttgtcctttacttactcattaactgagcctgtgcaaagggccttctgtgtcaggcctggtactagtgcctaaattacaaaggtaggagaggaaatgaactctgacttagagactctcaaagtctgtcaagaactcagtcaccaccaagtactttcacataggcacccatgacgtgccgtgcaaccctaagaggcctggggtagccaaagagatgatgcttaagctgaaccttgaagagtgaatagaatttcatcaaggaagcatgtagttaaaggaacaacatgggctgtgccttaaaaagttactttctagaattctttcttccatgaagcataccattctactcagtttcttataggttttaacaaattgttttgtgactgtatgatggaaggtccaatggatcctctcttctctccatcatgtgggtctaattgtttctggcatcatgttactcagctatataaacccttctgggatgggactgtatctcttcagtattcttgattttccttacagctccaaaaacttggggagtgggtattgttggttggccaccttcttccattttcttgattagaaatattttctttgacttattttccttagaaaataagaaattattaaattagaaattagttgctttcacttttaactaaggcaatgagacagaacataccagatagatgttcctcctgcatatacgtcaggaacatctgctgttagagaagagccgtgtgtgtgtgtgtgtgtgtgtgtgtgtgtgtgcatgcacgcacgcgcaatatgttttaagtatattgtgtgtgtccatatgttctgggatattgaggtttctcaggagtcctgcagtttgcatggctgatacaacctttaaaaatgacttggacttccagaggctctggagagtaggtttaataaaatgttcattcctttagatgtgagactatgccattttactttatctagatacaccactgtcttccagttaatcatagcccttaaataccttcttttgcttctcaaaaggttttacctggacccagaagttcatacagaagctaaactttgggaagaggtcagatgtggaatccgtgctcccttccctttttatacttgctctgctctgcttgtacaatgaatggtcagttagaatgcctttgaaccaccccccttcctttctttttttttttttttatgggactcattcctgcaaggacagttgtttcctgcagaataactttctcattcctctcaggactactgcctgggggccaaaacttgctaattagagggttggaggaatcttcgcaatctgctgtcttcattttcaacaccagtaagagctaacctttggctggttgtaggaatgaatgagttttgtcctctagaaagatgtccgtcttcattgtacaaagaaatggaggcctgagactcaagctttgtaggattaagattcagataaaatcggacaatttgctcagctttctgctttacatctttgtaaaggaaataatacttcctcatacctcccctaacttcaacccaatctctaaagaaatgagagaaactctaaatctgttctaaaactaggggtagtcatggcataataggtatgaaagatctgttcttatctcttccttgtataggggcagatatatagtggcagaattgagaataaaccaaacaattgagtgttttcagtagaaactgatatatgactaaccatgtacctatgaacatatttgattggtggtatttaaagagttgtaaatatttctcattaaaaatagactgtgagatctgtagtcatcaaaggtgggattgccacttgtggaggtagaactttgttttatttgaaatcaagaaaagttgtgcagctacatttggggacactctgggttgttggcacaaaatttaaactcaggctatcaggaaattcctcagtgggaaggcatttcacaaagtcgagatattatccattgatcatggtaggaaagcaggcaagaaagctgtgttctatcctgggcaagccatcaatgcctggggaaggccctttatttccgtctctgtgttctcatctgtctaatagagaagttaatacctttccaacatacttcacatgtgaaaatcagacagtgtaacaggttctctgtctttctctcctggaacagatgaaatctcttccatcattcagacgctaggctgttttgtttggactctcttctatgggcatttgccccaatccctttttctatggtagttattgacttatctcatttcctcctacaacagtgtaagttaccttaatttgcaacagtttactcctctcaacatggtgcaaagagcacagcacttgcatcaggaagccctaggaatatagaatcagaatggaattctgtgatggaatccaggcacttggtttccccaagaataccattgtaggattgttctatctgccccaccatcttgtttttgggagttaaacaggagggcttatgggaacatgccaagtacatagtacatgcttagtaaccattaggctccttcccttagttctttgctcatagtggcaacttaatatatgcttttggaccaatcaaattttgacaatgaggaggaaatccatgctatttgttttttttccttctggttaagatgttcaggagagaaatagccctgccctcagttatattaaaaatttaaaaaattaccatttcaattgttgatacaaagtatttttgaggtctgcagaagacacaatgcaaattttattaagttaccattatccttgtcagtgaaattagagcatgtttctaatcagtatcttcagcaattacagacaacaaggaaataactcatgctgttatatgaaacagcttataaatttttacatacatgtgagaggaatcacttggaatccaaagctgccaagaggaataattaggaaccacagaacagatcttggtaatgtgacagcagcttctaaaacatcccacaggacgaagaagcgcaagctggcttgacctatatctttaataatacagatcattgcccttggattgaggctaaagggtaggaccaagtgcttgcttcatcacgttttaggaaaaattgccaaagtatatttatgaattcaccacacaatggcctcttgctttgattatgaactgacggatctctctaagtagcaactcagcatgcaaaatttaaaacaaaaaaacccaccacagagcataatttcttatattctgtcatgcttggcaaaaagtattatgtaagacccaagtagacaaatggctgttaacagtagaaataaccttttgtttaattagaaaataggagctatatgggataataaaaatggttactgatgccctctgtcactgtttaataaatacgatcgcgctagagataatgggaagtgttatttatttgtgcaatatcacagacttggtaattgttcatgttgttgagcattttcctgtgtggagatcacagtagttttagaatttgtttcctttgatctaagaaaaggaaatagcaagttgtttgcttaaaatgttcatggcctccctaggctggagtaaagtatctgcatatttttagcccctcagttttgaggacagaatctctgtggcgttgtctgatgcatattgagaactggtgcgttattttgaactggctctattttttttttccagagcgccctcaggtgctcatggaacatacttctcagcaatgccatttcatgttcagttcagattttccagcacaactaaatttagtagccttgctggagggaggaagtggagcagagctacctacctgaggatgtgttcatgggaagagaaaaatctccctgttgctccatcttgagaaccagcatatgggatgaagatcagactgaatttccacagcatgtgtttcactatcttccctggggggtggtaaggagaaaaggctgaaggtgttggccatgtttcagggtcacttccattttgtgtttactgtgaacactttagttgtgagactgtgccatgtatttggggtcatctggctagatttatttcattgcacatggcagttcacgcttggtttcttttttttggggggtggtggtggggattctgttttcttttgtattgtgattgctggagtggatactcttgtttcttgccttttagagaaaatgtttgtggtttgtgatattggatgatttatttcttattatggcaacctaaggatttttcactgttgactttggtgattgtgagatatttcctcagaccctgaactaacacttgattcttctcatacagagaaatccacaaaaatgagatatggcacaaatttgtatagaagtgttttgtgtgaccacttatttctgcaagtcctaagtagccctttctagaaggtttccatgtaatacctttataaaaatatagacagtttgttaaaaggaaaacacaacgcaacaaaaccccttttcttcacacaattcattttaagcttcaaaatccctgaaaatccccaatctccttttgcagtctggttcccactctaactttcctcatctccccctgaaagaaagaaaaaagcatttcttccagggactgataagttgtaggccgatgcttagcaacagcattcctgtgctttaagtagctgcaagccccttgctgaactctttgatgtgactgtcagggcagatttattttgttttagcacattgtctacttgtccagatgtatcaggagataaaaaggagtcatgtttacactcctcccttttttttttttttttttggagatgtaattaaatcgtgtttttgatgagtcttggggagctccagttgaagaaaacaggaattggctggagtaaagggaagaatgaaaacttgcttggcagaatgaacacctgactgcgtcaaaaaataaagcataagtaccagctggcgtggttctgtgaagctggaggttttgttctgagtcttttgttccacttctgtggaagtccaaccaagaagaagggagaggtgcccgtccagcgctcacttgctgggcactatctgtgaaacctctagctctcagtgatctcttctttcttactgcacacaggcgcgcacatgaggccttaactcccttcttccactatcatttagtgggtagtacatctgtgatagatagttgtcaatctaagctaataaaattgttgaactccagtgatcttgaataaacaaatcttcaccgagctggatgagttgaattccctgggaatgggattgccactctttttttttttttttggtgatcagttttttaatgtgcacatttagtaacaccattctgagttctattaatgacctgcagtgagcagtgacaagcaggaatatgacattcagtactgctgaggacctgccaggcagcggctaacacgctcgctttcatctgcagctcgggagacactctatttgcatcctaaataggttacactacagcacccccttctgccgactgagctgtgtgacaagaaggcctcactacaactcagttttctcccctgatgacagccctgaaggccctttcacggctttctctaacctttctagccttcccctttggtccctggaggagcacaacagtgactaatggtgtgcgtacctgcactcctgggggcttcatttggattatacttttaattactcattcatcagaggaaaggaacaaaaaccatccattgaaggagacagaaagatgggtataacaaaaagaaagctgagccaagcaggtgctaccttagatcactcctggctggggtccctcctgccagatcccaaatcccagacagacgccactgaatgcatcttagaaactacaggcttggttttgtgtttcccatttgtagcccagtctgaagtacaggaaggaggttttcctttgtttgttctaaacaccttttggatgactccatttggcagaagcgcaccttaaacttgtagtcctttcacatacgagaaatcaactgggctctgctagaaaggggtgtccacatggggaattttggagggaggaactatgcatgccacctgtccaacactgagaagccctgtttgcaggggttggggtatggggtagagagctcccatcagaggacagtgcagaggctgacttagcctgggaagatgtggacttattgttatcctccacccttggaggccagggaatgctatttgttcaatattttaagttcatttaatttaccatttagtatttatcgagaagatactatgggccacccaggtggagtagggcgctgccctcaaggagcaaagtgtctagtagggggacaactcaggcaaagcatgttgggagggagttaggaaggaagactaggctttgcaaagatctccagcaggatggggcacagtgccctgcgggagcaggagaacaccacgtgatgactctcagggtgaggagtgaaggcaaaagagaggctgagaaggcaggggctggggcagagggccttctaggaaatggatggtgctctttgcttaccccaagagcaaggtgaatcactacgtttttaagcagagaggccccagtttccttgtgaatcttcgtggagtcctttgagctctgtaaccatctgggttacaggtcttctttgtgtgtctcactaccatgccttacccttctgtaatctgtctgtgcaagtgcacttgcaggataaacccaggagctggagaaagcagaggagtttctgtggccgtgtttacctttcaaaacctaggaatcctggatatggaataagagaaaagagggcttgtagcatgtgtgggccctttcttgggccctttctatcttataattggtacaaaagacagtagatggtagaacggagtcaggaaaaatgttggaaaatgttttaatggatgaaaactcatttggaaagtaacctcaaaacatcttttttctttttcttttctccctcccttcctctttctttctttcatggtcaggacattggactgtcctgagcaaaacatatacctagaatgggatctcccacccagggtaggttcatgcatactttgtcagtgactgagtccctctagaccacaatgtgtttgagagttgaagactaagatgggcacagggtagtgtttctttagaaaataaacttaaattttgcatttcctttggcttcagggagaataaggctgctagaatggttagaaatattgcacaggacatcagacttactgattatgatacttgattagtcatttttcttgtagtaatcatatatttgggtctggaatctctcaaggaaatagcttcacacatatgtatacgtttagatgaatgaaacttttgatgttaacagttattgatagtataaagcaaataaaaaaggcctctttcaagaacggctctgtgaataatttacagaaaattttgaaaaaagaaaataaaggagaaaagatttttgggggttatttctcaaatgactttccatctattaaactattttccaccatttcccttggctccaatctactatattaactatattttataataaacacattagtattgtgaaaattaatatttaataatgtagagtccttatctagaaaagttaagttcttatctagaaaggtacacaggctgaggattagtattaactttacaaagaaagattgggtttggaactcagagtttttttatatccttatcctctcctctgcaatcaacacatacacacatacttttgcatactgcagcccttttggaattccaaatgttagcatccaagcttcatggttcttcttcagattttagctatcctgatatagacactgagagcatgtgggctctagcccagaagagttttagcagcctagcagagcatttgtacatatccccctttggttgctatagtgggtgctgttgaattgctaagcagagaatcctgcctactttctttgggtctcttgggggaaatgaaactcaagtgtagcagctagtcctaagtctgtaggtcttcagttccacatcctaagtcacacatgacacggggcatggatcttcaggggcttacctaagctgtccaggacacattgtcctcatcctcaacacaatgaacctggaggcttggatatattcaaggcaaacatccttggcatctcttttagaaataggcctgaaagataaagagggccgagtgatagagtaatggggaaatgcttttggaaaatgagagatgcacattagaattaattttcccatacctttgaggtttgcatatgtcaaaattaaaactttttagactgttgttcccagaggacttcctcgtgctactcttttgtactggtcacatattctcttgtggtattatctgtttaatgtgtggacaaaatgtgtatgatgtctcattcccagaattgataccagtagttgcttgacacatgctaattagtaattaaatatactgtattactcctcacttaaacagaacataccacactgagtttaactttatcctgttgacatatatatgtgtggaggagtggaggaagcctggggtgtcatcatttcagaggtctgttgcagcatcttgtggttcagctcttagtctagctttttgtggttgtttctttttccatgtcatactgtgaccccagcagctacccttgcccacccctcatgttgctctatttagatgcctgtggctgtttttaatcttctgtgggataccaaagcttagaagaataaaattgtatgataaacctgcctgatgtcaactaagatcctgaaaggtataaactttatgatatctgcaagacctcgtggggagggttttctggaggtggaggccttttgttgatgttgatgtcaggattgagccactgcataatgagttcagtttggcctaaagataatgatgagatgttttgaatgtctgggatgcagtgaggggctcctgaagacttacacaggaggtcgtctgctttcgaaggggaatttgcccttttggcctctttggtgtccactacactgtattctgggatagacctaactctgtggaaccaccatgtgaccacccttaatcaatagtggtctgatggggccagctgctctctcagcactaggagtggcacaggagccaggctcaatcaggtagagggttctttctcatgggtgaggagattctttccaggataggcacataacccaaagcaggccacggattcccagattttgttggaacttacaggaaagagaaactctttcttttgtctttgaagatggtgaggtacagatgtggggggctcctgggaggccaccacgtggagaaaccaagaaacaaagctgagatagaaatttctgatgagaagtttgaacacctggatctaaccgtatatgaaaccatataccttgagctcattaaagccccctgctcctctttttaaacttaaagcactttgaggtggatttcatgacttaccatcaaaaggataatcttattttcctgaactgttcaacaagggagattctacaacttaccctggaaatgtagcaagtggtccccatagagtcattttggtcaagaattcttaattgtgtgtgacttaaatttcattttctgacagtctctctgtaatgtaaataacaaaccaaccctacttgccctctccccaaatcaaaaaatcctcaaacccaggaacaaaattttgattagtctactccttccaaagacaccttcatctacttgaacatcaattttcaatggtcccttcaaccttctctttaaatactgtctttattatgcaactttgaaatgatctacctgtagatatgtatggcaagtgtcaacactagtgagccatgagaatttgtcatagcagcgatctcacaagcatatcttgaaggttttcctgtggtttcatcctggcatctggtcctgaaagacgaagatggatagggagccacatggtggctgttcactggccccaggaaaggccgtgcttgtttcccctcccaagactacttccatggaccgagacaggtaactgcagttacccagtgactggaggagatggagaagattccagtagaaccagccaatctaaacccaggtccttctctgtgaagtcacctttgctacacatcagagaccatggggctgctgctttctcaccaatctctctcctgctctcacctctctcctcccagcctggggatggagaagccatagcaagcacccatatggctcacattttcttctcctcaaaacctctccccatagttctgtctgaatctgaaagtgacggctccaattaagacacaggaagaaaagaaatataatttctaagtcacttggcctggtgacatatatgttgggagttaggaaagtcagtgtgcggcttctctaccatcccaggcgctgcagtcaaacaaatcaattcagccttcagaggggcatccattgccttgtgattatgtttgtgtaaagtcttggggtctttgatcaaagaatggcatttcaggccagtccctaatcctcactgccttaagatgtttaaatgggttaaaaaaaaaaaagttgataacagctgggatttaaatttgcctttgcccagcttttgttttgaaaggacttctattatccgtggcttcccttttcgaggcaaagatggatcattgggtaaaccaaaaagggaaagaggatatgggaggaaatgggcggggactctgaattaatcttctgaggaagaatgtttgatcagcggggaggaggggatgaaaacctctgatgctgacagcaggcacctttctgatgagggtgtgattggcacctttgaagcttcagtcaggagccagtgtccagtgggtcagagcttcctctgtctgtgggtggtggaggtaataatgaggcaactggaaggattaattgcggacaagcagcaggattacgaggagggcttctcagctccaaaaggaacagttcgaggaaagcctctgatctgtcagccttagaggaaattagtgggagcagactcgagcaggcttaaaaaaaggcatttaggatattaaagcgaaatgtgaagaggatattaaaatagggcaaaagggcaaggagcgctgatcttgaaaggcgggtgtctccctcttattactaggaatttccaagttttgcccagatttcacagacaccttatttttacagtccagcagagagattttacttgcattgcaacaagttaggggagggtcagactggatttgaggtggcacccaaggtcctgtacaaaacttgtttgctgtccaccctctggcagtttcagaagctcctgaaactaaggctcctggtataattttacaacaagccagcgcattactgacatcctatctgcattagctatctgttgtatgttttacttcttacccttctggttcaagtctggatgctgccaataaatcctgtgttaccattaaagaggccattcatcacgcttcctaatgcgattaatcaagatacaccacagtacccttaaaatgagatcattttgataaatcatgtatgacatgaaaagactttattccttttaagtgcaatttagactgtaatttttttcctcatttatgattcatgggagaaacatggataaaattcccttgcacagttacaccttatctacagcaataactcaaaactgcttttagatgaaaattcagggtcttattcaccaaagctgaatgccagctcattattttctggcgttcagtagtccaaaaataatgtccgcacattaagcggcattctcaaaaaagttggaattggccaggctccaggcacatcaattacactccatcatccttaataaggaagaaatatcagatgtcctcttggaggttttttgaatcagtaatgctcagcctttaccttcccaatttagaatgattgggaaacaaaaatggtagtaacaaaaaaagtatgggaatttcagggcctttacatgactcttctcctgttgcataagtctcaaaagaggtattttttccctcccatgcggttcatgcttccttttccattccccttttctcatttcacaaaggaaactaccattttgttaggtctgagttttgtttctaagctgctgtatctgtgatgcaggctttcccctcacagctgtcacaataatttgggaaacgatattcataacctccaatagaaaaataatttgaaaatgtgccttctggtgagatccatcaagtttaaggccatatttttggttaaaagggagacactgatgctattcattaaactgaaaaatggcttgttttccactaatattgaaataaactctggatgaatgttaagtcatgctggcatgcactcttattgaaagcaaaaggaaaacacagatatatttaatttggacatgtaaagtcaacagagttttaggtctttcatgagaaagggaatcaggaagattggctgaaacaaatgtgaacaattagaagttcatttgcctcttgcaaagagtgagagcatttaaagagggattcagtgtctgagaactatagactcacttgcatttttttttcaacccctggtacctatgaataaagaaataaagacttgatcaacatgtaatttatttccctgctgttcttagagattcatttgggaagcagaacaaaagccagtatttgactctgtttttaagtaacccaagaatgcacacgtatcctattcatgcccacttaacataaatgcagcaaaactcaagtttatttgggttatcacatttatgctaatgctctgtactttaatcggatagaaactgacataaaacaaaagttccttgcatattattcacacatttaaatgaaatttcctgtgcttttaattttttctaatatgaagagtcaattaagaatctaaggccattaaggctgcacttgccttgtttaggtttccatttcacatttatgactttctatttttgtgaaaaaagatctgtaaatttgaaaaatatgcacgtatctcattaaaaaagtttcccagctctagcaacactcagcaaatctccaaagaatgcaagtttaaaacataaatattttaaggccccataaaattggcagtaaatatttttccccctttaataccatgttcatttcattccaatttactaccacgattatattttccaaagcggcttttaatacaatacacaattatttcatatggggttgggtaggtcgcctcattaagcctgcaaagatcaggcctcttgtgatccccacaaatatacttgcatttactcctaattaaaatggccctcttaaattgtctcaagttcattaatataaataagaagctaagcaaaatagccacagttgaacagttagcagggcaagatgaccaggtccccaaacctcacacagagcagactgtggtatgtatgcagtggtgccctgccacctgttggctctgcttacacataacagggtattgatgtccctcatggtggtgcagtaaccctctctgacccctatccctagttcatcatccccaagagaaaagaagaggcctttgagaatcccaggcctcctgatttcccccatcattcatttccttggctacatgtttctcctgctaatgctaaaaatttatggctgagcacattaagggcagtgcgagtccttccctacttctggattatatcagagtttcctgtcataaggaaatccaagatgtgtcctcagctgattgcatgtgacagtgtctgcttatatctcaggaatctgaggcatgatggataaactgtcagttttgaaggatgatattttctccatatttccattatgaactgggctgtcatctcctaataaatttcttgcattggtatcaatttatttttacaagcagagggtctgatgtatttgggaaaggcactgacagcagatctggcctagcctgacagagctggcttcaactcattttggaaaagtactttggttccaaggacagaacttgacccgtagccctcaagattaaaaaaaacctccgtgagaggaaaagagacacatgaggcaagttccttcttttaagccaaaataaatcaagcccttaggactaccatgacataatatcatttttaagacagtcctacaaacccagttgagatatgccacgtgtagccttctcgtctgagttagatgagaccatctaaatgttgttagagcatcacaataatgcagtgaattgatggatgaattcggattataatgaagctagggatctcacaatttttgctcccagaagggatctcagtagtgctcttctgcttgacaagtgagaagcaaaattaattcatataatgcctatttaattatgaaatatgggcatgtctctgtcatggctactgtgaagggcagaaaaagctatacaacatgagctttacctctcaagaaacttaaagtccagttgaagagataagatattaaacaaaattagagtgaagtaagaataaatcatagctaacatccatgagcagtggctaagatggttgtttcttacccttatttaacatttacctttattgggaagggaggcagcataacattgtaattgccaagacagcagcaactggaggcaaactgcctggatttgtgtcccagctctgccaaggagtagttacccaagaacttaagtgagagctttgtcaggggacttaatttctctggtcctcggcttcctcatctgtaaaacagaactaggagttgtgactcctcgtgaaactttgtgaagattgaataaatcaatacatggaaagtgtttaacgcagttctcgacacaaagtaagtactaattaaaaatgctaataaacgttagcatttttaaactatcattatcatgattgtgactattattaccattatcactgttagtcaaaatgtggcttaaagagtttaagtcaattgcccaagatggagcctggctctaaatcttgatcaataaggcatcagagcacagaaaacagagagttaaacaatatacaaattgtgaattagtcaagaacagaatccttgaagcttagttatttttcttactgttctttccattcctagactataaaatagccctttctccattgcctgaaacatactttagaagctagttgaaaagtgttatatgtagtggtgtgtaggtaaatgcttaacagccaagtctctgggaaaaaaagtgtgtgtgtatacacatgcatatataatatattgcattttttagttatataaatgatgtgtagaacacaattaaaagtaaataacaattgaatatataatactgtttctaaaaaattccatacaatcacttaattgtcacagatactttcaatgattttggccaaactcttgtatctcgtatctgtggttgcaactgatgaacaactgtagttcccacttgatattcctttatcttaatgagtatgtcagaactttactcatttgttaatgacataagaaactactttgctgaactggataatagtttttgaatattggaagaatattttttcaatttttttgtgctattcacaatgccttgcaatacccaacaaagcaacttctcaaagaattaagaaaagattattaaatgagaaggaatatactaataccacaggtaatttttataaaggcagaacatcctatctataaataagcaattatatttagccaaagaggtatggagcacaagttaatattttgctaccattaggctacgacacaacatcctttttttgttgttgtttttaagaaatggaattttgccatgttgctcatggttggtctccaactcctgggctcaagtgatctgcctaccttggcctcccaaagtactaggattacaggtgtgagccatcgtgcccagtcacacaacattcttttaggttctatctgcaacattaacattttctccatcactttaagtttagcaaataagcacaccaatgaatcaagctctcacttgcagcatttgccagtttctgctgcaaatactcccacagtggccaatgtcaaactacaaagtgccatcactgaagagttggaaagtgactgcacatcattatatagtatttttatcatacaaattcagtagactcaatttcaagagcataaataacagtaaaattttgtaaaataattaagaagtgaggagtcttgttaaataaggtaatttattcaagtttaagtgtatataattttaaataatacctgtgtttaacaactgaccaaagttgctgaaaccttaataattacttcttgtaagccagtacaggttaacacttacacaccactggttatttgaacccaaaaggccaaagagatctgaaacactaatttgtctacatcgcacagctaattctttcatgtattattaaataagttgatagttttatttacttagcacgccacaaaacgtgttgcatattaccatgagttgattcatatctcactaccaatatattacctacctttgtatgtgcactaaataagcctaggagggttttctttgccaggcacctttgaacatcaagttcattgtacagtgcttaggattcaggctatggaatcgagctgtgttatttctcaattccggtctccacatactagctgggttttcttggactagtactataacctctctctaaatctcaactgccttacctataaagtggtaatgttaatggtacttgtgatggcagcggcggcctgtctggagcagccgcttcgaagattagcttcagtggggcaggaagggctggtgggagccaggaacagacaagagccccaccccctaaccagttgaaggggcgggagcccgcactccttggtgcagctgcagcttcccagccgcactctggaccctggcatccctgtgctctcaggggcctgggaagcccctgccccagcgggcttggaagtgcctgctcctgctcccgggcctctccctgctcccggtgcccactccagtgcagagcaaagttgtggccaagcccgagggctgtcgtgactcagctgcgtttgcgtgcactcagggcagcactcacacgctagcgccccctgctgccttggccccctccagactttgggcgtcagtgagcgcaggaagcagcagcccagggggtgctgagggcagctccctgcgggcctgtagacacccctcaacgtgaacagcctgggcaacgtggaaggcagacaggtccctgggcggaagggggtgggtgcccagtgaaaccccaccttcaagccagggatggcttgaagcctgggggccgggctgccagtgccgggtggagtccccctcctggagtgagaatttatgatgctttttccggctggcccatggcagcccatggaccaatcagcactcacttcctccctttgagcccatagacaccctccccactccaatgacctgcctgcagaaaggagctacatacacactgtgggtcttctgagagctattctgttgctcagtgaagctcctccctgccttgctcaccttccagttgtccacgtacctcattcttcctggatgcaggacaggaactcaagatccgccaatggccagactaaaagagatttaacacaaacagggctgaaacacgcctctccgcctaacacgttgcaggtaatgagaaggagaagagctgtggcccttcagggagcccagacctaggggctctccaagtcagggctgtgacgccctctttagggctctgtggttcctggcgtctcccagcttccaggcaccacagcattccctggtgcccatggtggaagctacttgcaggacgcctggtccagatgcagcctctcttggagccagcgcctatactggcacttggagctgcctgccccaccgcagccagcacacctggccgtgcgctgtggccgaaccccgtgctcactcacacaccccttgccactccatgcctggctcacccttgacagatgtgggatctgggccggtagtgccagctgagcgcagcctgctgggccaagtgtgtggaatgagcccagtgaggctaagcaaaactcaggcaaaggcgccacgggccacagacatttctgactagaaaactgacaccctaaggatcctgtgacacttgcattataaggctattgagagggttaaatgaaacaatgtttataaaatgcctgcatataattaatgccagaaatgtgatgtacacacacccacattacttggaggttatattacattacattctgattatgttctatgtttgaatatatgacacaaactaaatcttcagcaagaattaattagcagcaaactattaatttgtgctccatcatacttctttggataaagataattatttgtttgtagataggatattctgcccttattaaaactacccatgctattagtaaattccttctcatttgataatcttgtctcaatgctttgagaagttgtcctgttaggtgctgcaaggcattcactgtcaaattaggactggcccctaccatcttgcaaaagagacaggtgcccagtggacagtgaagcaggggagaatagagtaatggtcaggagaagggcatcatgaaaacctgagggctccaatgcagagagagtgtggggctacggaaacagtttgggctttaggagtcaggctgatttggtttctaatcacactctggactttagaactggatagccttgtacatgttactgatctttcctaagtgtcagtttttttcatttttcaaatgagaggaatataggacatatctcatacattggataaccattagcgtttaccatatattcaagaaatattaaatcctgtcacacactttgcctcctttctttaccatctccttctttttcctcaactcgtatttttcctcccttttttcatctctcctcaacctctgataggacagattgaaaaatatttgatggactaggcattatttcgtatcagccattgtatatgagtagtgttttaaattctaaatattgtaaattataagaagtaattatatgttaaataaagtttacaactccaaacatccttaatcacattgctagcaaaaatttattgatttagtttttgagatggagtctctctctgtcacccaggctggagtgcagtggcacattctcagctcactgcaacctctgcctcccgggttcaggcaattctcctgtcttagcctaccaagtaactggaactacaggtgcccgccaccacacccagctaatttttgtacttttagtagagacaaggtttcaccatattggtcaggtggatctcagactcctgacctcaggtgatccacctgcctcagcctcccaaagtgctgggattacggatgtgagctactgtgcctggcccaaaaatctttctatctttacttattaactactacttattcctaattttatgtagttaaaaaccacaacctatgtattattttaatgtttaccatgttgacttaatgctaggtaattaatatctttgcatatttctctctcctttgtacttacagttgtattaggttaccaaaagaaattatgatcacttctataatgtccaatatttagatggttttatttttgtcttctgttatataagtgtctgctaaaaatattttggaaccactgctctagatgatttgtaagatctttaacaactcttacattctgtgattgaattagttatgtaatagcccataaaatgcccaagccacagcccttccttccttttttcctttcgtagttctcctcctccctccctccttttctttttccttccctgcctttcataaatatttgtgaactgctactctgggccagatgccactgtgggcactggcagaactgggccccctgtagatcagatagaaacaaatgggaagctctgggccattgccttcaaaaggctttcttattccagagaggtttttgacataatcctcccctccccaccagcctctgctgtgaccagcttcttacttgaattacccttcagctccctcgctcagcttcatgctcagcatttgcccagactctgacctcttctccattgggatctttttcttggtctcttggttccagactcaccctcatccctaccttgccttttgttttcctcccaatttcttggcttctggctctagacaggatatggctgttcctgctttcaaacctgtctattattcccaacttaatctgtctgtcagtgacaccttctctcttgctttactgaaaggcatggcaccttaatctgtgagaggggtgggaagcttcagccttctacctggttctttagtttctctaacttaatccttcagaagatggcaagtctttacttttggattctggcaatgtggcccacactttcgtgttgaattacagtcatggtatgtagttttttttttgtttgtttgagacagagtctggctctgtcgcccaggctggagtggagtggcacgatctcggctcactgcaagctccgcctcctgggctcacgccattctcctgccttagcctccagaatagctgggactacaggcacccgccaccatgcctggagaagtttttgtatttttagtggagacagggtttcaccatgttaaccaggatggtctcgatctcctgacctcgtgatccacccgtctcggcctcccaaagtgctgggattacaggcgtgagccactgcgcccagcccatggtatgtagttttatctttgactttaaaatgttttacccatcctattatcatgaattgacttcttcctgtattttttggcagtatgttgagcacaagggttaattgtataattaatttcagaaagttaatatagttaatctccaaagctctctgttagtatgagtgagaaatgagtaagggcgtaactactgttataggtgtttagatgtcataatcaaagtcagggacaacattctgtaatgatccagagtatgggagtgtgagggacacactatgagttggtggctcttcataaccactattaatcatagtatgtttttttttatgacccagcaatgcaaccaatgttctcattttatttttcttggtattcttagcacagggcctggcatatagtaggtggttattaaatacttgataactaaatgagtgatgctttttcttatgagagaaaataaatgtttttagaagagtcagctttataccatggtttcaggggatgaattgtgatgaaaagtgaagattgcttttgcttgaaagaggctgactatttcccagacccaggatcactttctgtggtgtatgatttaagggtgagcgagcatgccaaagcgctccacttgagctgagtgatggggaatgagttgtagagctgtggtcttagatggtattttgtgaaaaacagtgggagatttatggctattaaacaactttgtagctgcccccttcttgtttcgaagtctgccaaatctctcctcctgtggtctgtatcaggttctttcagtgcatccaggacattcagagatatccaccggactgtagtttttcattgaatgcacctattggaaaggggcttgaattttatgcatttatcagttttggtaatcaccgagtgaaattctcgctttgcacgtctgttgtagaatacactgtatgtgcattgaatcttttccaagcgggttgccaaagttctaccttccttctttccattatggatattgcagagtgcagtatattagtggctactgcctttattgatgtgagttttaaaaattattagtaactctttgatcgtgagcaggagaagaatcaagtaaccttcagaatgctttgatgtatcttcagcagaaggatttataaggccagaatgagtgtttcaagccttgcgggggaaggggatacatatttaccatcatctgcttttttctattctagagctcactctcagtagctctagaagaaacagaaatgggatatttcatcacaaaaagtcaatcagaggtggcattcatccatgttatacaagtactagagaattgttacaggaatttttctctcattgtgggttcatgtcaatataggagtgcatggattagaaaagaaatagggccttttggtgtttttaaaaaaatttcaggcttaagtctgagaaattccaaaatgtagaaaacttttaaaaataatgaacacatgtagagatcatccagaatttgtggtttctaatattttgacatttgttttaagtcttctttaaatgaaagaaagaacatcatatatacagctgaagttcctttctctccacatcacactagccccagtcctactacactgccccttggcagaagcaaacattttcatgaatttagtgtacattttaaaataatttttaggtgtttccctgcatacatgaaatcaacaaattttatatttccataaatattatattacatttatcattttgcaacttgcattttcactctgtattaaatttttagacctattcaaagcaagatatagaaatcaggtttttttctcttaaatactaaatattattctgtcttactgatatacaacattatttttatttattttcctcatcgacagacatttgagttaattccaatttcttctgttataaataatgctgcaataaacattgttttatgtctcaatttgcagacctgtgtgagattttccgtagagtatatattttaagtgaaattgctgcaccaattttcaattttattagagattgctaagttactctttaaagtagttgaacgaatgtacattcccaccagcaaggaatgagaagacaacagtttctttttcctttgttctcactagtacctgctattgtgagacttaaaagtttgtcagtatgatgagtggaaaaatcgtatcttgttttaatttgcattgcccttagtcctagtaaatttcagcaacttctcttatgtttattgactgttcaggttttctcatctttgaatttccagacatttcctttgtctatttttctattgatttaaagacattctttttttttttttaaatttggatactaataatttattgtagatgttgcaaatatttcctgacaggagaatttaaaaagtaaaatgtaaaactataattccttgccataggcatttagaaaatgtggcaagagccaggcgcggtggctcatgcctgtaatcccagcccttttggaggtcgaggcaggtggatcacctgaggccaggagttggagaccagcctgggcaacatggcaaaaccccatctctactaaaaatgcaaaaattagctggatatgatggcacgtgcctgtaatcccagctactcgggaggctgaggcatgagaattgcttgaaccagggaggcagcggttgcagtgagttgagatcgtgccactgtattccagcctgggcaagagagtgagattctgtctcaacaacaacaacaacacatttgccaaggattcaaagatttaagagtctttatagtcttgaagattcatatttactcaaatttgcttattctcattttaggcatatcttcttaacccaggtaaaagaaaacattatttaaattttctattactgcatactcaatatacgatgggtgtactgcctcagtttcaaggcaagttctttattctttggcagatacagtataaatttaagacattttcttgtccacttctttcctatgataattgtgtctttctgaattgtacatctaatcctaaggttcagagaaccagtgtgaacatcactgttgaaaggatcacaagggcttcattttgaaaaaagccaagtcaaagagctggtagttggatcattgatttgtagttgttttcctaaacatccagccatagaagtcccaccaaaaggcatagtttgcaaaatcattctttcctggattattttccatgatgtgagtttatcaatggacactgagcaggaaagtaattaagtgctggtcatagaatgatgactgcaaaacaacagaagccacaccattttttgctctacctacagtacgaaacaaaactaaatatctcttttacgcttggttacagaattctaatgtgtagcacagtcagagatgtttctgaaaaggtagcatttgttccagtaattgtagaaaaaagctgtcatcaaattgtcaacagcccaaattgagattaaaagttctaagaaatatcactacacaacaaactaaaactcatgttggatttttgggtcttttttttagcaatgagatggagcagaaatattgacagctatggcttcctatggaggaagtatgatagatctagggaggatgacccctgtaccctcaccccatatgtcctgcctcaagcattaaatagatgccctatttaggacactatcctcatgtttcattcatcaggtagaaattacaggagaccttgaatacccaatagagagacacttggtgactgtagtatttgatttttaataattttgggctctacattcttgcagtgtgctaaaaagtggaaaagtcttacctactttaaaacacgtttttcttggtggttaagcttttatttttgtggacccaatagccttggatccaaatttaaacaccatatatttgccttggagctggagtgaagaaatgctacctgaaaactgttttctacctagggacagagcttctgattttgctccactcacactcttcctgtaagtctccactgaaagccgcttagtcaaacgtctcaaatgtcagaaatgaaatttaaagggtttttctagcaagtaggtctaatctcctacttagttttgattcctataatataggtaatctctttggagaaaaggcctgcttttagaagggcaaatatatcccatagaatgtatttcccgctccggaaagaaaaatgtagcattaatgaaatttactttttcatgaagcttggaaagattgttagcttcggattttgatcctagcagatgttctttttgggatattaaaaaaaaaagctacatttgatttaggaatctcagttaagagttacagcggtaatgcttcttgctactagcagctacactgtgagtgtggcatactggccattggttctgagtgatagctgaccccaagctgaagtactttcttttggctttagctcacaaggatgttgggttctgaaaagagagccttagcagcctgggccatcttggacacagttctatggttaaagagttgtctgcgtacagtgaaaaagcatcatcctagatgtatgttatgttattttcttttaggccttggagtgacacatttgttgataaccactacatcccaaatccaaatttcagacgtatttctcactgctgttgttaaactgagccagaatccccagtacacagcacaagacaatttatatcctttcctatggtgacttcattctgccaagtctttcatgccactgggctcatggaagtcagccctggttttccccatttatcctgggggcagagcttaacctcttcactagtatccaaagaaatctgctcatagccagcctttactttgtgggaattactgggtgaaggcctgatagaaatctaagcctttaacttttcctgtcttctgcctctctctttttcctcctccctcctttcatttcagcacataaactgcccccttttcttagagctattccatatgtactgaggcccctcaaagctttggatcttacccaacacttaccagaatattatctcaacaaaaacagctcttgcttcctaagaagtatcttggtgaataatattttctccaagctcagatcccaaggagacaggtctggtaaatgagggtatttggtatttggtgtttggtgttgcttcatgttgactttgcttttgtcacacaggcttctagtgaggacgttgccagctccccggagcgccactacacgcccttgccttctgcttccagggaactcaccagtcaccaaggttggaactcagctttttattgctctcagtgggtgcagggagggacacttggctgtgcagagctctggctcattactgctgcctcggcactttagaaagaacacagtgctttttaagtccttgatgagaaaaccatacctgtcacacgtagtgattttaacccatattaaacagaatttagtagcagtctattcaggaggcaaataaatctacggtataatataattttgtgatttttttttctttaaataaagagattagagtacttaaaaattatcaaggagatgttaactccagtattagtgatggagagaaattgggaaactcactaacatttataaaagtatcgttgtttgagaatataacaattaacagctataatttcaaaatgaatgaactctatgttataactaaaaggaattccaatttgcctggcaacattgagagaagccatgtgcagtttttgctgaattctcttattttcaaaatattaatttggtttactcagtttttccaaagccttgcatgtctgttgccatctctagagtcttcagcttcaaaagcagacagaacactgacatgaaatatcatttgaaaatgtcttatccctaagttggctgttttaaatattgtttccccaagaaggaaattccacttgtacacgtaaaggtgaaagtgaacaggggctattctagcattgtcatcccagcagcattgcaggatgagcaggtggaagaacaggctgtggtgatgctcagaaagtagtgaatctgaccctccaagtcaccgtctgggctctgggcaaatgggatacttgtattctgcaggaaacgaagaagagagtagtgcaggatttccgatgtctgtggcttggacctgtgttgcctgtttggtgtttgggcatcaatagaacttttctacatttaaatatactttagttaattttgtgaaaaatcaattttgctcaaagtcagggagaataagcagctgccaacctgctatgttttgaggggcatgaacaggtctctttcactgaatgtccttttgaaggtcttaagcatacatccctttcgagactgtttttgggggaatttccctaaaataacaccacatctagatggagcaacaaattaacccttaaattagcctcatatcctcatgtgtttatttattggtttcttgtatttgaataagggtatttttactttagagtcattgaataagttgcatagaaactgaagtctcagaaacctcacagccacttgtaaagtttatctggccctgaaattgagatttcactatggagagatatgatcagatagatgataatcattaggaatagggcaaatatcatctgtcatttttaacagtaatataaaaaatctgagacttgaagaaaggaaatataacacaatatagttttaaaatatttggagtaatatttggaatatggaaaaatgcctaaagtagttagagttcaaataagtgctcttggatgacatcagggcttaacatcaatgagagaaatgtaaagacgttatttaaagagagccaacacagacatctcaattttactgaagaaaatccctacacatttaacatgttggttgcctgaccagtgctgacttggttgttgataaaagcaagtccatatcataaaatgacgttctttgggctgatggccataaggagaccaatagagagaagaccgaagaagttcattaaagctggattattgaactgatctatgtaggagaaaggtgagactaatatatttcagcttagcataaaccaatttggcttgaaccaacttggctttccccaagtgagaaagccattattttttggcactaaaatgaaaccacttaatactatctcatttttttagtatttaaaagaattatttcaagtttctgatcatgtacatcacgaaaacatttgaatgtcatttgttaataccttcatgcaaacagcttacaaacatttatgcagaaggggacatttcatggtgtgaggacaaattacatcaattctttctcaagtgaaattctccatgatgtctgaaacttttgtctatacaatcctcagtggaagttctatttgcaaataattttttattcatcgagttcccaatctcttttccttccacaccaacaactacaaaaactggcgggcagtagttcatgtgcaaattgctatttttctgtacatgccattttccctttacttgtccttttatgtaacttccaatgtcaactatgataggtccaagattcatgtcctaaaaactgtagattcaaatgcaaaggaagtccgggcttagaataatgatcaggagacctgggactcaatttttccatctgttgcttgtagataatccatatatcacagggatagtaacatgtcgtattttgcttcctgcatgaaacttttactgatctgagttatgttgattttcttctttctataggtatgtctgatatttgtttctatcttctaggtgcaattgttcatattctactttgtatgatagaggtcaggttatgtgtatcttaaactcctcataaatgaaaactccctgagaggcagcagtaagtccaaatcatctttttttttttttttttgagatggagcctcaccctgtcacccaggctggagtgcaatggcacaatcttagctcactgcaacctccgcctcctgggttcaagcgattctcctgcctcagcctcctgagtagctgggattacaggtgtgtgccaccatgcctggctaattttttgtatctttagtagagacagggtttcaccatgttgaccaggctggtctcgaactcctgaccttgtgattcacctgcctcggcctcccaaagtgctgggactacaggtgtgagccaccacgcccagcctcatcttctctttgacatcagtgacactgcccattcttcaggtatcagcttacatatcacagctccaaaggaaacttgcctgataccccctacacacttatattaggccagtgttccctgttcagggattatcttcctagaaaggccataagctgttgggaagagtggttgtgattacatatgttcaccactttatctgcaatgcctggcacagggcctcctacctaaatggcgctccacatatatttgttcagtaaaggctgagtaataggaacccaggggaagggtgagtatcttagtcacctctgcgaggtaacttgattgcatgtgagaaaggagaccctgcttcctttgggggtgaacacactaaagggaaaggtccagctgtgtggacctcagacctcaattctgttgctttcataaacccaaaccatcagggatgggtgtcatatgtgttcattcattaccagaaagcatttagtcacaaagcctaacttctagatagttgattattttaatgttgtagttttcaagcattggcggtttgacggtagggaagggaataggatgaattgaagtaactgatggaattattttactagaacagaaactctcaaggaaggggtcagactctcagtaagatacagattgtggtacacacatggatttagaatggtccacctgaattctttctgagaatgctgccctgggttggagcatatctttggaatgaggaggacatgggaatgtgtcagtaatctcagttgttccctcgtggcaatctacatattgtatccttggctgtgtccatgttatgaggagcgctaaaatatctgttggagaaatgtccctttaaatatattacgagtacaggacatgccccagcgtgccaggtattgccgttctttatctggtagctcttagaagtagaattcacatttgtacagggcattatgtcttttggggaaaacatttctatttagaatgtaaactatatcatcctcagggtaaccctgtaaagtgaggagtgcaaatatttttcccatttaacagagggagacatcaagaattgctggggatgatggagcaactcaacaacaggcaagggaaacaaaatcaaagccctgtgcccttaattctcaggtccccctgacctttgtcctttacccagtgcgtatgaagcaagtgtaggtaggactaactgtggccttgagctggaaggaagagtcaaaaaagtagagggagaggcatggcctggaaatgttcaccactgccatgcgtttccaaagcctgtgctaaggctgctaggagctacagcatcccacttgcctgcctctgtcaaaagaattgcattactcctgccctgccattctgtatttttaaattacagaacaataaaatcaggagtggagaaaatttgaaaacaaaaagggtgaatgctccatgtcagtctggattcagacagggaaaatagaaggcactgtatgtattccagtaatgaagagttttaatggaaggaattagaggtgctgccaccacccagagtcacaacctcagcactgaaccagtgattctcaggagcttgctggaaagtttctgtggatcacaggaacatctgggtgtctcccactgactttctctatctgaagcaccagtgaggggattctcacgttcacctggagactgtttcagtcattgctgttatccatgcgttgccctgctcctccatctctctagatttccaaatcatactccagcatctctctttggcccaactctaacctaggctgattcactgaaggcgattctccgatgtagttttcagttctccctcgaagctacagagaaaaccttagaagaaagcagatggtggtaatggtaaaacagataatccagcacatctaccataaccctgccttgccaatagctatcatgtggaggatctcatttcaacttgtctgcacgcacattttgcaagataattgcaagcctagtgaatgtccctgaattatttatttcctgatgcttatactatagtcttgaagatatgccatagttagcttgccatattaaacattgaacttgaaatgtgtaaaagaaagaaagcaaaaagaaaaaaaatgaagaggaaatttgctgtgaaacttgcttagagatgataacctttctactttgactattgttggcaatcttgccattatttttattgacacagttgttaggtactcatcttcctctccaaccaggggcttggtctatttgtgtttgaaattgattgctgggactgtcacaaagtaatttatatagcaacttattataattagttatcatttgcagtttcctaaatgtgagttgcattttatgcttagcaattgatttttctgtatatctccatgaagcagctcaatgtatgccatccaaaaaagaagaaaaagaccgaaagaaaaactgtgtttttttaaattatttaaaacatttttagcctgagatatcataaaatacgtttccacagaagacataaatacagagtgttttgcttcaactcattaaatcgccaaagtgaaagtgaataaaaggaaatttaaatgtctgtatgtgaagaggtagcaatgtagacaaaaatgtttgggatggggagatgttggccagaaaaacttcatgccaacaagcataatgctttcaggagggctcaaaaggaagttacttgatgactaaactattgctcacaatttgttttgggcttataggattcggaggtgcaggggcagaatgatgcgatacttttcctcatctattataagggtcacagcccataacaaaagacaggttaacaagagaagaggataagaaatttacttaatcaaagttttctgagatgggggggcctttagaaatgaaagggaaaactagttttatgcttatgttgatgaagaatggacagctgtgtagaaacatggttagacaaagggtatgatctaatgggaatagattgaggggaaacctagcaaggcctgtctgttcagattcttcttggcctctctatgtagcattccttcccctggttataggacagaaccctctgaaatgagagtcttcaaaggagaagagagagtgtgaattttctaggttttatggctggctttaagggataggattctagtttcgatgaccccacttagggaagaggaattctggtttctataactcactgcagggcagagacagagggatgagggagcaggtaagagaaggccagagagaccttgcttctgaggcccttccagtgtcttttgtttcaaagcactcagcacgtcaaggtgccacaatttcgggtattgtgttttgagccctgtcagaggcagtatgtctcttttagccaacttttagtttttcatttttagatttctactatcttttcatgtcagccacagggaatgtgaaagctaagtaggtctgatcattataaacaaaatctacagaaaacaatagcaaagactcaggaaaatagatgcatttatttaggccagcttaatagcttagcatcaaggaatcttttgcctactgcctcttggttatcactgaccatttataaacatgaggccaggtgccgtggctcacgcctgtaatcccagcactttgggaggctgatgcaggtggatcacttgaggtcaggagttcgagaccagcctggccaacatgatgaaaccccatctctactaacaatacaaaaattagttgggtgcagtggcaggcacctgtaatcctagctacttgggaggcagagacaggagaattgcttgaacccaggaggcgaaggttgcagtgagtggagatcgtgccactgcactccagcctgggcgaccaagtgagagtccgtctcaaacaaaacaagcaaactaacaaaaagatgggatgaacaacctgatggttctggagcctttgccacataggtctcacctaaggtcaggccctatgagtgagacagcctgcttatatattgccttctgccttccagaatatttttattagtctttcaagagagctaagcatcaaataatttctcaaaaaattgtcaatgactcattgaaagttcatagaagcacaacagatccaaatttctcctgtggataatgtattgaaaagtggcaaaaggaaagagagagaaaagaaaaaagaaaaaaacctccttagagacaagaatatgtttttgtccaggggtcctgtcaaataagagtatggccttggcttgtatcttttagacttcttgccaccactgtgccttgactgtgtgggggaagagtgtgttggttcctcgtgcagaactattattagcatttgctaattatgtaaaatgatttcctctgatgacattttcaacagaacccattactttagttttctttccttcataatgcttttatgggcttataatcttggtggaattctcagatgctgagagatgctaaagtttcctttatttaatcgaggtgactagtgatttgacagtagtggttgacaggtttattttatctgcgtggcagtaggagtctattttcagtgtgtgcactctgttccaaagtaaaaggactttactaagtgctgaataaattgtactttcctttgattctagaccttgctgaaatggtttaaaaactccggtctgggtcatcaaattcatctccttgctactttgcagggtcaatagcttcactctgtacagagccgggctgggtggattggaatggagggtagtgtagattaaaacttccgcatatatatagatagatgtgcatgtgtgcactcgctgtctgcgagggtggcagtgatggaagagcaagccaagtggaattgaagatggatgaatctgttagactattaccaagactggcatggagtttagccaggaactttaagcaacctcctttaaacatttgaaatccataggggtccatttcctctccttttcctccaaggatgatttttcatttgcagtctctgagattgctttatttctattctttgggcagaattgtggtatacttgtagacagagaagggctacgaatctggtttttctctcccagagcaaagcaaggaggaaaaaatggatttcagttttcccctgcccctcaaatagtagcaaaccctacttctgtaaaatgagaggtcagaatgacaactcttcccccaacagacagtcccaataaaaaatgatagtaaaaacatgctccctttatcttaacaaaatggaagcctagaatgtacagggtggaaggttctaaatgtgcttatgttttagagtcctgggctgtttcttgcccctttttataaagaaaaaagtatgatatggtcagtaagacaaagattgctatgagcacagtcattcaagaatctccccaacatgtcttcatttagtacctattgtgtactgagtgtattgttaggatttgtggagaattcagaaatagagaatattatctctatcttctaggaatttatggtttgattgaggagatcccaaaaatgaagtaataccaaccaaacaatatattatatattacataaataagagctctattagttggtaaaagctgcaaatgctctcaacgtttagaaaagatagcgtgcaatgtaggtgagactactcaggcatgactctttggaggatgttggcactgagctttgaagaacatgttaagtggagagcaaaagaagggcattccagaaagataaatgggtaaagataaagcacaaggacaagaacaggtagaactgatgagagaaagggaccctgttttgaaaaggtcagaaataaggttccttatgtaggataggtccacattatggcaggccttggacagacagaagggtttatattttatttaaaaccatgctgtaggattattaatctgcaagcagtatccaggggtaattggaaaggagagagcctggattcaaggaggccatggtgggatgggattggaaggaaattgtttcagtcttagaagccttagatttccagataaccaggttctgtgcccatagactgtgatgcctccaaagagcaggtttctagcaaaggtaatttagaaaacaacttggtaacagatggggaagacagctggggcctggatagatactgccaggagagcaggagtgggggccatgcacagggaaccttatggccactatggagttgttgtatgaggttgctgatggtttggtcacgagggctcaggcatcagagaaactggacagtcagtgtttttcctccgcatgttattcagaatatttctgatgttggcttttgaaactaaaacacagggcccaggataatgttacaataatccagcattcgatgatcaaggcctggagtggctggctggctgactgggagtacaaaaaataaaggaaggaatatgagaaacattctgttgcaaacacaatagaccgaatactgattatatttcagggtagagagaaacagaggaccagaaagctataaggaagccagcatggtgtgtgggaggctgtggtctctgcctgttgcccctctgtcggttcatcctcatcacaggattctctcccaccattcatgcatgaactctaatctggcctgttaaatggaagaccggtggagttaatgtagtggagctgtggcagcaggaacaaacgtacaaaaagcaggcagagcagccacaaacatttgttctcattctagcctttggcttaaagatgagcttcattctcttaagaactaataaatgtccagggtgttttatttctgaatcttgggctcctggaaggagagtgatttgaagccaatgcttttggtctaaattgttcagccgtgagctcggcccagtattaacttcctagtcccagttcttctgactctttttatttccctgtctcttgtagaaaactttacccctgccccaggtttttcctcatgtagtgattttacaaccttttttggaacaaataaacaaacatctggaatcatgtggcacatttaattaaaaagtttgcatttggccagaaatggtaaaatcatgaaaaatggcctgtcggtgagctcaagaaggccaaatgatgacgttgttggctgcaaacggactgaaattgagggaagtgaacacctgctcagctcggcctgccgtcctccagcttcctcctccagccattaatatttacagcagtttctttatccattctaatgaaattttttggttggggctggtctggggagagggctgttacttttccaataaccttggatttgttgtgatgtgtgtactttataaagggtgtggtattgggctttttgggcttttcatttcccttgctcagaattccatatgcttcaggtcactgcaggggcctgttgctgtttcttcaatcagtcactcaaccatggttttcatgagagccgtaacatgtggaaccctgcaccagggcatgtaggagatgaaaaagaagctgtgggctctgccttcaggaatcctacagtctaattggagacaaggtcctatgcagagaaagcagaggccaagctagatggaagagtgcagagaagggagggatctgtgatgatagaaagattgggaggtggccttggatgaaggtgagaactgagttgaaagaactttccctgcgtgagttccaagtgtgaaaggatttaggaagagatcaagttgtggattcttgtctagtttctggtcataatctaggtgaaagtagggggtggatcatttaaagcaagaattagatatgattattctacatttccagttagcttctcctttgcaagacatagctagggtgaagtaaaatttaagttttgtttgcaaattaggataaaacattaagatgatctggctttgcagagtgtagtgctctcatatgtctcccacatgaggatttataccgaggatgagattattcttaggacaaagtgagaagtttttcttgttgcacagaatacaagggaagtagccaggtgctgcaaatatagtaagcactgtttaggttagatccaaaggaagtatgaacccataggtatctgagacatgtctcacaataaatttagaaagtttattttgcaaagacttaaggatgcgcctgtgacacagcctcaggaggtcctaatgacatgtgcccaaggtggtctgggtatggcatggttttatacattttaggaagacatgagacatcaatcaaatacatgtaagatatacattggtttggtccagaaaggcagataactttaagtggggggagcttccaggttataggtagatttaaaatttttctgattggcaattggttgaaagagttgtcaatagaaaggaacagctgggtgatataagaggttgtagaaaccaaggcattatcatgcagatgaagcctacaggtagcaggcttcagagagaatagattgtaaatatttcttatcagacttaaggtctatgttgatgttaaatgctggttggcttttcctgaattccaacagggaggagggcataatgaggcatgtccaacccacccccgactttccatcatagcctgaatcagtttttcaggttaactttggagtgccctggccaacaggagggagtctattaagatagttgagggaggcttagaattttatttttggtttacagaaggatgagtattgttttgaactagggtgtggattggcaagggagatagagaaatcaccattccccaaggccttttactgaaggacatgctcatctctctttgaggtagcctgaaggaagtgaaatgaaacttaaacaattttcaaatcctgactggatgtaatcctgggttctctatgtcagtgctggttcagctttttcataaaatgaaatcagggtttcaccttgaccctcctggacttgtgcaagcacagggagatacaggatcatgctggacggagcataacttcagttgccagaggagttcttagtcctcagctctttattattcttgtgcatctgtttccttaaatactctctgcagaagcattagcatgaaaataaaagagtacagcaacttggaattttccatttgtagcttccttagtctgtggggtcaaagttctgtcctcagggatgctaatgcaaactctgtgtgctgttccagggcaaatgtttctcaactaaatgacaagagggggtggggagccagggaaataatgcagtgctaattcccaaacacagactgcccagaggtcccaatttaaattgctgcttccccaactctattcccaccctcccccaaaggaaaaaaaaatatcctgtgttgttaggacagacatctgtgtgagagcaataaaacagtcttctcccttgtggattagctctttattcctttatttatcttgctatacctcatcagtttatcctaaatcaaggagagtcaaagaggataagatgcagtcccttttttgtttttgattaaggaaacccatacaaccatcctcctacacaaatttcttttctcaagagatagctttccttgttatgtctaatttctccccacccccctttttttaatctgcctccttggaaactctctggaacttttatttcatataatgttcaaatcagaaaatgaaactcctccagagacaggttagatagggcagtgaatgttggcatgtctgcatgattctaaagtacaaggggaactaggatagcagacttaacatattccatagcctccatttcttcttccaaatccctggaagtttattaattcattcaagagatatctatagagcatgttctatgtgtcaagccctgttcaaaacattagagatagagctgtgcataaagtgggcaaacatttctgccttcaaagagcttatgttctagtcagagagaggatctataactaagataaaaataaaaccaccacatggtatatcggtactaagatgaaaacgacagcagatcaagggcatgagagagtatgtgttggcaatttaagatctgacagccagagaagtcaccactgagaagatgatggtggagtaaagacctggggaggtgaggcatggaaccctgagaatgtctgagagaaaagtggtccaggctgaggaaggagcaagtgcaaggccctgaggtgggagcgtgctcctggcatacatgaagcacaaccaagaggtcagtgtggctggagttagtaatctagggggagagtggtagatgaagccagaacaataccaggggctagaacttgtagcccattgttaaatgttaaacccaggagcattaaaattttaaagaatttatttgagcagatggtgattcatgaatcaggcagcactagattgcacgtggttcagggctccaccaagagggtgtgagggaatattttttataaggtgtttgtggaagccaagacaaagaaattatttgattggttaaagtggaaagtcccagttagaagttagttagtggtttcttgttggttaagcttaagtttcattttactgcttacattgacttgggttttggtttgcttatgtaggaatccaaagtgctggaaccatctcagcctaatggcttcctgatagattattttaacactgtttactgtgactaagacaggaagctatttcaaggcagaagaaataatagaaatgctgttacccttctccttatagaaaaaaaaaaaaacaattcccaaatgaataactaactggaaaagaaagaaagggtactgcttttgatcagaaactatagatttcctgcaagatcacagcccaaaacaaatgcaacagagtttcaaaatgcagaaccaagacccagcagggtggcatatacctacaagctcagatatacctgacgtaggaggactgcttgaatccaggagtttgagactgtagtgttgagtgattgagcctgtgaatagccattgtattccagccggggcagcatagtgagacacagtctcataaataaataaataaataaataaataaataaataataaataaatggatgtagaactagcttcaggagttctctaagcacagagaaagctactgggggcctcatagcaggcaataatttgggcttcctcagtgggtacagccacatgggtcacattgtctgtatacttctctccatccttagtttaggcatcaagtaacagagctatctctaagccagggcagtaagtatgagtgattggatcagaaaaataagatggcaagagttggtacaaatgtattaagtcataataaatgagaatgaactagactaaaagacagagcactaccagatttggttaaaaaaaaatgtaaaataaaatactttttcaagaggtgcatgtaataaaatgacatagaaaacttgaaaatactggaattaaaggacagaaatactggatacctgctaacacaaaatccaggaagagcaatgttaatattagacaaaataagactcaagatgattactgaaatgacaaagagggttattttgtataactatgaagatataatgggaatctaaaacaatcatgaatcttaatgtacccaatgacatggctttgaaattcataaagcagaaacttctagaaataccagaaaaaactaacaaagtcaccatcatgaagactttagcacatctcctatgaaaatgacagctaaatgaatggactttttacaataccttccttttgttacatggaaaataaggtgatattctttaaaaacctgtatgaaacagtcacaaattggctcatatccacaaactggctcataaagaaaagtgtaacatgcttctttcaaattaactgaccataactaagtcaaattagaaattatattaaaaaaggaagacttccttccccctccttccaaaaaaaaaaaaaaaagtaaaagaggtaagaaaaagaactatagactacagaattagaaataaatgaagttttgggtttatgaggaaatagtatacagtatactttaagagtaaatggaagtgataacactgtagtatattaaaaactgtgggatataccaaaagtctaattaaaggatttttcctccttagaaacataaactgtaaaacaaggaatagaagataaaaatatatgaactatgttttcatatatcctaattaaaaaaccaagcaaacctaatgacacatggaaggacttaataaaataaaaacaatgtacaatatactttatcaacaataccaacagatatttaagaaaaaggtgagcctagcagatcaaagtaagaaaaaatagagattgacatttaacattaggaataatgagacaaaaaaaaccccacaaagctattgagcttcatattgataaatctgaaaatctaagtaaaacaagtaattttaaggcaattatagttaccagtgctgtctcaagaagaaatataagtctaaacagagaaaaaaataagatgataaaagaaactttaaaaataaccatatagccctcaaagagaagtagcatctcatcttttataatttattccagaaaataaaaaatatggaaaattactctttttctcttactaggaatccataactgaccctaagcaatgtgagaaaacatgaaaatgaaactctaggtcagtctctttttcaaatatgaataaaggaatcctccatgagaaattaacaataagacttagtaatgcatttaaaaaatagtacttcctgaccaagtagggtttatctcaatattgaaaggttagtttacttttagaatttatcagtaaatgtgtcatattggcatattaaaaaagaaaatgggattatatataaggatgatgttactagttataaaaagagagggaggccaggcatggtggctcacgcctgtaaccccaacactttcggaggccaagcagggtggattgtttgagctcaggagtttgagatcggcctggccaatatggcaaaaccttgtctctactaaaaatacaaaaaatagctgggcatggtgatgcatgcctgtagtcccagctacttgggaggctgaggcatgaggctctctggagcccaggaggcggaggttgcagtgagccaagatcgtgtcactgcactccagactaggtgacagagtgagaacctgtatcaaaaaaaaaaaaaaaaaaaaaagagagagagagggagaaacctatgaaatttaacaaccatttctgctaaaatctctcagtaaacacagaatagataggaacttccctaacttgataaagtgtatctaccagaaacctatagcaacctgcatatgaaagagggatttaaaaaatttccatcaaagtctcagaacaagcagagaaggactattctacattcccttggatgtgctagccaaagcaatgagatatacaacaacaacacagagcgcaataaagattggggtaaattcagcattatttgcagtcaatattatgacttagaccaggagtaggcaaactttttctgttaaggagcagataataagtattttagggattgtaggccagaagacatctgtgacaattactcagttttgccctaataacataacagaactaagatccattatatctgtagtaaaatatataaatatgcttaattcatgtattttaaagattttcagagtgaattataaggcaaaacctaatgctctgtgttgtggaagagaaacagaaacaaactgactcaggaaagttaaaataaaaggatggacaaatgtgaataaaaagaaagcaggtgttgtagtcgttatagtgttttacaaggtagaattcaagcagaacagtaaatgaggcaaagaaagatgcctggtactgaaggttgaaattcatattagaaataactattacgaatagctatatagcaaaataaagtgccaatattcatgatggaaaaatcataggctatgaaaggagaaattgaaaaatatactagtcttaggggattctccttcacctgtctcatttactgacagattaagtggggaaaaaataaggatatgaaagacaaaaatagcaaaattattaaggtagatttgattaaaacatatcaaactctgtaccctaacaatataggatatgcttcttttcaagtcaacataaacactcattgttattccagttagtacggctgtgtaacaaattaccctcaaatttaattctatgaaagaatgacttattatattcagattctgtgggtcaggtatttcaagaaaggatagtaggaatggcttatctctgtaatgcctggggcctcaataaaagacttgaagcctgggagctagaattatcagaagattcatatgttcatgtttggttgttgatgctggctgttggctaagggcccccctttccctgcatgtgggcctctccatgtggtttccttttgttggctcatttgggcttttcatagcctagtagcagagttctaagggtgagagtcccaagagacaggaagacccaggcagaaataatagaatcttttatgacctcagaagtcatacagcattactttggccatattctgttcattacggtagttacaaaagtcctgctgctcatgttcaagggaagggcaaatagactctgcctgttcatggggagtggcaaaattctggaagagcatgtgggaccagaagtattgctctgactgattttggcaaatacagtattccccggtaatatactgactggatcacaaacaaaatttcaataaatttcagtagatagaggtagtacaataacactgagatcataatataataaaaccagaaataacaaaattagattgcaaaaaagccctctacccagaaattttctagtactcttacatttcaagtcagagataacatatatggttaagaattcctgggggattaaaaacaaacaaaaaaaagataacatataagcctaaactgtagaatagctagagaagtatattaatgaaaccattacctatgagaatgtatagatagatttaagataattattagaggaaaatagatagcttgaagtacatatattaacttgaaaaaataagcaaaaattgtaaaagatatattaagcatctgactcaaaaacaatatcagcctcataaatcaaaggaaagtggaagggaggaagttttaaagttaaaaataaatattaataagatagaatacaaaaagtataatagaccaaaagttaatttttttgaaaaactaaattattaactatcccaatcaaggaaaaataaagaaaatgcaaatatacaaaataaaaaaataaaaagccatagaaacaagagaaaactaaaataatcctaagaagaaactgtgtttaattctgtgcaaatatctgaaaatctacatcaagtggataattttgtaggaaaatataatttcccaaagctgaccccagaagagatagaagattgaaacagtttgatttccacaggcaaaataaagttcataaagacctatcacttctcccacaaaaacaccaagtccaggtggttttacaaggaaattttaccaaacattagaagagtagatacttatagtattctgctaaatgtttaacaaccgggtctgggggctggagcagggagtaaaaaaaaccctgatctgtactgtttgctgatttctaagcataaatatttctgtcataatttatttcaagctacctgtgtgacatcacttaaagtgaagatgagaagagatgtgcagataggctgttgtgagtcagtacaagctggcttttgcataacatggagctgatcccaatgctatttaaactgttgcagggtatggaagtactactttactcttacagaagtatatttacagagtgaagaagtacttccaaatttcttttgtgaagtacataaggcctttacagaaacactgataagggctttatagaaacactgataaggattacagagaaaataactgcatactcactccaatgttaactataggtgcaaaaatgctaattgaaagaattacaaacagaatctagcagcataaaagcagagtaaaacatcatgtccaagtaacatttattccaagtattcaatgaaatttcaatattaggatactcatttatttactttttttagtagatctgatgatgaaacccataattatatggatgccaaaaaggctttggccaaaaattttatagccattcttgataaaaagcattcaaaaatagatgtgtacttccttaatatgaaaaaacacatccatctcagtccaaaagccaacatcaaacttagaggcgttcctgtgaaagtaaggacaaaacaagatatctgttactacctattatttaatgttttactagaaatactaaccaaagcaattagatatgagaagagattacaggcatcaaagtggaaagcctattataaaagtttcatgtttacaggtgattttttttttttttttttttgtgagatggaatcttgctctgttgcctgggctggagtgcagtggtatgatcttggctcacctcaacctcagcctcccaggttcaagaaattcccctgcctcagtctcctgagtagctgggattacagacccgtgccaccacgcctggctaattttttttggtatttttagtagagatgaggtttcaccatgttggccaagctggtcttgaactcctgacctcaggcaatccaccctcctcagcctcccaaagtgctgggattatagatgtgagccactgcacctggccaggtgatttttgcacttggaatttaagggaaacaactaaaaatctaaaaaaataattcagtgagaaagtaaaatatacagtgaatatgcaaaatctttagactttttatattgaaatgaaagcctgttagtattttgaatgaaaaacttcatttacaaaagcaacataaaagataataaattgggaatattataatcaaacattaacaaaaatatacaatatctccaagaaaaaaaacccacaaaaaccttctagaagggtgtgcacaagaattcttgacattaagaacagacattcgtattatttttaaggaaaactcaagatcataaatatgtcatttacctctttgtaaatttataaattcattatgaaatcatgtaacaaagctttttttcttccgttttaaactagaaaaactgaatctaaaggtcatgtggaaaatatgcaaagataatagctgggattatttttaaaaagaattataatgagggaaaatcagccctattggatatcaaatatattatggaatgttaataattaaaacaatgtggtactggcacaggactccccagaataatggaatagaataggtagtctagaactagactcagttacatgtagaaatttgtatatggtaaagtagtatcttaaataggtagggaaaagatgggccattcagtataagtttgggggacatataataggtatttggaaaaaaatttagatacataccttacaccttacagcaggatacgttgcaaatggattaaaattttaagtgaaaaaaaaaaagaaatcatacaagtactgaaaaaaaagcataagataactcataattcagaaacccagatataaaaagcaaaaatggacaaatttgactttattagaaatactcttgattttatttaaaaaaaaccttttacacaggaacacaaaaccttttttttttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgctaccacgcccggctaattttttgtatttttttttttagtagagacggggtttcaccttgttagccaggatggtctcgatctcctgacctcgtgatccgcccgcctcggcctcccaaagtgctgggattacaggcgtgagccaccgcgcccggcccacaaaaccttttaagcaaagtcaaaaatgaatattgaacttaaaaaattatttggcaattgtattacagaccatgataaatttagatatatatttattttatatatatttataaatttatatatataaataaaagggaataaaacaaggtgtagaatagtatgtatattatactgctacttatgcataaaaggtgggacaataagaatctatatttatgaaaaaactctgaaagatgcatgataatagtgacaatttatggatgggaaacctaggcatggaaaaagagtatggtggggaaaagacttaaccttacacgtgcatttactttaaagctttggaccatgttcaagaataaacaaattgaattttcaaagagcaaaataaaattcatactgccaataacctaacaattacacatggctaaagggaaatacacagaatgatattcattgaagcatttttctagtagtaaaatacatacaaaaattatatgtctgtcaggaaagaaatgattaaaatatggtaaatttgtaatattgaaggctatgcagcacttaaaaaaggttaaggtaagcaaaatactaatataacagaaagatctccaagacatatttttgagcaaaaacatgtttgagtgcaaaagatttgtatggtgttggcagaacttatttatttaagagtacagtgctatacacctttttgtgtttaaaagcacaaaagtatacacacatgcagacacacacagaaatctataaataattggaaatagttttgaaagtgtagacacaaaactcctaacaatagttacttctacgagaggactttgtttggagtggaagagagtggaagagggtgaaaaaggacttcagatttttcagtattggagtttttattaaaatatgctaatattttactcatgcaataataataataaaaagtctcaaagaaggtgataactttgggtgatttataactgttttggagactttgcaaatttgtttccccaaggccaagtgataaattgtttctgtgaaaacatcccttttcttcttcagatttaaatattccagtgttgagaatccacagtaaacttgctgtactctgtcactgttgaggaatgggacattcacatgaatcaaatatgctggtaaataaagaaatatggagaaaaatatagaggtacgtgcatatattgtatggcttataatctactgagaatggagaggaagacatcagcattaaaaatattctttattgagtgaattctttagatccaggcactgtactggaatctttacatatgtttgtgatctcatttaatccgggaaacatctcataaagttggatattatccccattttatatatgaggaaattgaagcttagaaagatatttccttgtttacccaaggtcccagtgctaataagtgtcctccatgagacgcaaaaccaggtttctctaacacctgaagcctgtgttctttcctctgttccattctgccccctccccaatacaatacacaacaatacaactacactgaatacattttaatgtttcttgatgattaggagagcacttctggcttttttgaatgttttggaatccctttatgagcgtcaattatcagaatactagtgaagcatggaaataatgtctaattggagatatctggttaaaagaaagcagagtaatactgcatcgacagaatttagtgcttttattacagatagataaaggtatggcaaaatcactggtgtgattcttgcatatcccctttattaattgatctgcatgttctgaaggccgttattccctatatactgattccaaatgttctgtctttattagtccttttatataaaaccttgtatctctatttgtcatcctaaaaatattgcttaaatacatgatgcagcttctctccacattggaatctgataacgaaaggtcttatctctgtagcctgaattaacatgagcagaatttaggtatactacgccaatagcttcatggacagtccctttggttatagattataaatgccatttagagaaagcacaggatggctcctgagtgtctagtaaacttcaacaaccacctgagagatacctccgtgtgactgcatgaaatggaaataaagaatggcaaataacccattgactatgcactttctcacccgctgagagcaaaacataatccgatgcaattttagtacttacatgcctctggggaaaatagacccctaaaaatcaccgagtgcagcactggaaaaattccttaaatttgtgctatgcttggtgttataaaacccaaggaaccttagatgttcttcttgagtaaaatggactggtaattttgttttgttatattatccaccaagcataatgataatgggtcacatgcaatttaagaaaaaattaagtctaataagaaaaatctctaataaatactaacagcatcttattggtatcatcattggtttaacccttctattaacatttgtttttttacatattaaatgatctgtaatatgttgaaaatgaagaggatagtaaaaattaaaacaggcattctaataatatatgcattgtacaaatgtttgcatgcttcttccctcaggcgagtactaggaggtgtggtacatgcatgggagtggtgctaggatagagcaggagattttgattttagatatgctgagcagtgaagatgctcagtgcaggggatagaccccatcattaaccaggaatgcaaccaattcaatgaaaaacagagattagaaatcaaaatgtagccccgaggaaagtacacagttatcccctcaaatcaggcttcttctgggccactgagaaagggtgaacgatcttagggaacctctggtacccaagcaaagggcctgggggctcctgtgcattgatagctatccatcacgggcaatgtggtagagtggggtagagctagaaggatgtattcaggaagctgccattattagaaatgtgcttctcaagcctacataagaatctcctagggaacaaccataaagtaaaagtgcttaagcacgtatttccaaggattctaattcaagggaactgggtaacaccctggcatctactgtttttaatgagttgttctggtaacacctctgcatgtaaacatgtgaagacgattgcattaaatgatattgacaaggagtctctttcccctagtcctttccaccatgtggtttaggagaatagcaactatttccaaaccctactgaatagtggcagccacaaatgtcttgccatgtcaggctctcaatggtttctgagaaagattgaacagccttcaggaggctaatctatgattaggtatttgctatgcaagacactgtacatgtgtagaaatggcaaaggtccctgcctcaaggaacttacagtttaggaggacctagcagacagaaactcagacaaataaatgcagcaaactgtgacatttgctgtgaaaagccatttgtattggataatggggacaaatggggtttggtcattagctgaagggttgcctaggtcagcataaggcttgcacaaaggagtggcagatgaggacatcacaggagccgtgttgaggaggtcaaatacttgggtagtagccacatgttggttgtaaatgtgtgtaggagggaagagcatgaaataactcccaggtttttctggcatgagtgtctttgtggcaggtgaagccattgtgaggatcagcatttggaagaactggatttgaagagaatgttgaatatgaagtattcatagtctgtaaatggagatgttctaatttgtgggtcagcaaacttttatcacaaatggccacatagtaggcattttaggcattgcaggtcagtctttgccatgaccactcaactctagcattctagtgtgcaggtagtcataggcaatatggaagccaatggggttggctgtgttccaataagactatttagaaaaacaggcagtgggccagatttggcccatgggagctagcttgccactcctgctatatgtataggtatgatctgaagataaaaatataaatgtagctatgttgactcacatacatacatatatatattatatatatttacctagtatctttctatgtagacttataatcatacctatttgatataaacgctgcacttcctggttatttgggataaacagttttttcaaactatccaaaagtcacctaataattgtctataaagaaacaattaaatatgaaaatataaattaaaacaacaaaatacattttgtactcagtggttcagcaaaatttaaaaatctggtgataccaagtgttaccaaggttgtagagcaacaaaaactgaaaagctatttcaatgggagttgtgaattaatgtatctctattggaaaacaattgattattttctagtgaatttgaatatatatgccaatcctaagttccagaaatctcactcctgggactctaccacaggaaaaactattatacatgctcagatcaatatgaactatactcatagcataacaaaacaaaaaaacagaagccggaaacaacccaaaatgattcattaaataaagtgaaataacattcaatatggacaaatctaaaaatcaaaagaaaaagaaaccgactgaatgataccatataatatcctttatataaagcttgaaagtgccaaacaaaacactgttgtaaaagggtccttacatttttggcaaaactaggatgaaaaccatgaaaatgaaaaactcaaaatgcaggtaggtggaggcaaaaaacaaaaaaaaaaataaataaattctgacctgataggaacgaccaatgggatttatttatttctaagcttggtaatgggtagacagatatttttaaaatgatagctcttattattttacatatgttatatttgttccttaacatcaagcaagtcttgcatgataatgaaaaggcaaaaccaaaatcttattaagttatcaattttatattttcaaaaaataattaagtcaagtttattcttttgttcaaaagaaacgttcattatggggaccgattttttttttttttggtctggctctgtttctttccagtcatgtcacctctccccatgacagagggtcagctggcttccagtgtttcagctaggcaggagtcggggattatggatagcatagaagagggaggaatatcaggaaggagctaacgttgctggtgtagggtcatttgagttcctgtatctctaggagaacaagcattgtctttggcataggacagaatgtggtcagaatcctctctgtcactcagaaagtaattccattgctgtcttaatattatcctagtcatctggggttgcaggaacactgtgtagtggttttgcggtgtggaagctattgctacataattttttatttcttgaatatcactttgtagtgtcatgattacaaggcttggaagaagataaactctctgtccattccgagtataaatgggcacttgagatgaaaccacctcgttaatttccccttgttgctgaagtagaatctgaatccaaaccacaacacaacctagcccctaaatctctattaaaaaccaccttgggtagtctggcaaagctttatttaaagtcagcagagaattataaagtcaaacgtgaaaaatggtacaacaagaaagaatcataaaaaaatactagatcagttaaatgtagtcaaaggcaatttagtgtgttctggcaccagcacttattgatgcaaagaatgtgatatgtcaggggttggcaagagcatgtaggaaatgcagaatgaaggatgcagctccacgcattgactccgaaacagccatacatggctgcagaggatgcttcagctaccttccttgcttttctatcaggaatttcagggagaatattcgaattcccctaggatggacattttctgttcttttgttcttgatatagtttatgttttaaagtagaattctttctttcatggagataagctaacatggagactgtgtaaattgggtcagaccaggagggtaagtaaaacttgctggtacttctgagtatcctactattctagtttctctggggctgctacatttatctgcttttttacatccatctccaagctgtgagggtttctgcctcatcttcttcacccctttggtttcccattcaccaatattagcagatttgctcagtaatgaacacagctaccaatgttatgcacccacccctttccaggcactgtgctaggccctgcatatacattctctcactaatcctcaacaagccccggtgattcttagaactctagtctgaaaaaaaaaaaaagcccctgtgagataggtcttatcagcatgttgattttacacataaggacaactagggctaagagacttagagctcatttgaggtgccacagaaacagaactcactaggccggactcctgtataggagcaggcgctatgtaagaagtgttggttctctaacttcatcaacagtaaaaggtgggtgccagtacctctaggggacagagtacaggatagtatagtgtcaagagcatcaggctgaagtctgggtttgaatcctggctttgccacttattgactctgtgactctggagaaggtacttgaccactctgcatctccctctccataaaatagggacaataataacacctgccttactaaggttgttgtgaggattatgtaagttgctatgaatagtttcaaatagttactgtggaagtgctgaatggtagtccccttacctctaggggatgcattcaagatcccagtggatgcctgaaaccatggagagtactgaaccctatgtatactgtattatttttttgtgtgtacatttataactgtggtaaagtttagtataattattaggcatggtaagagataacgataactgataataaaatagaacaattataagaatattccagcatcactacgcttgcactttggggccattattaagtaaaatagggttacttcaacacaaccactgccataccacaacagccaatccaatagctgagacagcttctaggtgactaagcggccgattctatatacagaatggacacactggacatagcgatgactcacatcctgggcaggatggaacaggatggtgtgagattttatcatgctactcagaatggcatgcaatttcaaacttatggattgttgatttctggaattttctattcaatattttcagactctagttgactgtgggtaactaaaaccatgcagaaagtggataaggagggactactgtatacatattgttgctgctgctgtttctattattattattatcaatagtgttgttatttttgtcttaaaaaatatatccctgaaagtagagtgccttcactgaaagaagtggttgtggatggaatcagggacaggggaggtggaaggaccagcccctgtggcaggtcagatgggaggatgttcttagacatgccactcggtacccttgaaatcctactttggtgtgggccatatccacttttggtaaactcatttgccccaaatgaagcagcttttgaagatcaaacaagaaaactggattctttgagtatatccagcttgagtacttccatgttcaaaatgcctttctttcctgtctacagattcacctctaggagagaaggaaagaagtttggagacttcctttggttctagcaggtcttatcagagtctcagtgtagactgaagaggagtgattgctatactgtaaatgctttagagggtctgaaagagattagagaaacctattccagaggataaaggcaggacaagagggagccattaatctcatggacattacattccctaagaactttttttgggaatggccagaagcatgccaggccatgtgctgtccatttgcaattctctgagctgtggagttgtgtgtgtgtgtgtgtgtgtgtgtgtgtgtgagatagattgaggccaatgtcattgcctcatttacaatggttcttaaacttgaactgaaaggttgacacatgcatgcagagtcaatgcagattattcgactgaagtagtcctgacaaataccagggctctccacattgtcaggaacagtctgatgatgacacgttcgaagctccgcagactggcttgcatcttagtaaatgtgtacaatcaggggagacatagctatgccgtggagagttctgagatgtgaagagaacaagttaattgttcagcctcaactgagacctttcactcaagtcattaatcacagtgcacagtctggagtcttggctctgaagttcgattctttaggctgctttcctgctccagatgaaagctcattccaggtgctggccatttgtgttttcctccaactaggctgatttatggacctggagatgttttctggtttttccaaattctgttccattactttgtaataaggggggacatgtgatttctggctttttgcagatcctcagttttaacatccctaataccaaagatttttaaaattagtctgtggtctgctttctgtgatctggagaatagaaatgctgttctgtattttgagtatcaaagttaagactttagggactcatttctttccccttgagctggagttgaagttgcaagggatgggcaggaaactgtgttcctgccttcaacatcccaatgcaaattaaggcttgggaagccctagtgacagcaactgactgcaggtgttggagatatccccgtcccacccgaatacatatggctcagggtataatattaaaggacttccacacttgggctaggtctctggtgacagtgtaagccaatattgaagatttcaaaggagaatctgagtgtcaaaggaggacattgtgatatggaggctgaacagggtgctgccaagtgttagctgtttgactgaaaggtaaaccagatctgagttgatatggggcaacagatcccttgggagttttcccaggaggatagaaatgtgtcacagcaaagtaattggaaattgatatttggcatatctctgggttactttttattccagataataccaagagtcacttggtattggccaagagtcattagtgacttatacatcaaatcccataacccattgctgaaatacaatcttctgttcgttgacagtagccagctgcttcctggtcctctgcttcctaactagtactttatgttaaaggcccatggccctgatttaggtgaaatgagtggtaaaaatagcaattcaatcttataaaaaacctgtctatacttttaaaaaattgatatataatcattgtacatatctatgcggtgcatgtggtattttgatacacgcatataatgtgtaattattaaaccagggtatttgtgatatttatcacctccaacatttatcatttctgcgtgttaggaacatttcaaatcttctagctgttttgagatataaaataaattatttttaactatagtcataattgtgctgtcgaacatgatgtcttctatctaactaaatgtttgtgcccgtaaccagcctctcttcatccccctgcactgcaccaattctaccttttgataattctctgaaacgaaattttcactggcagtgctgtccttcaaattcaactcaactcaacaggtacttgttcagagcctcctatgggctttatattgtgttgtgtgccctgggacctataaaataagtatcaaacatgacctttgcccttgaaaagcttatgagctcataggaaggatgatgtgtttatgaaacacattttacatggcaagataagctatcgtgtatgtgccaaagtgactagaatcgggaataagtgcaacagagagtcagaaaaatgagagtaggttgtactggaactgtcagagaagctcttatggatgaggtgggacaaagacacaaatatcctaaacccagaactctccgttaaagaaattgtaagaagcacagcatcaggttaccaagaaattatggagcccttttaagtgaaagtaatttgttcaatatgagaatggattaatttagttccataaatatttattgagtacatgcaatgtgccaacaactatacctgatgtgatcaaggaagaataatgagtacaaaggacacgtgtgtgttattctcagatgctaacttctctcacataggtatttaaagttattgctggtctgttgattccaaagtctgtgatttttatcatttaccattcaacctctcaaaaagactttgtcatccaagatatatttggttgaggggctgagtctaattttttgtgtggtggaaaaatggcatgtctaactgcataagttgtatgaagtgtaaagagttgcatgcatgccgattgtgaaagaaagggacgttgaattagcattgaatgtgggcccaaattattgggttagggagtatttggagtagcattagaaaagcctgaacctggcccacattcagggctataagtgaagcccaagttctctatagatcaagcttttcttggaacttgtattgttccccttgacagctgatttggaaacccaattagaagggcctcccatcattagaggtgaggcagtcttgcactgagctttgttatttgagaagtttaaaattggctacacccagatatattggataactcactaaaatctagaattgatctgtattcctccttgtaaaataaggaaagccattatgtgttcatttctttgaggacaggtataactggacaattgcaaagtgttttagaaagaaaacaatgtcaggatgatagtggtggtagtggtcatcgtcatggagatggtagttattattccaaatatccagataattttaaaataatataaccatagaacgctagtaaatgctagaaagaatctaagatatcaggcatggaggcacagaggtgtcaaagtttatttagcgaagcaataccagaagagaactagaaaatcctgcttcctagctggctgtcatttgcatacaacaatgagacccctgcttagtaacccctgtgtttctgccacccatgtgactgctttctgaagctaatttagttatcaaataaaaaatggaattttgagaaaaccgtatttttttttaaactggagggattggtggaaggaaaagcaagaagaaatttggaatcttggttcctgacattttccttaatgttcaattactctcttcattggaaagcttcgtcttggcctctatgggtgacacatccacttgtggtcactcactcctatgtatgcgtgtacatctgttgatatgcattcctcttcatcatctgtaggcattttacaaataatggcttgtgtgtgcgtgtgttttttatcatcttatgtttttaaatgaaaatgacaacttgaaaattctttgcagaaataattcttctatggtaaaggaatttcagcgtgtcttccagggtcatctttgggtcacataatttcatggaggagttggcagtgggtgggagggatataaacaatgactttggaatttttatctttccatcctgtggcaggtgggcaatgttggtaacaaagaaagttggttggtggagaactaggaaaatatagtcaaataagaaaggtacaacaagatgtgagtgcaaaccaaaaaattggcaagtgcaaaacaaaaaattggcaaggcatagaaagagagaagaggaggcatggatacttttcccctctcttccaaccctgctcctctgtgaagccattgctgaggtgggggtgcgatcaggagagtatataaaggagcttggactttgcagttgtaactcttgtttttgatgaaactgttttggaagctttcttcttgaatagagctgggggatctgagtgggactcagaagagaggagaaaggccatttggaactcgatccagattctgggtttaaagatgagaaagtattacagggtttccataaaccacggagttcaggttggcagcatggaaatctgatccagtttttactcaccaaactatgtgtgtggaggtacacatcagaggggtacctttttcatatttatccaaagcactgtgtagaagagactagtccctggatgggggaattttaaacttccttctaagttttccaatcctatctgcatatttttagagccggagtttctaagcaaggcactctatattgtttgttctcttgggtagttaagcacagacagcagggaagcatggtggctcacagagtgaactagctgcagagaccaacttatccaatgaacaaagtaggtgtaaaatgaaaatgactaaaggggtccttgatttcactctcttgagaagtcagccacaaagccaagtgcctagagacccacatttccagcttctctcgtctccagtctccctttaggaaggctgtgagcaaacctggccttcgtggttctttcttccgtctgtaaactccctgtaattattatgcagttccttatgctaggtaccatgggactgtgaggcctccggaagaaactcttgactttgaggagcttggaggccattgtgaaaacaggaaagacaagcacaatcctggtaaatgaagtgtgtacaaagcctgtttgacaacaaagtcctctctagaggaccttgaaaaatcagagaccgccatcccatatggagaggtccttccaccctcacctcaggggctgtttttctctcactgaagaatgaaaatggtaaatggcctcaagcaagctaaaagcagatccctcagctttattcatttcctgactgcaatacttggtggtagtattagaaaaggctctggcagtcctcgtaggagaaatgccagtaatgaggcaatggaacgttcattcacctgctttatgttcttttggaaataacatgatttataaaagaatacagaatcataattgtcagccaagatgtcattttaaccttaggatgtccagaaacaaagggatattacatcctttgttcttggagcaccactggtgtcaaattatgcacagcgtttcctcttggcattaagtgcttgtgagcctaacagcaaccaaacactgacttcagaaagatgatgtttctgatggttttctcacctgaatatctccttggtactatgggagagagcatgggcctcctagcttccctgcattctgatagagcaggagccaggaggcatggcagtcttagaaatggctaagggttggggtacactgtctttggcctctatcagaggagctgaacaagagtcccattaaaatgctggtgaaataattcataaccttgattttatctgcacatcaacatatgccaacagatgctcagtgcaaaacatgaatatttgattaatataaaatcaggcatctagagcagagagcgtggaatgttgggggttgagtaggacttacatgttatccatctaatcgcagctgtctggatgcacatagtaggcattggaaatatccataattatattttcattgatttgaataactctgttgcttggttttgagcccagatgtttggcgtcccgctggaactgtgtgctctgcctcctgtcatcagtctcatcagcacacagatgttcggcaagggacagcattcctctagtcttcattgtgaggcctcttctctgttctcccagcccatccactagggctcctgtgacagtcagccacagaacacagtgcaggtcacccatggagctaggtgcagaaactgtccaccacaccattttgtcattgtggttttatccaaaggcagagaacattggagcctcagctaacagaccagactaatgctggtaacaagtacttgagtggttatttcatcattcattccattggtcattgaaaaaatattgagtaaaggcttattagtccacagcacttccctgaaacctgaagaagacataggagaagacccttggtaggagatggagaaggttgcactgtgagtgagaatatgagacattcattaacttctagggaatgataagactggttacattagtgctgatgacattcacagcagaggggaggggaagctagttggtagagtggatagatagtacactagatccaagtctgtatcttgaatctctctcataacaccagcgtgtggctgtaaacccaggcctccggtttcctctgtaaaataaaggagatgcactaagatgctttctatgcctttcagtactatccttcagtttgctctgatcaagaattgaagagatccccatattcccgtggtttaattttccctgaagaccttggactgaccactttcgtaagtaatcaggtagacttctaatagtcaaaggacacatgaatgaaaggtagtgaaagaaggcatacactgatgccttaatatcttggttagaatagcggcttttgaaagtctatgaaaatcaattttggataataatagaaaaattcgttaaggctgggagtagagctttgcttcaaagtgaaatagcagcaagttttacctttgctcatgtaccatcattcttgaattagttattaatctcaggaccaagagcaacttgttgcccttggatcggtccagtggcatttctttttcttttgtttttttttatttttttgagacgcagtttcgctcttgttgcccaggctggagtgcaatcacacgatcttggctcatcgcaacctcccgggttcaagtgattctcctgcctcagcctcctgagtagctgggattacaggcatgtgctaccatgcctagctaattttgtatttttaggagagacggggtttctccatgttggtcaggctggtcttgaactcctgacctcaggtggtctgcctgcctcggcctcccaaagtgctgggattacaggtgtgagccaccatgcccagccctagtggcatttctgacttccttggttcacatggtcttggtatgacagccctatgaatgggtacctgaggagctctgctgccagtgttcaaggtggcttctctttagctcatctaagatacaggggctatatctttaaaaagtagagacaggatgattaatctgtagttggacagattaattgtggcttccaatctcttcagaccctgtgtaggcagatcaagtaacttacctacataaaaggcaaagcacagaagtcatgaacattctcacttctgtgtagtactatatagcttcctgaaaggtttataacaatttctaaccaacttgtttaatccccacagttctgtgaagtcagtattatattcttacattgtaagtgaggatattgaggtacaaatgtatttgtggggttggaaatttctcacaggacatatttggtggatgctgggaagagctactctcctgaaactccaaaaccccctccctccctcacctgctacagttgaactttttctgtaagttaagacatttctgattctgggtactcttttaaaatgcagatacccctggaagagaggtcagaccaaatttcttattgcttaaataattgcctgaataatgttttacaatcattttcatctaagatagttgaggacagcatgctaacatattaaaatcaggattaaatgggctgggtgtggtggcttatgcctgtaatctgagcactttgggaggctgaggcaggtggatcgctggacgtcaggagttcaagaccagcctgggcaacaaggtgaaaccccgtctctactgaaaatataaaaattagttggatgctgtgttgtgtgcctgtagtcccagctactcaggaggctgaggcaggagagctgcttgagcctgggaggcggtggttgcagtgagtcgagattgcaccattgcactccagcctggatgacagagcgagactgtctcaaaaaaaaaaaagaaaagaaaaatcaggattaaatgaagggggaccaggatagatttgggtttggggagcttgtttaggagtagctatctgataggggtataacaatggtgaccccaggactccagttctgaatgaaggaagtccccatctaagggatagtatgggacacggagcaagaagataatggaaacagagcaactctttatatttcagacttggttggcttatttgtgctggatcgacccctggtgagtgggcaggattgtgatggatggggtcaagcttatctaccattacatgccaagtacctggcttagggcattgatccattttatatactctcttattttgctaactacttaaggcagaaaaatcattcccctattctactccaatatgtgccagttgaaagtgaaatcctcacactgagcaaatgcaccaaagaacactatataaacttaatgagggagatgaagagatatgtgccagaaacctagaaaatttaacactgatgaggttatgactattatatgtttagttaaattgttgacactgacaggacgtggctgaggaaatctaccatccattttctccttgtaccagtgataatggttccttggtgtgctcttctcagttaacaaaaatattcccaaaagttaaatgcagggagaagaagtgacataagaagtacttttattatctctgttcttctgggagttccctccagaaacattatttaaagcagtacttctcccgactggcaaatgagtttgaagggaaggactcacgagttcagaggggaccggagaggctcctaaccctgtgcttgaaggcttgctccagcaaacccacataacacgacactgccatagcctctcaaaaacacctttctcttccattttcttcctttcaaaaactgacaaaggttatccacgggctagtgaataaaatctcaattcctttagctgacattcaaggcacaaatgtgatcgtgatttttgtaaggtgtcaagtgctgtataaacaggtggtggagagagtattgaatttgaagtcagaacactttggtttcaatcttgttaactgggtgaccttgggccagtcacttgatcactctgaatctcagttccttcacttataaaataggattatttcaatagttaaattaattgaaagtaacatagtacttagcaaagagtgaacattcaatacccattaaggaagagatggttaccagaggcaatttattctagcatttaagaacattcactatggagacaaaaattagtaatcttttttatttatttatttttgttttagattcagggggtacatgtgcttgtttgtacccccctggtggggttgggcttcaaatgtacctatcatccaaatattgaacattgcacccaaaggttaatttttcaacccttaccctccttccaccctcccgccttttagagcaatctttcttttgtctttgatttctacctagaaaatgggggtaagttggaagacttagatgagttaatacatatcaggaactttcaatagtgcttggcctatattgatccttctataagtattaagtcttttcttgctactgttgttgcttttattgaatgacctgtcctaatcttatttttcctgacttatctgattttctattttaccagcagacagagctcctccacaaagtcatgatatcattagggtggggattaattcctacctttaacttccatgagctttactcaatgcctgcaaaatactcaatcatttttgttattaaaaagtgtacaaatgtgcttgctaacatcgacctagcattgtgctagaggtttcagcctgtggagtaaggaaagaaagaaagaaagaaagaaagaaagaaagaaagaaagaaagaaagaaagaaagaaaggagggagggagggagggagggagggagggagggaaggaagagaaagaaagaaagaaagaaagaaagaaagaaagaaagaaggaaggaaggaaggaaggaaaggaaggaaggaaggaaggaagggaggaagggaggaaggaaaaagaaaagaaaagaaaagaaaaaagaagcatccagattggaaaggaagaagtaaaactgtctttatttgcagatgaaattatcatctctatagaaaattcagtggaatgtacataaagctgttagaagcaacaggagaatttagcaagttacgggatgcaagattaatatgcaagtcaattgttttagttccttaaacttaagacagccacaagtagaccagtttaactggagcataggatgagtgaggggtagtgtggtatgtaaaattagaaaggcagatctagataacatggaatacttttgcttactctttctctgccttccttcattccttttcccctcccccacctcctttctttctttttcctttctagtttcttggtataacaacctttttccataaaagaagggtagaacttctttcttaaaggcgaagttatttattctttgggttaagtcaaacaaaatgaccgtaactacgttgttttgagcttacagttaatgttctgttatatataaaatgttcccaaagacaaggagtgaaatgtcagcaagcaatcactggaacatagggtatcaggattcaagttctgatttcctcttaactagctctaataactttgggaagatcacttcaccttttaaggcccagtttgctttgtcttaaaaaagggataatgattgcatgatttccatatttatagggttgttgatggcttactccaacaaaatttttctagttcttagaaactctaagagctggagatagggaatcactcccctcagggaatatttagtgaaaatatgtgtagaactaactccagtggcataggataggctattcagagtagtatacataagggcctaggagagtgcaaagaagggattaattaactctgcttgtggggttgggaaaaatttcgctgagttgatatctaaagccaagctcacagcttaagtgagatttttgacagagaaagggacaactttaacatgataatgggaataatatcttttgtttgtttagcactttaccattttacttgacataaattagagtgatctaaaaactatatggacgttagggattattattgctatcctaggggtggttattactttaaactacttgtttgataaggctggggaaattttgaccccaaattgtaacaatttagaaaagtttatgtaaaatttccagggaatttttccatgttgggggaaccaggagccttaggagcttggtggggtgtcaaggattaggggaggggcatgggaagagggaaaaaggatattaattaaatctttgcaaaaagatggctcattttgtaattatggcataacttgctgagtaaagatgcaataatatgaaaacctggatgtttaacttttttccccataagttattggggtacaggtggtatttggtacatgagtaagtcctttagtggtgatttgtgagattttggtgcacccatcacccatgtatacactgcaccacatttgtagtcttttatccctcaccctcctcccatccttccccccaagtccccaaagtccattgtattattcttatacctttgcatcttcatagcttagctcccgtatatcagtgagaacatacaatgtttggttttccattcctgagttacatcacttagaataatagtctccaatctcatccaggtcactgcaaatgctgttaattcattcctttttatggctgcatagtattccatcgtatatatatacacacacacacacatatatatatatatatatatatacacacacacacatacacaccacagtttctttatccactcattgactggtggacttttgggttggttccacaattttgaaattgtgaattgtgctcctgtaaacatgcatgtgcatgtcttcaaataatgacttcttttcctgtggctagatacccagtagtggggttgctggatcaaatggtagttctacttttagttctttaaggaatctccacactgtttttcatagtggctgtactagtttacatttccacccgcagtgtagaagtgttccctgttcactgcatccattccaacatctactgttttttgatttttttattatggccattcttgcaaaagtaaggtggtattgcattgtggttttgatttgcatctccctaatcattagtaatgttgagcatttgttcatatgtttgttggccatttgtatatcttcttttgagacttgtctatttatgtccttagcccactttttgcttggattgtttttttcttactgatttgtttgagttcgttgtagattctggatattagtcctttgtcagatgtatagattgtgaagattttctcccgctctgcgggttgtctgtttactctgctgactgttccttttgctgtgcaaaagctctttagtttagttaggtctcagctatttatctttgtttttattgcatttgcttttgggttcttggtcataaaatccttgcctaagtcaatgtctagaagggtttttccaatgttatcttctagaatttttatagtttcaggtcttaggtttaagtccttaatccatcttgagttgatttttgtataaggtaagagatgaggatacagttctcctacatgtggctagccagttatcccagcaccatttgttgaaaagggtgtcctttccccactttatgtttttgtttactttgttgaagatcagttggctgtaagtatttgggtttatttctgggctctctattctgttccattggtctgagtgcctatttttataccagtaccacgctgttttgatgactatggccttatactatagtttgaaaacaggtagtgtgatgcccccagatttgttcttttgacttagacttgctttggctatgcagactcttttttggttccataagcattttagaattgttttttctaattctgtgaagaatgatggtggtattctgatggggattgtgttgaatttgtagatttcttttggcagtatggtcattttcacaatattgattctacccatccatgagcatgggatgtgtttccatttgtttgtgtctatgtttagaaatctgtgatttctttcagcagtgttttgtagttttccttgtagaggtctttcaactcctttgttaggtgtattcctaagtattttatttttattgcagctattgtaaaagaggttgagttcttgatttgattcttggcttgcttgctgttggtgtatagaagagctattgatttatgtacattaatcttgtatccagaaactttgctgaattattttatcagttctacaagttttctggaggagtccttagggttttcaaggtaaatgattgtatcgtcagcaaacagtgacagtttgacttcctctttaccgatttggatgccctttatttctttctcttgtctgattgctctggctaggacttccagtactatgttgaagaggagcagtgagaatgggcatccttgtcttgttccagttctcagagggaatgctttcaacttttccttattcagtattatgttggctgtcagtttgtcatagatggcttttattacattaaggtatgtctcttgtgtgcccattttgctaagagttttaatcataaagcgatgctgggttttgttgagtgctttttctgcatctgttaagatgatcatgtgatttttgtttttaattctgtttatgtggggtatcacatttattgacttgcgtatgttaaaccatccctgcatccctggtatgaaatctacttgatcatagtggattttcttcttggtatgttgttggatttcgctagctagtattttgttaactattttagcatctatgttcatcaaggatatcaatctgtagttttcttttttggctatgtgctttcctggttttggtattagggtgatgctggattcatagaatgaatttgagagggttccttctttctctatcttgtggaatagtgtcaaaaggattggtactaactcttatttgaatgtctggtagaattctgttgtgaacctgtctggtcctggactttttgttgttgttgttgttgttttaatttttttaatttttaatttttttttttgaggtggagttttgctcttgttgccctggctggagtgcaatggcatgatctcagctcaccgtaacctctgcctcccaggttcaagtgactctcctgcctcagcctcgcaagtagctgggattacaggcatgtgccaccatgcccggctaattttgtatttttattagagatggggtttctccatgttcatcaggctggtcttgaactccagacctcaggtgatccacctgccccgatcttaggtgatccacctgcctcggcctcccaaagtgctgggattacaggtgtgagccaccgcgcctggctggtaatttttaaatgaccatttcaatcttgctgcttgttatttgtctgttcagggtatctaattcttcctgatttaagctaagagtgttgtatttttccaggaatttatccatctcttgtaggttttcctttatgtacataaaggtgttcatagtagccttgaatgatcttttgtatttcagtggtctcagttgtaatatctcctttttcatttcttagtgaggttatttggatcttctgtcttcttttcttggttaatcttgttaatggtctatcaattttatttttcttctcaaagaacctgccttttgtttcatttatcttttgtattatttttgtttcaatttcatttacttctgctgcgatcttggttatttcttttcttctgctggatttggatttggtttgttcttgtttctctagttttttgaggtgttactgtaaattgttcttctgtgctctttcagactttttgatgtaggcgtttagggctgtgaactttccttttagcactgcctttgctgtatcccagaggtttcaataggttgtgtcactattgtcattcagtttgaagcatttttttaatttccattttgatttcgtttttgacccaatgttcattcaggagcaggttatttaatttccatgtatttgcatggttttgaagattccttttggatttgatttccagttttattccactgtggtctgagagagtacttgatataatttcaattttcttaaatgtattgaggctcgttttatggtctgtcatatggtctatcttggagaaagttccatgcattgttgaatagaatgcgtattgtgtggttgttgggtgaaatgttttgtatatatttgttgagtccatttgttccaaggtatagtttaaattcattgtttctttgttgactttctgtcttgatgacctgtctagtgctgtcagtggagtattgaagtctcccactattattgtgttgctgtctatctcatttcttaggtctattagtaattgttttataaatttgggagctccagtgttaggtgcatgtatgtttaggattgtgatattttcctgttggacaaggtctttaccattatatactgttcctctttgtctcttttaatgctgttgctttatagtttgttttgtctgatataagaatagctacccctacttgtttttggtgtccgtttgcatgaaatgcctttttccactccttcactttaagtttatgtgagttcttatgtgttgggtgagtctcctgaaggcagcagatagttggttgctgggttcttatccattctgctgttctgtatcttttaagtggagcatttaggccatttacattcaatgttagtattgaaatgtgaggtgctgttgcttttatcatgctctttgttgcccatgtacttggttttttgtttttgctttttaacttgtatttttgttttataggtcctgtgtgatttatgctttaaagaagttctgttttgatgtgcttccaggatttggttcaagattttgagctccttttatcagttcttgttgtggtagtttggtaatggtgagttctctcagcatttgtttgaaaacaactgtatctttccttcatatatgatgcttagtttcactagatacaaaattcttgcctgataattgttttgtttgaggagcctgaagataggtccccaatcccttctagcttgtagggtttctgctgagaaatctgctgttaatctgataggttttcctttataggttacctggtgcttctgtctcatagctcttaagattctttccttcatcttaaatttggataacctgatgacaatgttcttaggcagagatctttttgtgattaatttcccaggtgttcttttgcttcttgtatttggctgtctaggtctcttgcaaggccgggagagtttgctttgattattcccctaaatctgttttccagggaaaacctggacatttaaatgctagtttaacatggagcagaggactccatttttgtaaaatgctgcaacctgggaatttcctttcataattttgatagacatatggcacttctggttgagaactgggcctatagcagtggcttaacttaagggttccatagatccttgccttggttcaacatatcccatctacgagatgacaaatgtttgattgaagaagtattgaagagtatttggaaatgtagacaaataacagtatctggagcttgcagcacagtgggaaatggagccaagactgtacctataatttagggtaaggagcaataatgaggtcccataaaaataaaaaaccatgatgttaaatagactgcagatcatttgcaccttgaggcttttcttagattttatgccagcaaaaaaagtagtaatagggcttgtgctttatgccaaaagaattcctcgtacacaagattttatttgctttagtgtaatcaaagagaccctccccctaaaattatataagggtaaaaaaaaacaaaacaaacaaacaaaaaacccatccagctataaagagctgccagcctgggtttggagcatggctttaatcctctgtgcctggggtcatattgtttttatcttgcttttgactctatttcaaagctgatgttgctatctacaaaccttacctaacagctataattatttcatttgtattcactatgaagtcctttccaatcatgttagagaaatggattccagtgtttgcaagtgaccccttatcctgtcttttaaagaaaatagcatatattgtaggctccccttatctgcatttttgctttccacagtttcagttacccacgatcaactgcagtccaaaaataagatattttgtgagagagagaaagactatattcgtataacttttattatagtatattgttatcattgttctattttattattattattgtaaatctcttaccgtgcctaatttataaattaaacttaacataggtctgaatgtataggaaaaacatagtatacatactatatatagtaagtggagagcacaccaaatgtatatcatttttgtactgtagtaaatttgaaaaattgtaggtcaacccattataagttgaggatggaaggtctgtctatagggttcagtattacatgtggtttcaggcatccattagtggtcctgatgtgtcctctacagacaaagggggactactgtaagtttgtaaaaccactgaacaaggagtttcaaatgtgataaaatattaaaatgggactcttcaagttcagctgaagccacaattaataggaatcaactggtcgcacattccaagatgagatgctagatcaccccagcaggacctgcaagagttctaaaatttggatcgtgtcattgcctgagctttcagacattagataagtcaagtcagatttgatccttagttttttcctttgtcaagtgggaacagttattgctacccagtgaccttgtagggatgtgtcaattgagatgctggacctgaagatgccatgaaaattcgaggtagtggttctctttctccttcttgcagtggggttttgggtcacaaaatgacaggattgtcctcagatactttatagaaagccattggtgctgttaacacagtatgagtttagtgtttcattttggagtcaaacacactttatttttttttctcacaactgcttctgtgaatctacttgcagggctagatcttctgccctggaatcatatcctagctagtgctcagagcctgccactcactctttggtagtaataactcctctcattggttacctgagtttccaaacagtgttggttatgctataaataagtatagtctagggtaataatcaaaactctgaaattcatccatgggtaatgcatcttctggcaccatcaagagcttgctacagggggagaagtgggctgagtaacttctttctcctttattcttccatatgctaggtgagttggataggggaagagaagagaagtaggagccaggatcaaatttgcttggctggtcccaacctggtattgatttgcttttctactggcagatgcttaagactggcctttcttctctgaaagctgtttcatgatttggacgcttatcactagggtcctcttttttgtgggtgattctcttttgatgataaatgaatcatctagggacttctctctgctgaggtctccttgcctctaacaaggcaaggtccaagactagctcagggtgctttgtcttgtacttggcacttacctcctccctggaaatatggatctttgacctaaaagtgttgtatagttatgtccccaaattgaatctgttttgtttagccacctagtgagcagctttagccatagtctttctttcactcattaactttcttagacttatgtaagatgggtatcagttcactgtgacccttaaaatgcaggggcacctaccaagccatctgagtacactaccaaagtccctctcatttgctagaaataaagggagtaccatagccctgatacttttccactggagggaagcattgcaagtacacttgaaaattctctttgaagaaatccttgccgggcacagtggctcacacctgtaatcccagcactttgggaggctgagcggggcagatcatctgagatcaggagtttgagaccagcttggccaacatggtgaaaccccatctctactaaaaatacaaaaattagccaggcatggtggcaggtgcctgaaataccagctacttgggaggctgaggcaggagaatcacttgaaccgaggaggcagaggaatgcagtgagccgagatcacatcattgcactccagcctgggtgacagagacagacttcatctcaaaaataaaataaaataaaaaataaaataaaataaaaagaaatccttaattcccaattctaagctcctctgatagtatattcagcatcttttttatgctatgcagagatgtactcagctaaggggtgcagacctgggtcttagacatctcctttgcaggtcctgctggggtgatacagtacctcatcttgcaatatgggaccagttgattcctattattttgtggcttcagctgaacttgaagggtcccattttaacattgtgttatatttatatcagcttaccccaaactgtagtctatggaacactgcttcagaaaagggttccattttttttaaaaagggtccttatcaagtgtatttgggaaatatatgtaagatttccagctcttcaggtgctcattgcatataagcctatcgaagaccatgtggaatctagcatgaggagtggtgtttgaccctttccaaacccagtgtttctcaaatatatttaaccacacaatttattaacatggtgtctctttgtttgcattttgggagatgctgctgtagatggttgctggtgatgcttccattgggtttagctaagaatgtccatacattcttccaaagttttcctaaataaaaaagcttaattccttcttagtagaaatgggctcattttaagatgagtatctgttttggaaatagtccatcagcattggcgatgtgaggaaaaaaagagtaatgagtaggcttgttgccttgcttattgcaaacagcaaaaaataaaagataagattataataatatttatatgtatcatagtaatattgattattatgatacaactcattataataggagtttgtagtatcctggtattctgtctggactttgagagcttagcttcaatgaactataaagggaaagtcatagttaattattctcacctggacaagatattgttatctcctgtgttttttaagtcactaccatcagttgcattggttttgagtcttcccaaatgtgtctacctttgggaaggcccaattggccagttcctagacagtttttttttatgtacacagctcattttcacatatggatcataacttcccaggctatcctagcatagcctatcccatctatcccctcattgtgtttcaatgataagatgatgggctttatagttcttttctgtttcaaactttgcaagtatttattctgaataacattagagtctcactagcatgaaaaactgtcctggtttgcctgggactgtcctggctttagtactcagagtcccacattctggaatcctctctccaaaatgcaaaatgtcttggttttcaatagtggatggcaaagcttggaaaaatacaaagcccatatgtcagcccaaaatataggtgctgaaagcaatgctgttttagtgtcaaataggtacagcatagattatctatcttccatagttattgttactattcacccctcccatgttgacaatcatgatttgcagttcacactaacggatcattcattattgtttcactccaattgatgaaactcaagtgtacaccataactacattgtaagttgagtgttaaaagtccatctgtctttgactttgtctttatattaacttgttgtgctttgtatcaagataatgccagtttaatttttaactttatgaatattgtgaccatattctctaagagttcagatagtgaaaatgaagatgattattataccaatgccagcatcctagaaaaagaaggttagatggttgctattttaatggcagatgaaaggactcatacgtctggattgggcagataaataatcaaaacagagcatactgcacaagatgcagaaaagaagatataaaagtgcatagggagactgaatcccacaattttggcatgaggtagacaagtacttctgagtcaatcaaaagtttcttgtctcccaagaagacaccaacgctcagttgaatatagcagccactgaattatcttgagtatacgacacaaataagcagcgtcattgcattattcccttgattgctttctgaaactgattaaaattatatttcctgattcacaggttgcagttaaagtgccctaggcatgaacagcaggggaagttttgggtaacatgtgctggccctctatgtagcagagttaattctgttagatttgaacaacaactctagtatatcaagaaattcttgaatcatggcaataagataatgttccctttagctctttagtacttgaacttgataaatggagattcagaatgtcttttggatttttataaagattttaatgaaactgtagaaacataaaacaaaagattactgataacttgtctaaaaacaagctagatttagctcatctatctgcatgtgtggcaggcagtgcaaatgtaaattttggtaaacttcattcagtgtgtaaatttcttaacaaagaaaagaaaaagatttcaactgctaaaagttcagtatactttttctgcaaggatgctaaaaaaaatgggatttgcttacctgtgatattgaggctttttctaaaactctctgatgatctttgaagaagccataaggagcctagaaaaggacaactgactatacccaagttgttggatgttatgtgtaggatgtgacagaaactcatacagaaaaaaaggacttatgttttggaaataagcctgtttcaaatgaaaaaaaaaaatatgttaccagaggactgccaggttaggccaatctttctcagtttttcaatttctttaataaaactgtcacttacttggaatctggctttgatttcacaagtttgaattacttctgtgctttaaaaccattttacctgccaaagaaaagttttgcttatgatgacatccaaaatgcttcgtagtgttttaaaaatgatcaacatattggacatggataacctatatgactagtttatagatgcagtggatctgactgacaaactgctggtccatcaaagcaggcatgtggatacaaagtggatgaacatttttggagagctagaaattaatccctacaagtcttaaatcctgatgttactagtaagtaaacttctaagtgttccatgctgaattttttttttttttttcggggggagaggatatttgacttggtggagtcataccaatacagtgtaaagtgggcttgataaagagcatagtctaaagttaaatcaagttttacatttgactatattcatttagttttaacactacagaaaagaatagaagtgtgttgtaatggttgaaagcagtttaaagaactattactggaaaaggaaacagagagtaagaatatcctgctgtatcatgctgtatcacaggacagatggaaacgtgtcatagtttttgggttttttttaatagacatgagggtacaagtacattattattacatggttttattgaatagtgatgaagagtgggcttttagtgtaaccaacacccaaatagtgtatatcattcccaataggtaatttctcatcccttacccctcagccacccctccaccttttggagcctccagtgtctattattccattttgtatatctatgcgtatacattatttagctcccacttatgagtgaaaacatgcagcatttgacattctgagttatttaactttagataatggcatctagtttcacccgtgttgctgcagaaaacataatttcattcattttagggctaagtagtattccataatatatacatatatatcatgcctctctatctacctatctatacatacatacaaacatacacacacactactatagatacacacacacagcacattttctttatccagtcatctgtggatggacacctagattgattttataactttactattgtgaatagtactgtgataaacatacaagtgcaggcaactttttaatataattttttttcctttgggtagatatgcaggagtggaattgctggatttaatggtagttctatttttaattctttaagaaatagccatactattttccataaaggttgtactttcattcccaccagtagggtataagcattcacattcctgtttctccacattcttgccaacatctgttgtattttgactttttaataatagccattctgactggtatatgatggcatctcattgtggttttaatttacatttctctgatggttagtaatgttgagcattttttcaaatgtttgttgggcacttggaagtcttttttttttttttttttttttttttttttttttttttgagacgtagtctcgctctgttgcccaggctggagtgcaatggcgcgatctccgctcactggaagctccaccacctgggttcacaccattctcctgcctcagcctcctgagtagctgggactacaagtgcctgccaccacacctggctaattttttgtatgtttagtagagacagggtttcaccgtgttagccaatatggtctcaatctcctgacctcatgatctgcccacctcggcctcccaaagtgctgggattacaggtgtgagccaccacacccagccgtatgtcttcttttgagaatgtctgttcatatcctttgcctaccttttaatggggttatttattttgtttttcttgttgagttgtttgagttccttgcagattctggatattagccctttgttggatgcatagtttacagatattttcctccattctgtagattatctgtttactttgttgattatttctttgctatgcagaagctttttaattaaatcccattagtctgtttttgtttttgttgcatttgatttggggctcttagttacaaattctttgcctaggccaatgtcagaagagtttttgctaagttttcttctagggttttaatagtttgaggtctttattccatcttgagttaatttttgtatctggtgagacatatgggtccagtttcattctttcgcatatggctacccaattttcccagcaccatttattaaatatgatgtcctttctccagtatatgttttgtcaactttgttggagatcagttgcttgtagatatgtggcactatgtctgggttttctgttctgttgcattgattgatgtgtctatttttataccaatatcagactgttttggtttcaattgttttgtagtataatttgaagtcaggtaatgtgatgcctccagcttttttctttttgcttaggattgctttagctattcagtttcttttttggttccatctgaattttaggattattttctctatttctggggaaaataatattggtgattcggattcgataggaattgcattgaatctgaatattcctttgggtagtttggtcattttaacaatatttgactttttaatccatgggcatgggatgttttttctatttgtttgtgtcatctgtgatttttttcatcagtgttttgtagttctttttgttagagatcttttaccttcttggttaaatgtatttctaggtattttacttttttatagctattgtaaatgggattgacttttgtattttgttctgagtttgattatttttggtgtatagaaatgctactgatttttgtaggttgaatttttattctgaactttactgaagtcagttatcaaatctaggagtcttttggaggagtcgttaaagttttctaggtatcagatcatatcatcagaaaacagagataatttgacttcctctttcccaatttggatgccttttatttatttcttttgcctgattactctagctaggacttccagtactagaataggagtggtgaaagtggcatccttgtttagtcccagttcttagggggaatgctttcaatttctcctcattcagtatgatgatggctgtaagtttgttgtatatgtcttttattattttgaggtatgttccttctatttctagtttgttgagggttttaatcatgaagagatgctgaattttattgactgttttttttctacgtctattgagataatcatatggcttttgtttttatttgtgcttatgtggtgaatcacatttattgatttgcatatgttgcaaatccctggaataaaacccacttgattatgatatattatgtttttgatgtgctacttaattcaatttgctgctattttgttaaggatttttgcatctatgtacatcaggagtattggtgtgtcttttcttttctctctttttctttttttttcttttttttttttttttgagacgatgtcttgctctgtctcccacgctggagtgcagtggcgccattttggctcactgcaacctctgcttccccggttcaaacaattcttctgcctcagtctcccgggtagctggtattacaggcatgcgccaccacgctcagctactttttatatttttagtagagattgggtttcaccatgttggccaggctggtctcagactcctgacctcaggtgatccacccacctcggcctcccaaagtgctgagattacaggcgtgagccactgtgcctggccttctttgtgtgtgtgtgtgtgtgtgtgtgtgtgtgtgtgtgtgtgtccttgcctggctttggtatcagggtgatattggctttatagaatgagttagggaggagtccttcctcctcaattttttggaatactttcactacgattggtgccagttcctagaatgtgtggtagaattctgctgtgaatctgtctggtcgtgggcattttttgtgattgttaggagattttttactactgattcaatctcactacttgttattggtttattcagggtttctattttttcctggttcaattttgggggttatatatttatcgatttcctataggttttctaatttgtatgcatagaaatgcccatagtagtcttttatgagcttttgtatttctgtggtttcaattgtaatgtgttctttatcacttctgattgtgcttatttgacttttctctcttttttcttgtttagctagcagtttatcaattttgtttatcttttcaaaaaaacgactttttgttttatcgatactttgtgttgttttttgattttaattttatttcgttctgctctgatctttgttatgtattttcttctgctagctttgggtttggtttgttcttgtttttgtagtttcttgatgcgtgaccttagactgttaatttttgatctatcttttgaatataggcatttaatgccataaactttcctcttagcaccacgtttgctgtattctagaggttttggtttgttgtgtcactgttttcatttgtttcaaaaaattttttaattcttgccttaattttgtcattgatccaaagatcattcagaagcaagttgtttcatttccacatacttgtataattttgagagtttctcttggtatcgacttatagttttattctactgtggtccaataaaatacttggtatgaatttgagtttttaaaacttattgagacttgttttatggcctaaaatgtctattttggagaatattccatgcgtagatgagaagaatgtatattctgtggttgttgggtagaatgttctgtaaatatctgttaggttgatttgatctagagttcaatttaagttcaaagtttctttgttgattttctgcctccatgtcattgttatttttcattatttataggtaatatctgtttctaatgttattttcattttctttttaaaaagtcttatgtttgtgtatcttaagaatatacataatataggccaggcatgatggctcacacctgtaatcccagcactttgggaggccgaggcaggcggatcacaaggtcaggagatcgagaccatcctggctaacatggtgaaaccccatctctactaaaaatacaaaaaattagtcgggcgtggtggcgggcgcctgtagtctcagctactcaggttgctgaggcaggagaatggtgtaaacccaggaggtggagcttgcagtgagccgagattgcaccactgcactccagcctgggcgacagagcaagactccacttcataaaaaaaaaaaaaaaaaaaaagaggaatatacataatatagcctataaatttaaatatccaataaagtgcttaaaaagtgttaaaacaaattgctttatcagaggacagaaacattactgtaatatttttctcacacatattatttgtttagttagtcctactattaattaatgttaattgccactgttaacaacctatttttatttaaataataaaatgcatgtagctgaaaggtaaatactatagaataataaataatttcaaataaaaccttatttttaacatttttgtgttaaaatactaatgtatgtatgtattagtaattaattattgtaaatttttatctttgcttttttttttttttttttggcttggaatggctgtaccctaggttactctaatggtcaccagggtacttttcccaagcccgtaatgttttaagacaagcaagcaaatctaattctcattaattgcctcttacctggtataagtaacctctcacattggacactgactgtaaaaggagttactattacattatccttatcaattatctgtgacagtggagccagtaattctcaaaacatttgtacgtcatttaggactctttttaaagtaaattacatttactttaaaatgtaatttatttgatatttggtatcttcaattttttgttggtgctaattgaaaaaaggagaattgacaatagtccatatatatcaccaatacctgtacatatctggtaattggctggggactgaaacttcttttaaatccagtagttagaaaatgatgcttatattttcataattgtgccctgtatttaccatctcgcaataatccataagagttttctggtattccaagcccttgtggagtgtccctttcttatcactaactaccctctcctcacatggaagtagacatataccctcatatccggtaagcatctccgtgcttacaaaagaatatcccactcctttagctctttggctcctttcttattcctacctatacttcaaagccccttgaaaatgccctccactttacaaaactttcttcagaccatttttctaacctacactcctgtgtaccacatgccttactactcagctaccatcttgtattgtcctgtgaagtctcatctgttctcttcttggatggattgagaagtagagatcatggcttattcttcccttgtatccacccagaatactagaacaaggctaggcaggttgtaattgttcaaaaaagaccatcaattggtttttataaatgatgagtcctgcaacacatgacatggaagtaggcaaataataatatatcttctcatagaaacgttgtccatcatgtttaacagcacgtgaaagcacattgttgcaatggaaaaataagtgaagacaggaaaaaatgaccatagtaaccctgactcctgggctaagattttagttaataccgtactacttctgggtagagactctagattatttaaaacacatagacacactcacatgcacacattcttacgcacatgtacacacacaagcacacaaagaatgggggtttggccttgacatacttttagaatttgataccagtactttttaacagcatggtctaaagttggaaaaataggaattcagtgtctagttgagttatgagttgagaatgaatttcacaacaaacctcgatgattttccaccaacaacaccaacccaaagacaatcacttggtggccatcgtattgcaaaagaagcagagcacagacatgctgtctgtttcacttaaatttatgagaacctgctgaaagggaatgtagaaagtaaacgacccatggtaaagcattgtgaatgaagggagaggtgctgtggttagctgggttgctcaattcctcagattctcaaagccaggagaaaatttatcctcttccactgagacataaactaaactccttttggccattaatctgcaaagttgatgcctgccatggtaattcatcagacatttttgtggggtgagtctggtggggcctctggggcatctgcctttgaaattcaaagaacagctttgtcccctggggacagagtgactttcttccctcattgcacatctggaaggggagtttctgctcccactctcccccaagccaaggcagggcctgaaagagctgccatcttcatgaagcatgtacttgtacctcacttttctgatcactctacccagactgtcagacgaagagaaggaagagaaatacagccagcacactgtttgtaagtgcctttttcccattacagttcagcacagagaaaggacaattactgtttttagtgggttttataggagccacagtcactgcactaaccattgtgaaaaatgagcagaattctcaagctacatgtctcaatcatctgcacataaattgggcaatggttttggaatcttggggtctaatctgaatttacaagtgtgtctccaggcccagtgacaaatacatgatctgaagacagcgggcattactatgaagaacatagccttgggtgctgggctcatcttttgccccttcagtaacaggcacctgccaatgccttggtctcttagctggaggtttctcctgaaccttccagtccttaagtgaactggccgtgttttctctacaggctcctggtcctctgtcctccagctctgcaccacactccagacacagtggttacctttcagttttttgagtacaccaatgtcttttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgactcggcctcccaaagtgctgggattacaggcgtgagccaccgcgcccggcccaccaatgtcttttctacatagaactatccaccctgactagaaggccctgccgtacaatctttgtgatattggcttcttttgacattgaggtttcagcttgaatgtcatctcctcagagaggtcttctgagaccactcagtttaaaggagccacaaccagctacccaccagtcactttccatcatttgtcagtgtgtcactttccttgtgacatttactgatacctgccatttttttttctctctctcttctctttctctctccagccctctttctctctctctccccctttccatcccacttctacctctatgaaatagtaaactcccaaagagcatggtccttaatctgtcctgttcactgtgctatgtccataggatgtgttcagtcattcttgctgaatgaatggtttccctgttctttgggtgtttgactgagggtagcatgacatttacagtaaagtttatgtcatttttcatattaaaaaacatgcttggatcaacatcttttaggtagaattcactcttatacatttatctattaaccaatgtattcatttattcattcaattgatatttgttatctactatatgccagataccttggcgagatgttacagatgtcagagaagtttcggccagggaaatgatataaagaaatggagagagacacatgtgaaaacaaaatttcatattttataccgaatgttatatccagacctgtctgtctaatatccaattttctttttctagctaaactgctatctttctgctccaactgtctgctctccagtaaggctctttcttcattaccccacaattggacctcatcttcacttatgttattactttattctagactgtcttctctctgctgttttctttgaggccagttcaggactttccgtcccaggaaggtttccacaactctgtgagctcccatttgtcccctgagctgttctctttagtacgtaaagtctagacccttcaaaaatttagagctttgtactgatgatgattttgcttggatttgtatttcttccacatgtgttaatattgaaaacccaactcaattctatcttctttgagaaagcagccatgttttataattcttctaggtctctgccaatatcacaggtagtatagggaacataatagcagtcaataaattcttactgattgattggtgtcgaaattgggttgtcagttccagacggcatgctgaatgagagcaggtctgggaaaagcctcttcagcattcagcctccctgtagatcaagtacaggcaaagcttatggcaaaaggtggtgaaaggcaaaattccaatagcaagagtattattaatctacttaaggcattaagtgttgtccagtattagattggaccggaaatcctggttttcaactctttcccatttgaatgcccaagaggctgtcagtgagtgagaggaaatacggaattggctttcagttgcccgaggagaggagcttaaattcctagatttatggctctactttacctgaaacttttattttgcttttacttttatgtaccaatcgagtgtactctatttctgttggtgcttcctaaacagtctaagggagctctaaaaataagtaccaaccaatttatacagtaatgttcatagcgttgtttacagaatgcctcatcacaggtcggtatcctgggagaccccaaaaggtatgatactttcagagaggggccttagtgaaggaggtatagtttgcagtatgaatggtctgtctgtgatctctgaactcaattattctggtttttcaaaatctagtagtagtaaaagaagcaggcagagtgtagtagtcttgtgtcccgaatctctttactaacatgccatcttgctgcttctgtttggcctgattttcctcatcatgctctacatttctggaagtcctttggtcttccttctgttgaagttttctagctccttcatatcccaccttatcctcatttcctggagtgaactctttcttctttgactctctatagcactcaggtgcttcttcattcatttgctgcttattaaaattgccatttaatgtgtatgcatcttgttttcttaagttgactttaacctattgtttggcaggaactttgtctcatacttcttaatatctccagagtgcccatagtaaatgctcaataaatatttgctgctaatgatatatcttagttgactcatcttgtttctggtaaattttactgtaacaagtagcaatataatgatataacttaaaagaggacaaagaaaatctagagggactttgaacacttgattagaactctaaaagggagaaattctttcagtgttggtcagtaatataaaaattattttgaatgattttatcaacttgacatatctggctattattacaagtgtttgtttatgtgttaatctctcctaaacttgacaaggatagggtcttcttaagcacaaagtctatatattttatatgtccttggctttatttggattaccaagtgagtagagagctgaaaaaatatttattaaatgcataaatgaatgaataaccttcaaatccaaagctagaaattctgttaaagaaaagatttagaccctctatctctcaaagttgcaagttactaatgctgctcacccattttcggttaatactaatagtctgtcttctacatggggaagtttgttggactaaaatgtgataatagggaccataagttgatgcctttgcattggctggtttgggaatagctgttgagaggatacaatgtagtttcttttcagttttatttgtcagccttgatcttggtggaggaacatgttcttaacacctacaagataacaggattgtttaaacattacaatatcacaccccatatttgagttttatgaaaaactgtgaatagggccaatgtcctaatttgtcaaaaatgttaaactaatattgcaattctataaaataaattattgacagattttataacataaaaatgtgtatttttatatatctgtagcattataagcaaaattaaggaaaataagctaggagataatattttaaaatataattaaatattttattcctttattataggaagagcttttacgagttctactgaacaacaacaaaaaatccagtagaaatgttggacaaaagatgtgattatacaaaactagaaatgcaagtaaacataaaaagctcaaacttacttaaaaacttaaaatgaaatattcgtaaataaaactattactgagggcctataaaattttgggttaaaatgaaatggtaatacttaataaatgttagggcacaatgatgctatctttcttacatctttctttttagaagtaacttatttcaatgtttctggaaagcaatttgataatttttatattactacaaaaatatggtagctaccctttggctcaacaattttttagaacacaaaaatgcagtcaaagatgtatataaaagactgaaagtaattcttcatagccttgtttatatgaaggaaaactgaaaacagcctaaatatttaacaataggtgaaatgattagaaatgtggtatattcagagcaggcatagtggctcatgcctataacccagcattttgggaggctgaggtgggcaaatctcttgagcccaggagtttgagaccagcccgggcaatatggcaaaaccctgtctctgcaaaaactataaaaattagctgggcatggtggtgcacgtgcgtgtaatcccagctacttggaaggctgaggcaggaggctagattgagaccaggaggtagaagctgcagcgaggtatgatcatgccgctgcactccagcctgggggacagaatgaaacactgtttcaaaaaaaaaaaaagtggtatattcagatgatcatatattatttaacccacaaaaataagtctttttaaacttaaatttaaattttttaagtgaaagcaagattattaagaaagtaaaggaataaagaatggttattccataggcagagcacaaaaataagttttaaaagagtaccatgagattgtgcttataataacaagtggggaaaagtactaaaagctacatagagcatctcaatttaatggacccacacaagactttgaagaagttcactgaaatatcagcagtggttctcattgcacaataaaacagactgtgagtgatttttttgactgggtcaaacatcattgtcctgtcatctttgtgtgactgagaggctaagtgtcagaacactgtagatatagttagtttgaaggaattcattcattctttgaacgaaaaatgtagtatgtattatgagtctggtaccatgctagatcctgtaacaaggagcttagaatgaaatgtgcgatacagctaggtcagtagatatctatgttctaagtattattgtattaagtgcttggataatatagtaatgaggatgataatgatgatgccatagagaccacttatgtagatcttctagtttctgttgctgtgtaacaagttataccaaaagtttagtaactaaaaccaccgttgtattcagctcatggtttctgtgggtcagggattcagaaagcataaggtaatagctttttctctacatcacaatgtcttcaccctcagctgggaagacatgaatgctagggctgacttgactggaaatgggaatgatctgaagactcatgttcatacattcatctgtttgggctaggaggacccacagatgaggatttctaactgaaatgcctacatactccttgtggcctggcttgcttgtggtttggcagcctcagggtagttggatttacatgaaagtgcaaggtttcatgcccatgcattctagtcagcaaagcagaagctgcatcagaagtttttctgacttattcttggaagtcacacgtacacactgattcaagggaaggggacacggataccaccttctggtgggaggatagtcatgttgaagatcaaatggaattggagatattgtatgtgacttcattatgtgctagacattattcatactgctttctagcaagtagttcatttaatcctcactacaattcatgaggtaagtagtattagcattgcctcctttaaacaagaatctgaagtcatggagctaagtagcttgcctaaggtcacataataagtggcaaagctggacttcaaactcaggcagtctggctccagtgtttatgctcttaatcagtggaggtgatcaggttactagggacatatgcagaagacctgcctaaccctgacacaggacagggagcagggagtagataaaggaaggctcccttgaagaagtgatacctaaactgagttatgaaggattaacagaccctagtttgagacttgaaggactaataaaatggacagtagttagctgggctgtgggtagatggttggaatgggaaaatgcctcatgaagggagaacggcatgtagaaagcccccaggcaagtgagtacggcatattcaggcaattgcaagttgctcctcagtgctagaattcagagctgtggtggcaagtttcgaatggtgaggctggagagattgacaggaataaaattagaagggcccaagcaatccaatgattgcttgatcaccatactgagagatcaccaggatggtgatgttactgaattgactcttctgttttcctcctagcaattagccatgtatttattagcatttgccttttttattgtagtaaaatatataaaacttaaaattcaccatttaaatcatttttaagtgtacagttcagtggcgttaagtaccttcacattgtggtaccacgatgaccaccatccatctccagaatcttttcatcctgcaaaactgaaactccatactcattaaacactaacttcccattcactcctcccctctagaatccaccattctactttctatatctgtgaacttcactactctaagtacctcatataaatgaaattaatattatgtggacttttgtgcttacttatttcgcttagcataatgtcctcaaaattcatccatgcagcagcatgtgtcaaaatttcctttcttttttaggctgaataatatccaattgtatctatatgccacattttgtttattcattcatcttgttgatggtcatttgggctgcttctgccttttatctattatgaatagctctgtacatggatgtacaaatgcttcttaagacctatagataaatctttgagaccttgtttccgattcttctgagtatatatacagatttaaaatggccagattatgtagtaattttatttttaatttcttaaagagttaccatactgttttccatagcagctgtaccattttacaatcctaccaacaatgcacatgattccaattattccacaggctcatcaacatttattattttctgatttttgcttgtttgctcgcttttaaaaatagctatcctaatggatataaggtggtatctcattgtggttttgatttgcctttccccatcttttcatgtgctcattagccatttgtatactttctttggggcaatgtctaagaattgactttttagaatgatccctctggggagaagtaaaagggtagaaggagggtcagaatggaggcagggagatcaggtaggaagttgcactaaactagccaagatgtgataaggcttccatgatgcaactaatgaaattgtatggggcagtggtggtggtagatagcattgaaagattgttttgcaaattaagcagaacaaaaaaaaaaaaaacaagaaaactcaatgttaagtggatgatggcaccatgactggtattcagtcagtatgtacctgtgtagccattctggctgaaatacttccatggcagctcccccaagagtgccccttcattgcccctcccatccaggtcttcaaaatccttaaactgcctgtatgcccccataattccctaaataataatgaatgctgggtacagtagggggtaggggaaccttggactctgctccagctcagtagccagggtccattcagatttgtcagcccccttcccctctgatttactcctggatagcagtaccatttcttgacacatgtactgatgtggaaaagatttttggaaggtatgaagggagttcaccaaaggtgataagttttatttggggcctgtttgtgtattcacgtggagagagttagcattcttggttctagagaaaaagatttaggaattttcaacatatgatagtcatagaacccaagaacttaccatccaatggaaatattttccctctgcagtgacaccattctttcataaaattattcacaatttagcaactatgaacaggaataaaacctctaaccaatattccaaagaggtcagctgtgcctaaaatgcatgttggcagaatgtagtcacattcccagattttaggaagccaggaatccaggaaggagtcttcctctttctgtatagcaacttaagcttatttgaaggtggttgttcactccctcctggagtgcccttagctgcagacaaagagagtgggattcgtgatgatcatttggcatcatgtccctgacagatagcctacaatgttaccagaagctgatgaggcttattttggttttgtttcgttttgtggaaaaccagaagggatctcagtgttgctgcctgcaggataagtaaagataacctactatgtattttattggcaatcctgatagcattttctccattggtggtttatgtgtaatagagaccaaactgcaattttctgacctgccaagatccattatgtctggtaaatatagtttatgcttgacagaatacacacttagggtggaaagccatgcaaattaaactaaggtttaggctaatttttggtagtgaaaattattctcccttggtgaccttattcagcatgaaataaaacaaccagaaagctattcatgcagtccactctttctttaatcaaaataatgaaagctttggatagcccagctcctgattctcatagctcttgtctttcatggagcctaatcttttatggtcataagaagcttttttgcatgaataggttagagattaggtagtaaaatgccttatttaaggtaactgttcttagtctactttgaagtctatgcaaattatatctgtctatggatttatggagactgtatcaccacagagtcttgatctgttaacataaatgatattttaaaaatatttacccattgtctgggctaccaaactttagtcttatgttggaatagtgtctgattgctgacaagctgagcagtagttttgacagagctaaataaggagaaaagccaagctttaataatgttgaccataagttaggaataatctcattgattgcttagtacagctaattctattttctgatgataatttgcattaatatattcagtttatgtagcttagtctccaatattatctcggtaatcccatcttcattcacagtggaacagaaaagacagagttggaaggcttgtaggtcaacgtaacaaacttgttctatctgctggctctcagattcttttcttttaaaatatgtttttaaatcaacagacaaaaattgtatatgtttgtcatgtacaaatgttttgaattatgaatacactgtggaatggctgaaaggggttaaataatacagattgagtatcccttatctgaaatggcactggaagtattttggatttcacattttttgggattttagaatatttgtattatacttaccagctgagcatcccagatctgaaaatcaaaaatccaaaatgctccagtgagcattttttttgagtgtcacattggtgtccaacaagtttcagatttttgagtatttaggatatcagattctcagattggggtgcttaacctgtatgtgcattgtgtcacatagtttattatttttttttgtagtgagaatgctcaaaatatactcttagtaattttcaagaatacaacatattgttataatctatagtcaccctgttgtacaataggtttcttgaacttatttctcctatttaattgaaattttgtatcctttgaccaatatcttcccaacttacttatactcccagcagtccccagtaaccaccattctcctctctgcttcaatgagtttaacttttttaggatccacatataagtgagatcatgtggtatttgtctttctttgccaggcatattttactaaacataatctccaggttcatccatgttgttgcaaatgacaagatgtcctttattaaggctaaatagtagttcattgtgtacaagtacaccacactttcttaatccattcattcattgatggaaccgtagactgattccatactttggttattgtgaataattgctgcataggagtgcagatatctctcctacatactgatttcatttcttttggatacattcatttcttttggtgggattgctaggttatatgtataataactgtatttttaattgaggaatctccatactgttttttaacttacattcccactggtaatgtacatgggttccctttttcccacatccttatgaatacttaccttctagctttttgataatagccattttaacagatgtgaagtgatatctcattttggttttaatttgcattccctgatgattaatggtgttaaacattttttatacacctgttgatcatttgtatgtcttcttttgaaatatgtctgttcaggtcctttgcccatattttaattgggttgtttgcttaataatgagttgtttgagtccttatacatttttttatattaaccccttatcagatgcatggtttgcaaatattttctcccattctgtaggttatcttttcactctgttgactgtttcttttgatgagcagaagctttttagtttgatgtaatcccaattatttatttttgcttttgttgcctatgcttttggggtgacatccaaaaagtcattgcccagactaatgacatggagttttcccctatgtttccttctagtggtttcgctgcttcaggtcttatgttgaagtctttaatccactttgagttgattttattatatggtatgagataagggtctaatttttttcttctgttgtggatattcagttttcccaacattgtttattgaggagaccgtcctttctgcattgtgtgttcttggtacctttgtggaaaaccagttgactgtaaatgtgtggatttatttctgggctttctattctgttccattagtctatgtgtctttatggctttcaaatattgtgagacagaagaacacaggatacaccctcttcacacttgccattaatagcccagtgcagccagaatgaacaaggtgttacagaatgtgatgcaacaacaagggagtgataattttattttaatttaaaaaggcattctcagaaactgaagtttaaataaaccatttgtttaatggctttaatgtggacactagaaggcacaaaggtctgggctattgggattccagtccattttctggaatctttgccttcagagggcataaggtaatcaagtacgtgggaggtaagagtccaaatgttctgtattactctcatctttctgtgaatgaccaaattcttctgcttttcactggcaatcatatattttgtcaacttgtgaaaaaatactctacaaagatgaaaattgaccttataaagattcttcacatgtatcacatttgagaaggttgtgttcctgactgaagaatcttgccttggtttgttgactctggggttacactgtgtccagttatggctccttggatgaaggccctgtgttgtttttgagtcagctcactcagctttctggagggcagttgattccatgaaaatacttgtctatgtgatcaagcagtgggggctgaatgtgtggctcttcacaacagaatgcaaggcggattactactattcctacagtgctactgttattattaattttaaaaacatacaatgtcattatcaaccttgatctgctctgcttttgtattttagtaattgattggatgagaatgtgcccaggcatgctttaatcactggaagggcaccagggtttaatcttccaaaggggtttttcccattgttatttcctgaaacatgcttgccattactcaagtggcatacaaaataaaattcaaatcaaaacagcaaaagagatgtgatccctctcttttgtgccttcttttaggcttaattctcataagtagaacatatctaagaagagtaggcttttgagttccaggcatactacttctaaactcttcacttaaagctagcacattcacctgaccttgaaaaggtgaatagatacacactgctgagattaaataaggcaccacagaagaataactacaggaggagcaagtaagtgcaataccctcttgtatgaagtgtgaccaacctgaattaaaccatatttctagtcctccctcagctccaaacttttcagagcttttgctcaatgactccaccccattgtatccttggctgactctcataattgcctcattattatattttctatataatatgcatctttggattcatagcccaacaatctcagctggttctcctctgtagtttgtttagcagacaattgtagtcattgcccctcagcccatacaacatgggggatctggatggaaatgaaacgcagacttggctcatcagagggcagcttggcttcacttgtatgccacaaacattgtcacctcataacactgacagtagtcactgatgagcacatttgaacccattcccaaaagtgcattgcctccacaccacatgaattagagccatttgtgttattttgcttatgtgttctttttcttttctctgttgtgtattcagattcccatattagttttccttaatctaagacttacattagatgactctagccagactgtcaaattatttgagaactctctttgtagctctaaatctagggtagtacctggtagtcaataattatttatcaaatgaatggatatttttcaacacttactggcaatcaagaaataattgtatttctaaaacagtgtgaaaacacgatgaattgaattgaattggcgagaatagaatataaactgcataactgtaagagatagtactatacaatagtgctgatgacattttgttttgctttattttattttatttattttctggggctgcctgatacaaaaagttccttgtgaaaagagaagattggaatccaattagtagattggaattgatgagttagttaagggctttagcatcctaccatgggctgtggtttttccccctgaacctatgggcatgttttgattgaagatgatggctggaagctgccacgtttgaagggctagagaaagagcctgggtttcctgtgtcagatgatacaaactagaaactagaaacgctacatggtagggaggcagtgggggacagaagaaaagacatcattattctttgtctcttcttttccctgggggaaatgttggcatccaaatattcaacagtaggttgacatgtggaaagtggcctagccaaaggatctgtggtgatcgggagtcataaatcagatatgagagggagagaccatatggtgcagaaagaaagtgacgatgcgattctttcagctatagccactcacgtgcactctcttacccagtagagagaggggcccctttccactgtttcttttctacttccccagtgaacctgcaggaatgtcagctgaaataccttgctcttttctacacatttctgaatcagccaagatgtcagtgacctggaaaggactcaggtgagagccagagaaatgattaaagagccggtgatgccgatgatccagtgggtgtctcctctccgcaccactagaactgacttatgggaagatagtcaaataactagatatgtgttgtttggcccagggcagacaagaaggaaggtatggggtaacttgtctccaatggagttgccaacagccaatgaattattgtgtcttttcctctccaaatggactgtcagtatacatatatatattttcaagttttattgaaaatagttacctcaaatttacttgcacttattttcctgagagtctgaggaatcacattctcattgctgcaggcccccagaagttttgaaacagcctctgccacgccacgcaactctactcacccagagaaattgccttccctcttttccctcaacttgtctggagatgaaaaggatgagattgaaaccccttttcttagagacacgtcccctcccttgctggtttctggcttctcttttcggtgtgtgagcaaaatcattttattaaaccatttgtcagggggcagatgggaagtctgtctttcccattagttagcagaaagtgaccccagcagctgtggagggaatcggtcaagccattgctaccaaccagaccagggtggagaaggaggccgggctttgctcagttgtcacaaggtcccaggcggctccccaggagccttggaactgatgaggccctgtttttattggccatgcctgtggtaggctgacttccttcactctgagcttcaggccagccagggaagggggcaggggccactagcattgggaagctttcgtactttgcccttaacactccatatccctgtttaattaatttcctaactttgtgggggaaaaagatgaaataaataaggccaactgaccacttcataatttgtttctgaagcttggctggacataaaagtctcccttccaaaaccacacggcataatttattttacgattccctctcggcaccaggtctgggctaaccttgagtttggaggctgtgccttcgcttcctggtgctggtggtcacagtgtgtcctttcttggcagtggccatgggcccagcaaaacagacctctgaaaggcgagcagattaatcattttgaaggcatgctcgcctcaacagttcccctgcaggatgtcggagaaccggagagaggggactgctgtagttcacaaggggcatagggaaatgcctgaagactcacaaaaacaagggggtgaacaacagaaaaagaatgagtgcttttaaattgtacatgctggagttttcactaaccgaaaagtattaccaaaaaatatattgccactcctagagcacaaactgtgatgagtccaacccttttattacaatcaggctttctctaaatatattatgccctgcaggtcaaaatgatttacttctctattttgggacatctgagttctattctactgttgccagtatgttttcagctgtgccagaaccgagcaggtctgcggctcctttgtaacatcaaaacggagacatttatcattgagatttatcatgggacagcctgccagatggtttgggtattttaaaggtgaactgtttgggccttgattagctcatgcggacttctagctaaagacaactctatcagctgctcagtggaaagacactgacgtccccctccccccagctccctccctctgttcttctagtaatgcagaaaatattaatgtaatggcagatgtggcatagattgtcatttcaggaagaaaaccaagccataaccaattccactgattgcattctaattataatgtgacctcctgttgctttgcatagaggcagtattcatttcagtacaccactgtaaaacttgcctagtcaacgaccctcaaaggggcaattgtaagatttaagcttggatttttttgctcataccaaagtcctttattctgccaagcctctgctgattgggccagaaagaatgcatttgattatatagactaaacttattgggaacagaacctctgtgctttgaaatgcttttcattcaaattacattcagacattcaatcaacattgattatgatatggattggcaacagggaatgccttgggtttttggtctggcttgaaagtttgctgagtttcgtaccagataacaactgggaagccagctgagtttccttaaccttttccatgagtttctcagaaaaggatggtttctcttgggaggccaggagttccttattcccacttgatgcagtattccaagatcatttcttcacttggaaaatttgggtctttggggcttccaaatttaattaacctctgatagctttgggaaatgtgtgctcatttgtgtttatgttaataaagtaggtccttgactttgtgcatgaaaatctaggagaatgcatcttagattcagattccaggtctaaaattttgtatcatggaagaaagtgatcatcactaattctggtcatagatgttgtctgtgtgatttagagcaaggctcagttttctcatctgcaaaatgaaataaaggtgatcccaaggtttaatttctaataaagttgatttgaaaatactaagaaacaatataatattgttattattatttacatgtcagtgtatgtgcttgtgtttttgaggggcctttgcctgcatctagacctctctgtctctggaaaaatcctggtgggatcagttttcgaagtagttggctcttggcagactcgcagacatactaaagtttttgttttgacttgaaggtcctcttccggcccttctgaataactttaacctaaaagtcaggctagaattcccacaagaagagagttgccagggcatcctcattccaagctataaaatcactggagatagctccattttctttatccaatcacatgccatgagctgtcatttgtgtacagatgtctctcaaatatagatttccagccttcatagcattcctgaaatttagcattgctaagtatatggtcaccttgaatagtattctaggatctcgaattcagtacgttctctttttccccccaaaacaatggcaaccagcctctcctctgttctctctttctcttaactgctcctgtagttccagttactagagttcaaaaccttggaacttttattttctcccttgtctttacttcccacatagaactagttgccaagtcctgtgaattataccacttgaaaatatctgttcttcctaaagttagtgctttttcattgagtctaatcatttccttcatggcctgtgtaatttagtctttccaccaatccagtcatcctaccatgatgtggcagcagcttctaagatggtccttataatatctgttatctggtgttcatacccttgtgagatctcctccccttatgtgtggatgggacctgtgatttgcttgtaaccagcagattatcgaaaaaagtaatgggatgtcactttcatgattaagtgacataggattgtgacttctgccttagtagaaaacttttttcctgctgatcttgatgaagtaagaagctatgttggagaggcccacacggcagcagcagagggtggcctctggccaacagccagtaaggaactatggccctctacccaagaccccacaagaaactgaatcctgtcaacaatcttttgagcttggaagcttccccagttaagcctcagatgagaccccagccctggtctgtaccttgataacagtcttgtgagatgcctaaaacagaggacacagctaagctgtatccagattcctgacccacagaaagtgtgagacaacaaatatgtattattttaagctgttagatttgtggtaatttgttacctaatattagacagctgtatcctagagcagctagattactgcctgacaatatcagtcttttgctcagaaatactcagtgtcttcatgattctttgtctttggccttgaactccctattcaagctgttttccaattctccttcctgagcacaattacctctgtactgttcatatttctggctttctgccttttaccttttgctgacatcgttaccatttcctggattttctttatgactaaatctcacatcttttttaaaggcccacttaaatgtcacctctttcataaaagcttttttgatctctgaagctatatagatctctgagctgccatcgttctatacctcaggttcctattcattttctacctcataggggactggtttgagaacattgctgtatctgtactacaggttgaataccccttatcaaaaatacttcaggtcagaagtgttgagaatttggggttttgggggagattttggaatatctgcattatatgcttacctgttgagcatccccagtctgaaaatccaaaatgctcatttgagcatttcctttgagggtcatgttggtacataaaacattttgggtttcggagcattttggattttggattttcagcttagggatactcaacctgtgctaggctgcaaattatatgaaggaggcttcttctgattcatctttccatgcccttgagcttccaatataatgacttaatggatggtatgctctcagtggatgagactcaatggatggtatgctccagtgactcaatggatggtatgttcttgttcatgaagagcaagccagtgtgcccacaggacagcaaaacagaagtggtttgtggaactattcgtttatttacttgcttattcttttattccttcctttaccgcatacctggcattgtcctaggggctgatgtggactcatgggcatcatgcttagaaagggaccttgttcttggggttttatgtttaagcatcaccatcttcttgagactcttaatcattttatttttgaatctgtgttttctgagtgaagtcccagaaggtagtggggtatatgctaggggctcagagaatttgccagtgccttctgcctccctgacatagattctaacccacttgttctcctcaccctcccaccatggcagaggcctgggcacaaccacagggagagttggggttgggtacacatgccctgtattccaggtcacagagtaaggaccctgggtacctgggaggatctgtacttgctgcatagtcaggaagtaactatgtaagtatcatattaaataagaaatactatgacaggttgagagaaagagaggagagcattagtgagcttacagacaaacaggaaaagcttttctcttgccttttgaacaagtgcctgcattttcatttgtactggaccctggaaattatgtagctggccctgactaggggtatagtgggaaaccaaaggggcagggatacagctgtggcagcagaggtggggtcgggggaaacagcaaacaacagacaataaacaagatgatttcagaaagtcataagtactatgactttctgagaatcaaatgaggtgatatgctggtgagtccctgagtatggtgcaggaagcatgttaccttaaagaaagatgatgagggaaccgttgctgagaaggtggcatttgagtggacatctgcaggaggtaaagaggttaggccgttccaggaatatggggcagtttctaggcagaataatgtgctaggtcaaaatccttggggctggaacaagcttgaaatagccaagagctagacacaaaagccagtgctgcagtagcctagagactgtggaagagaggaggcttggggcatttactaaggtaagatgaagctgatcctttattttattttattgttctttttttagaattaggttcttgctgtgtcacccaggctagagtgcagtggtgggatcatggctcactgcagcctcaaactcctggatcaagcaatcctcccactttagccttctgagtagctgggactacaggcgtgtgtcaccactcctggctaatttttaatctttttttgtagaggtagggtctaggtatgttgcactggctggtctccaacttctggccccaggcaatcctcccgccttgatcaccataagtgctgggattacaggcaggagccactgtgcatggtccagctggttctttaacaccaacaccatactggccatagtgaggacacagcttgcctctgggcttgtctaggtctgtagtccagtattttcacacctaagaattactaaggagggattttacagcaatgcgctccctgcattttctaccttaatttaattcctttttctttgtcaacatagctattctgcattctttaaaatagagattttttcagagacatgtaacttacaaggatgtaaataatcataggtgggccaaggaatgtgtagttcctagggagagctttgcaaatgagattggttcctttcccacagaacctcaaggactgttggatttgtttcagaggtcacaaatgggcaccttatggcccaaactggagccccagaagtgttttatttgttctgcatgttgcccttcatcaaacaggagtgccccagcaatggccctgtgctccccagatagctctgtcctaatctctcctatagtctcctgcttgtgcttcttccctttatgcctgaactctttttaattgtttctcattaaaaaaattatactccactgtatagtgcagacgtggaaatgttggcatgtggatagaccctgtaccaaaaacccagcagaagattcagagtccctgagatgcttcctcctcatcttcttcgccaagcacctcttgtcactgatcttggaagttagaggtgggaaaaggcaggtaagagggccaagaagtcaaagtcctaattcatgcatgcctgggcccacccgtcttcccgtcttgcatgcccattctgtggactccctatatgtagatgctaacccaggaaacccctcagggccagtggtgcatggctggctcccttcctacagactgttcctttaaaaatttggggctttaactgagaagaaaattaagtaattttgttattttttccttcataaagctaaaattattaatcttcagagataagtactgttcagtgcataatgagttcgaattgttgataattataattttgaagagtttcagcttgctgtcagccaagtaattaaaggggtgggaccagggttctattttgttcatgatggttatgcttctggtaagaactctctctgtgtggcaaaaatgccctcattctagtcacatggtgcagtgaaagggttaattaaatcaagtaaagtaatccactgggttgtgaagagttctcttttcctagtttcccccctggccttccatctcttccttaagatcttcccattgtcttagcaaagctggacaccctcaatggtgcccgctctccactagtgaaacagatgcaggatgcctgggtcctgcctgagcccagggaagaggctcagttcctttccctctttcgcaactgcccccttcacccaattgcccatgagtcaccttaaaaaaaaatgtcttgcatatactagcactggactaaaaaaattgaaccaaaagaaaagaggaagagaaaatggaaaactaatgattcaagaaatcacatagcacgagataattctattttgaaatcacagcagtggcacccagaggcggacactccccaaattactagtgaaaaccctttgatgtatccagttgtaagaaagcccaaggcacttttttattattattatgagtgtttcacattccccaaaagaaacatttagcagtaatttttaaatgtctgtgtgtgagcaagctaaataaaatgaaataaaataaaataaatccctaaaaaatctccaaccctaaatgtgcttacttgatggctggcttttacttacaataaaagccaaggtcttacaatggtgtatgaggcccccatgagatctctctgccctcatctgcccctttatcttccctggctcattccactatagccacactggctcgctagctgttcagggacacactgggtgtgttccctgctcagtctgttcccttgctatattcccagcctggatgctctttcctgggtatatgaatggctcaatcgtttctttccttgagctgtttcctccaaagtctccttctcattgaagcgttcccttgccatgctgtataaaacctcaacttcccacttttgacactcttaaagggactttgcagatgtgattaagttaaggaacttgagatggagagattatcctggaccatgtgggtgggcccggtatgaaaacaaaaatccttataaaaaggaaacagcagggatacaaacagggaaaggagatgttacaacagaaatagaagttggagtgatgtaagttgaagatgaaggaagggtccacaagccaagaaatgcaggcagcctctagaaactggaaaggcaaaaggaaatgatttttttctggggccttcagcagtaaccagagcagttgacacctagatgttattagctcggtgagaccctttttggacttctgatctccagactgtaagataataaatctgtgttgttttaagccactgagtttaatttgttacaacagcaataaaaaactaatacaattggcaggacccagactcataagaccccaaagaatttgaccatcttggtccccggttcttctgtgcaatattcaaagtttctattttctgtcaggatttcctttctgacttgaagacagaggaaagaaacctttgcagtacatgcattctggtctccttttgtacctgaggccagctttcgtcactaggtgcaataaacgctgcattagattttgatgggaggtatggtgcccaggtgtgtttcaacacagttcagatgagggacaggggagctggggagaagcaaatgcagccctgccaggaacagtgcgctgctgtttatacaacagggtaaaggaccagacttgtcattattttaacccaagtagacagttctcgcctgtctaaggatgtgattgactggtggtatcttttcatggttatgcagcagattgaacttcagaagtcagagctcacaactgacgggatgtgtttgtaattggacctggtaagaactggacctctaaatagggaagaaagagcagtggagacaatcacattgtggccttttgctagttattcattcatagagttcttcctgttttaattctggaggattaaaacattaaagaataatttattcctatactctcctcagcccccgtgcgttcctttttccttttctgtgtctcttgttttatctttctctctctgtgtcatacttttccctgaccttccatttcctgaaaattgtctgtatttgtgagggtaaccttagtgcttgaaactttttccagctttattttaaaaagatgaccattttatcaggcagtctgaaaatccaaaagtattctctgctccaaatgtcctcttatttaactggccagcgaggaaaacccacaaattgccaaacaagaggaacaacaggaagcggtgatggagctcatttacatctgcatatgttctttatttaaaaccaggggaagtgctgagtggatgggtttgggaaatatggccggcattccggaaagggtggctgtgcacaagtccacacatcctgtactaacaggcggaaagggaacatcatggcatttatgtttccgtgccatcttttaatgtctgttctgtggcatcttcattagatcccaacatgacccacaaactgttaacatatcaaaggcagtagggagagaggtgtgaatatcctaaaagggcttctgatgaactatcgtattttcttatactctaaatacatggaacagagatgttgggataggtacacatttgggttttattaacaaaatagcagtaagatgtataggcagttggagatacccgttgagcctctatgttctaaagacaaatgttccagcctctcatggtcttttggtggcacaaaatgtttcctcctgaagaggtgaaaaggtgaccacagtggtccttctcactttgctctgcctctgtggctgtcatgggagtagagttggctatgacatctgccctgcattgatacacaaggctgattcagggtgggttgtcaggtgtcctttcattcatcatgaccctgagtatgtcccttctgaaaggaggcatacatggtgaaaaaaggggccttccctggagcagatttgtgaagcaaaacatgaaaccttattattggtccatagaatgagcccgagaggcccttgagatggtctttgatcctactcatattttaaggtagaaaaacttcaaagttttaaaaaaactcagaaaggctggaataattgttccagatctcagtacagttgagctacagttcactcagtcatctttcccacttcagaatctgcccattcgtgcaacctttgatccctccatccacccacaaacatttgttgaatgcccataaataagatccagtccatgcctcaaaaagctcatatgcacaggaaggatgggaatgtagggctgtggactaggtgttacgcagagatgtggcagctgaagggtgcacagaacagggagtgtgcacatcagcctgggctctgtggtggagagtggaggaaggcagggagtgatactcaaagttgcggatatgtcttaagagaaaaatagttgtttgccaggtgctccatatgtgggaagactctgtcctatcctatttctatttgcttttaaataataataacaaacaaaatttctattgtttcattgattctctcattcactcaaaatttgagggcctgagatacccagaggagttggaacacacaatctgtactcacgtggggacttgcaaaataatgaataaattaatgttctagaagttactgggaccagttttcatccaatgcaagaataacttctaagttcttctcaaccttgagatttgatgaattagaataacgaacctttgtctcgttatctcatgcaactcacaacaaccctgtaaaatagattttatgatcactgtcagttttataggtaagtaaaaagagacacaggaggggttaagaaatatgcacaagatttcatagccaaagggtgaccacatgagagccaaaactgtctgctatccttaaatcctaggttatttcttttgcattactttgtgttgcttatatatagttgaactcaataaatgacttcatataggtagggcaatttcttcatttaactacacttaataggagaccaaattagaacatttgttttgaattaaaatatgatctttaagacattcctattaagaagggcagtatgttaaacatagagttttagattatcagagctggaccttgtacaaggagataataactctcaatacaattatgtcattttctgccatattacagatgagagagaacacagttttaaaatcatagccaagaacgcaagtttccctactcctcccagtgttatctcaactaacacttactgctttttattatattcagcacctgtaaggatcataacccaaagaaaggaaaatgcagaacaattgggttttgatgagagtctgagcttcagaagggtttggaacatacaatgaaatttctcattccgtggttatttgagtgttgggatgaggacaccagcgcacaactgtggtaatgtctgtggtcaacagagagcaccaggtactagctggatttggtggagcccaagtagaactagacagagggccttgaatggtcatctaactatataaaacactcacctttgattaggtctgctctctagtcataattctgacctctgtggagtttacttaaaagcataattctcattgattatgtaccgagaattatgttctcataattctcattgattctgtaaggaaatgtcctatgcacatggttctagaaatataaattactcctgtcaatatttaaccaaaaaccagacttggtccttcaggtgccagggcagagattgctcatttatattgatgtgattttcactaaataagagctgtaatgtttgaggatcaaactgtccagtttttgaaattagctgctttttgaaatttcctctgaagtttgcctttttcattttcccttttgtttttctgctggtttcttctttctcctccaaagccgcaggactcctgctacattgctcaattctactttccacctccactgctgggcaatttcttccttcctcactcccgggaagaaataattctcctcttgacagctttcctttggtggtttgcatactcccctcatgtagtagtcacattataaacatgcacagatggcttcggaaccctgggcttattttctccctattgtggtacaaggcatttagcacctggtaggagctcaaaaaatattttaggaatgaatgaatgatggaagcaaacaaagaaggaatatttgcctctcattactaccatctggagactccaaggaggccctatggttcagtctactttctttcagtttaccactttgtgtcacttgtccaggtgattttaaataaacattcattcattcattctgtctctctctacaagaggatggacacgtaccacactcaataatggtgagattgtcagtgattttcgtactcttttcctttgagctttttggtagtttgacatttttctgcaatgagaatattttattttgtagttcaaaagtattagcccttttatgcccagtgttccattattggaatgctaagcttgtgggagttatttatatcctactactcaaggtcattgccaaggtctgattttttgtatacaaaaatagcaacctctggcacaaatgagttaacattagatttttaaaattatattttgtattctaaaaatgtttattttataaaatttagacaattagtaatattgggagaaaaaaactacccataattctgatacccacaatccattgctaacccgttcactttacttctagcctttttttagtgcatacattttgatatgtagttgtgatcctgttgaaaattgacatttttattttactttttcaatgaacatgtataaagtggttttatgttatatatctccatgaatttcacttttattgactgcatgctagtctttttaaatattaatatcaagtgcatggtcaactttagcatttcccaatatgtaatagcaacactaaagtgagcatttattaaatgcttgctacttactgggcagtgtccagaataaactggtaggcaaaatgaacttctgctctcccagaggatagaatctacaaaaacaaatttatgctagcgactcaatatggtaacagctttatagtgaacatgcagagttatgggaacatttgaaggaatgtagaatccaattttaagcaaggattagggaagtcttcctggaagaggtaacattgaagcctcgacaaccgtatcacaactgaccagggagaaatgtgagaagagttcaccttgggggaacagcatgtataatgggccagagggcagaggcatggaatgttgaaggcacggaattgtagtttggccagagatcattgtgggaggggatagagagagaaaaaggagagtaaggaggtgatcgaggagctaatagcggaggtgcatggggtaagatcatgaagaactttacatgcaaatttaaagagtagggattatgtcatagaggcttggaaaaatcactttctttcttttttttttttttttttttttttttttgagatagggtctcactctgtgacccaggctggagtgcagtggtgcaaccatggctcgctgcagtatcaacctcttggtctcaagtgatcctcccatctcagcatcctaagtagctgggactataggcacataccaacatgcctggctaggtttcaaattttttgtagagacagagttttgccatgttgcccaggctagtcttgaactcctaggcttaagcaatcctcctgccttggcttcccaaagtgctgggattataggcatgagccaccgtggcccagcccccatcaagaagctttaggctggagaagctgaaagattacattggcttattacaaagatcattctggctgggagtggctcacacctataatcccagcactttgggaggccaaggggggtggatcacttgaagtcaggagtttgagaccagcctggccaacatggtgaaaccctgtctctactaaatgtacaaaaattatccaggcatggtggtgagcgcctgtaatcccagcaggctgaggtaggataattgcttgaaccctggaggcagaggctgcagtgagccgagatcgcaccattgcactccagcctgggcaacagagcgagactccatctccaaaacaaaacaaaacaccagaaagatcattctggctgccatccacagatatatgcagggagaccatagagggggttggagcaagagatgcaattcatgcaagagatgtttgtcatttacctgttgttgtttttatttcaccatcataataaccatgagaggaaatttttatgcatagctatcttgagtactattttattagaaaagaataaaaggaaaatgcgagctgatcttagtgttacaacttgtcagcgtcacttgcaggctgagtttgttctcatgcccacctaccaagtcatttcagtagtacctgttggagatgcgtaaagggcaccttcttgaggatggctctccatagtatacgtggttcagaccagatttcatccagatttatgctgcatcatttgctgggatctcaacttccactctaagcctagtgccagttctgtacaaatgatttttaaaaatccaacataattaggatgattatatacaccttacagccatgtttcatggactccctgggtggaatgcatttgcctaaggtcaacgacattatttccctaaagggacagtcctattgttggacttcagataaattcctcactatttttcaagtgctccagtttatatgattccactttcttggccaaaattctgcttatggcatagtgttgcccattgtgggatctcaaagcacattcattatcatgtgctgacggctgttctgcaggagtggaaaatggaggtagagagaagtgaatgcaacggtgccagcagtgggggatggagccacgcccctgacagggggcacagtctctgaactcagcaccaggctgggaagctttgccggggcctccctgtgctcttttggggcaggccactttggagacataacaaatataaccagggtagagctctgccagaaagcaacagcggggacagtgatggaaaacagatggaggcgctggccttcacttggtgagaaatccactgagggaatggagaatgtttgcaaaatctccgagtgctattgggacacctcttagtgcatttacaaggcgccagcctctgtttgccaatggtttagtttggttttgatgagaccaaattaccctttgaattctctcgaaattttgaacatttcccaaattttgtttgactcaccagctggaggcttggaattaaaaatccagcatgagtgcctgagaaaaataagtgaaatcttgccttattttggaggaatggttaagaaaaggtgcttgtagctgcctagcttgtggttggctccccacattgtgtaattcttagcctggaacaaatcttgagttgtcattttgtattttctcctgcttctacatagggagggagggctctgcctccccaaagtatttcggaaagatggtggactcttctgatgtaagacttcagaaaggaaggcacacaaccttatttgttcttctgattcatggataaagggttaaccatactgtggctttttgtagcacatgcagtttgaacatagctctatattcaacatcttgtggtgagaaggaaggacacaaaaaagagttcatctcctttctctgggggactctgccctttctaggtgagatgatggtgtatgactctaggaatatagataagtgtccttacatacaaagcagtatgattcgctgtctaggggaaagatacaggggaattgaatgaggaatgattctgcattcttagtctctaagatgttgaacctatacaatattcagtaagtagttttgattcttctgtgatgcccctatgcccacaaacatcctcccatcatctcagcctgaaaacaccattcctgcaatcttcctcctttccctctctcttgctctcatgccaccttctttgttttgctgctaaatgctaaaagaataatttagacttgttgcctttcctctctctctttcctgctctcccttccttctccacttcttcactcctagtcccctgacttccttcctcctctctggattacagctgttctcctggtcagcaatccaacctcctcttcacattctttgccttactgactctttggatgagtcctggtgattccagaaccctctgtctctgagcttttatgccactctctcgatgcttctcacatatctctatctgctccctttctcttcttctcacatcccttaattgtgaccttttttcaagattctgtctttgagccctttctttcttttcgacactcctagccaccatgggatctttagcatctctcctacatagatgcctccatttttagctttccagctctgacttttgcatgagccacatcacatctgtattagtctgttctcacactgctaataaagacatacccaagaccaggtaatgcacacagaaaaagaggtttaatggagtcaccgttctacctggctggggagacctcataatcattgaggagggcaaaaggcacatcttacatggcagcaagcaagaaagaatgaaagccaagtgaaaggggtaatcccttacaaaaccatcagatcccctgagacttactcactaccatgagaacagtatgggggaaactgaccccatgactcaattatctcccaccgggtccctcccacaacacatgggaatgatgggagttacagttcaagatgagatttgggtgaggacacagccaaaccatatcaccatctgattctcaaactaaaaaatagtataaaatttatctattttatttattgcatggtgttcctttttagaagaaagctccccaaaggcagggatgtctgtctgtgttgctgttctatcccaggggcctaaactagagcttggcacacagtattggctcaccaaatatgtgttgaactaatgaatgaatgttacctacatttattgagcacttgcctggtaaagaaaatttctaataagatgattatctcacatcatcctgacaaaatcctatgaggttagcccattcataatacaattttgcaaacaaggactgtgaaacaccaagaaggcaactctcctgaggccataaggccatatggctggtgagaggcagaatgtagacttcaaacccaggcagaatgacctaagcccaagctttcaagcactaggttgtacttggaggtgattgatctctgccattgactagctatatgaacttggacatgctttttaagttatctgagcttcagcttcctcatctagtgaaaggacattacctctgacttaacagtgttatatctaagaactttgcaaacagtaaaatacagcattaatgttattcctcaaataaggtatcactaatatttatgagaaaaattacatacaaactctattaggacttacagagccacaaaacaaaccagaaaccaaccaaacagcaacaaaaacaacaaaccacaaattatgaagttatggtgctatacttcaaggaatgcccatcctttctttttccctcccttccttccctctctcaaatatttattgcaaccctacaagtgctgggcctgggctagagataaaaggataaaaataattagttgagattaagaattagtaattagttgagattaagagattgatttatacttctgataagggaaagaataatgttgactggagttcttgtggaacgctgtcatgagagggcctggaaaaggagtttagaagactcaagcaacagagaaaaatggaagaactatattcctctgtgttctcctcttctgtgtgtaagatttgtaaccctgagaaaactggttgagccatggcttagctggctgcccgagtcatgggccccttaaaatcttcacttaggtccccatggatgccagagagggctttaaaggtgactgctagatcaccagcctagataagaaccaggggaatgggaaagtggctaggaaaggagactcatatttgaattggagatgtcaggatagtcaggcagaggcatctgcagttatgcagcagagtaagaagaaaaggagagcgaggcttcataagcacttggttctttggctgagggtctgaagaaatcctccaagacatgtggcatccgccacaactctttgcccacatccaggcccttccctcttgggagcctgtcagaggggaaaagcaagtggctccatgtgtctctgcctttgtggtaacttggcttctttgctggagggatcagttgagcatgtcttcaatacattggtctggggaccttctggttctctaaagctgacagatttctgctcctttttggacttcctaaggttccatttaagttttacagttaagggttgacataaagacatcagtccagagtctgaatcttctcctgccttgtttaagacctgctacaagggctttctgtccagaagagctttagttccatttggggaaaggtagataaagctgggtgctgtcatttttttttgagaagtagcttagtatggacacaagagctgtactctgagaataaggagtcttggattctagctcctgggtttgtttgtgtgacctggaatatgttctgtcccatacgttctaggcttcagtttcttccataaaaagtaggagttggactaaatggtatctaacaccagtttccatattaacattctctcatctttggctggggcgtgtatgtgtgtgtgtgtgtgtgtgcgtgtgtgtatacagatttttctggaaaagaaagattaaggatacgatcccatacacactatcatcaccatatgtgcgtgcattcctgacatggctatgggccccacccatgccatatgctccccacactttgtcagcctggctgtcctttattgcccatcatagctcagcctgccacatgttcctgtgcgcacgagatgcactgacacaggctttgtgaaggctgactccatgtcttgttctcctcgctgcttcttgaggaatcctaaatccagctgcaacctccacacttgcatggctttgtagaaggggaaatgtaagagtaggcttttaatcagctcacacatattttgtgaggcaaggtctgagagggctttgtgaagccgctattcactgcatcatgttgtgggatcaagcctacactttgtatcatatggaaacactgatagtgccagataaatactgagacttaggaagaagcatactgtacttccaaccatccaaatcgtggcagaacctgaggacaaagcattcaactaatatggcagaactctacaaggcaggactgggatggaagtttcggaaaggaaagatttgtgactctctgaaggtggttcacatgacccttgctgtggagggaaatggagtgccacctggaatcatgcttcccctgtcctgctgaggttcgtgtggatatgtgtcaaatatttttcagagattttaaagaaattaaaattaacacttgattcaaccctcagatctatcacttataatgcggcctcggacaggccatctaacttctttaagcttttttgtcctaatctttagaataatatattacctactatgctgccttttttcccaggttagttatgaaattcaaagaagatgatgtttgtaaaagcaatttgtaaacaataaattaaccagtggttatgtgctcaacactgtggagcctttcactccaaataaaaacaaatcaaaacaaaaaccacctccatggatatataggcaattttgacatgtaacttctaagggtctgcttaacaggctcatgtgtcagaatttgacaatccatgaaatagagatcaagtagtcgtaataatatcactgccttcatggcagaggctgcatatctgtttctcctattccacttcatctccccagtgctcacacatacaccctgttggtttgtagttagtgaatgattaaggaaatgtgcgtgtgcctgtgtgtgcttgtatgttgtataggtgtgtctgcactgcccattcttgcatttctatcttttaactgttatggatgtataagcactatctatgatggacgaggcatagtgcatctcctaggccggaaatgtttcactcactaatgagctggacaattctactctgtgaatttaactttcctgactcccttatgcaggttaattttggtaacatatcatattttactctggcttggtgggattaggtgggaaattacagattgcatcaacaatttggtctgcctggatacaatttggtctgtttcagtcacagcctgggtcacacctgttgatatatatttttaaactgattcctctctagatcattctttctgatcagcacaaggcaatatgctgaaatttctcttttatatctgttttattagcatgtctttcaagtgctccttaatcttccaaagaaaatggaaagagttcttatattgtgctacagcctttgtattcacttggcaattgccaacttattttaaaataaacttttaaagtgaactatgacgtatctatacaatatgcacaaatcatagtatacaactttatgaattatcatgagctgtcaccacccagacaaaaaaaaaaatactggcaatggcccctgccccccacaaactctctcatatcgcaccctaggcactacttcttcctccataaaggtagccaacattcagacatcatattctatggattagttttgattacttttaaattttctataaatggaagagtgaagtatgtatatttggggatttttgttgttgttgttcaatgttaaacagtattccaaaatattggagttcaatgtattagtctttttccttatggttagtatttttgaagtcctgtctaagcaacatttgtctactcaaaggtcatgacggtattatcctgtgttatcctttagaagtgttgtattttacattcacatttagaactacagtacacctaacatttttatatggtgtgtagtaagggggtcagtaattattttttcataaggatatctgaaaagacctgacattcctcactgcttttttcataaatcaattgtcttcatatatgtgaagttgtcttggactctctattctgtcccattagtattcttgtctcttctgggtcaatgcccttatctgtcaatgactacagttttataataatgtctaatatctagtcatgtatcaaaaccatattggctatccttggctctttgaatctccatacaagttttagaatcatatgtgtcctaataataacaacaacaatgaaaaaagatgatattttgattgggattattttgaatttataggccaatttgtgaaggattgatatgtttgcaatgtgacatcttctaattcatgaccatgggaatgttcttccacttatttaggtcttctttagttaactcaataataatttttagtttttcttgtgtgtgtgtgtgtgtgtgtgtatgcatgcatgtgtgtggcagtcttgtacatatttcattatatttatatgtatatgatttttcaaaatagtatggtaatatgatttacttattttttgatgctagtatataaagattgaaataattctcatatgtttattttgaagccagaaaccttgctaaattcacttatttattctaagagtttctagagtttttggttttctgtacacaaatctccctgtaataatttttttctttatacctattccttttatttcatttcttatcttatagaattggccatgacctctagtacaatattgaacataaatggtcttgaaagatacccttgtctcattttcaatctcagcttttaattttattatgtctaatgagtgctatagaactgttatcattatcctttatcaattagaaaaggcatcttttcttttgttatgagttttcaacatcaatgggtattgaattttgtcaaatattaaatattttgtgcctctgtagaggtgatcatttgcttttctcctttattatattaatgtgatgaattacattgatcattttttaaaatagactttattttaggaagaagtttcaggttcaaagcaaatttggacagaaaatagagtaacttcccagatactccctgccttgacacttggacagcctttcacacgatcagcatctcacaccaaagtggtacatttgttacaattgattaatctacattaacacattattatcacccaaagtccatggttgacatcagggttcactcttagtggtgtatattctatgggttttcatagatatgaaattacatgtttccactattagagcatcatacagaatagtttcactgccctgaaaatcttttttgcttcacctattctatccctccctcctaactattccctggtaaccactgatctttttattgtctccatagtttttccttttccataatgtaatataaatggaatcatacagcatgtatccttttcaaattagctttttttcagttggtaatatgcatttaagtttcctccatgtcatgttatcacttgatagcatgtttccttttagtgctgaataacattcattgtctggatgtaccacaatatatttatccattcacctacttcaattttgacaattgtttataaatctgccgtaaacatctgtgtgcaggtttttgtgtggatgtaagttttcaattcattgggtgaataccagggagtgtggttgctggatggtatggaaagagtatctcttgtaagaaactgccagattattttccataatggctgtaccattttgcattcccaccagcagttattgagcattccttacttattttccacctgtatatcttctttgataaagtgtctgttcaggtcttttatccatttttaaaattgggttgttcatttggttattattgagttttaagtgttttgtatattttcgataacagtcttttatctattgtttggaaatattttctcccagtcttttaaacattaaagcaacttgcagtcctgaaacttacccaactttattgtgttatgtgaatacacattgccacatatatgaacacaaaattgaactgttaatattttgtttatggattttgaatctgtgtttatgacaaagattgtcctagaatttttctttctggtaatgctcttattaaatgtcagtataaaattttactaccctcataaaagaagttgaggaattttcttgttttttctattctttggaagagttcatttaatattggtgttatttctttcttatgtatttggaaaaattcatggctaaactgtctaggcctggagttttctttgtggtaaggcatttaattacagatttaatttctttaagatatatgactattctattctttattatacctgttttgttgtatttttaaaagatttttaaaaattgatttaaatgtcaaatttatttgcataaaattgttcctagtatccttttatctatttttcaggtactatattgatactccccatttcttttctgatattgtaatttggtaccttttctattttactcttgagcagtctcattcctacccccatcccagaaattataattttataagtcttaaaaaagttttggctttgttggctgttttaatgtacatttattaatttcatttattttctgtttttactgtttccttcattccagtttgttggttttattttctgttccttaatttcttaggatgaataattagatcactgatgttaggctttcttcttttctaatatatgcatttattgatatatatgtctctaagcgtggctttagctgtatcctacatttttttatgacatactttcatagtcattcaattcaagatcttttctaatttctatgctgatttttttgactgttgagatatttagaagtatgtagcttaatttcccagcacttaagtgtttcttagttatcttttgttaataatttacaggtaatttcattccggtcagagaatatacttggcacaatttctgccttttcaaatttcctgatacttgctttatagcctggaatatgtttaatttgggtgaatgttctctgttgtgcaatgtctttagtcctcacgtgcagtattcttcatttgcgtgtgtgtatatacatgtgcgtatgatcaagtttgaagattgttaattatatttttcaaatcttttatttaattcctttttgttatctgcttcttttacttactgagagaagtatgctaaaacctcccactatgattgtgaaattctcctttttgtcccctatagttctgttgatttttgtttcatgtgtttttgaacttatacatttagaatttctacatcttcctgaacaaccacctcttttgtcattatgaaatattttccctttatttttagttatggtccttgtcttaaagtttagtttatttggtatttgtaaacatacactttctcttatggctagtatttgctttgtgtagtttcttttcacttctctactctcaaattctctgaaggcttttatttaaaatatgtttcttgtaagcagtatattactttgaaatccattatgaaaaccttccttttaatggtgatatatagactatttaacaattaatatagtgacatcttaactaacatttaatatagcttccttgtgacacagccgccctttttctaatagtctcaattatgtctcatttgttaaatataccaattaaattattagtttaagctatcgtatgtttcggccttgaatttttatttgactctgttgtatagttgtcatttcttttctaaattccttcatttgctgttttgcatctttagaatatatgtgattgatatgttccagtccgtggctaataactccaatatccatttcttttgtagcttgttatctcttattgattgatggtttggatctttgggcatttggttttgtctcttcgtatgccacatgatatttcatacttgacactgagtacaaaaattataggaaaaaacttgaggctctgaataatgttatattccttcagagaagacatattttgtttctgggaggaaggtctggtgggggaagattgccttagtccagttagggatttattccatgggaaactgggctgcagacttggtgaggacagatctatttccagttgcccttccacctgtgatgtagtttttcagggtcctcgctgaaagtctgggatgtctacctggaccccttctccttggcatatcttcagtctaattttgtccaccaagacttataagactgtgaagtttggttcagctactcagcctcttcattgcaggttgagaattgaaaattgcttcatgagagacagtagcactgaatgtgggactcaggtctccacacgctcactctccccaagatcttatcctctcaggtcgtcactgccttagtaactcactgaggccctgacgtaagattttctacacatatttagctcagcatttttagtttttctcagtgggagcattggtcttcagccagctagtctatctacttcactctcactctcatcaaattattttattcacactttacagatcttgaatttgaggctaaatcatccacattacaaagacagaaacccagccccgccatgctctcctcagtctgtctaatcataagacataaaaagctaagcctctttctactcaggcccctatttcatgtctcattctagggtcagttgtcaaagaaatcttgataagaaagtattaattcttaaggggaagctcttcctcatggataactgcattttattaatagagctgttttgaaggcctacagcctttgatggaaataactattttggaagaatagaagtgaaaggtttgctgttgtttgcttgggtctcagtaatacccctggggcatctacccctacacatacagccaactttgcctttgaatctcccctctccatctgaagtctttgttctttccaatggatttatagcaatttacttcctcatgaaaaaagaacttgcattcctgaatctctgcaatgaactgaagaagctaactgtacaactcaatcctgcccacaagtgggcaaaccaacaaaaccctttgagaaagttatatcctattttatctaataatggtcaagatgcaaaagacgtgaatgtcctcttttatagcaaggacaaaaaactccacgaagatgagtgtatttaaaaaacaaaattgaggccaggcgtagtggcacatgcctgtaatcccagcactttgggaggctgacgcaggcagatcgcttgagtccaggagtttgaagccagactgagtaacatggcaaaaccctgcctctacaaaaaatgtaaaaattagccgagtgtgatggtgcacacctcagtcccagctacttgtgaggctgaggtgggaggatcgcttcagcccaggagatcgaggctgcagtgagccatgattgtgcctctacactccagcctaggcaacagagtgagactctgtctcaaaaatagtaataaaataaaataaaataaagctgcttattagttgtttgacctagacataaattcatttaacttaccatagccttgatttcttctctgacaaaatgggcatagcaatcataccctttcataaggttgttggctgggttgtatgaagtcattcatgtgattattgattaattgagtgatttttcagatttcacaagagtttgaaataaaataattaaaaattaataaattttgttataaagggaatggcactgtttcaaacttagctgctgctattgctgctgtttggtaataaattctagtccccttttgacttcgatcaaaatctgatgccctaactcagctagaatgagttttcccattgcccatgtgtctatttttgttaaacggtggaccctaatcaaccgaggaggtgtttgttatagaaaaccaatgactaggaatcaccttctcagatacagaatatgaggccccaaggggtgaggggaggtgtccatggttactagacctgggggtctcctgacttctaggctgcgagggaaaatatcacagagtatgctctgattcctagagggccagaggggctcctttgtgatcccaagttctggttcaccttctatatggagttgtgttctggtcttaagggacttacccttccattccatcactttctgccatcaaaactttcctttctgttttctaagacaatatcaatggctgtggatattgaacaattgtctgataaaagtgatttttgacattaaggatctaagtgctcatatttgagagtctgatctagtgaccctcatgaataacaatcacaccttacttagtactgggattttccctttacagttgatgtttacttacatgattgacctgcgtaacagtttaaaacaggtaggaccacgaggtcaggagattgagaccatcctgacaaatatggtgaaaccctgtctctactaaaaatacaaaaaaaacaaaaaaattagtcaggcgtggtggcaggcacctgtagtcccagctacttgggaggctgaggcaggagaattgcgtgaacctgggaggctgagcttgcagtgagccaagatcgtgccactgcactccagcctgggccacagagcaagactccatctcaaaaaacaaaaacaaaaacaaaaacaggtaggaccacaacagtaacaataactgccattcatcaagtgtattttgtttgcaaaaatatcttcactttcatttcttatttaattcatatgctaatccttcaaagtgggtgatatcattacccatttaataaaatggcaattgcagctcagaaggcaaagaatgtgctcaggatcataaagccagtaagtgatgtagagagattttcaacccagtttgttgattaggcaaaacagtagtcttttcacggcaccttactgtctttcccaagttatttctccaacctgtacagagagattgtgccttgactaaaaagcgccagcaagtttatgatgggtggttgagtcaggagtagagttttaatcttctaaaccttaacccatctctctttctattgaccatacacttttctccccattagcatctcagcttttagaaatggacattttgtgaacctccccattgcattgcatctcagttgttgtatttgagatgctggaacgtggagatgcaatgcagtgaactcaacaatccaaaatagccaatccaaaattttggtgtctaaagagttaccatttccactataacagatcgccatcaaatttacttaatgtcaatatcacattatgtacactttaatttccaactcagaaaaaaaggtctagatctgtttgtggctttattaccaatgtcaccattatttttgagccattagtataaggagttcagatgtttgagttcctagagtattaaataagagagaatttagacaaccttaattttttttctttttttttcttttttaaccattgtcatgagacagactcaagttcaaatcccaactcagtcatttattgattgtgtggacttggccaagttgcttaacctctgcgtctcaatttcttaacttttaaaatggagataaaatctaccttgaaggattataaggaagaaaggttatttgtaggcagtacttggcatgcaaaagctataacttactaataataattattattttatttatttatttatttttcatatatattttttattatactttaagttctagggtacatgtgcacaatgttcaagtttgttacatatgtatacatgtgtcatgttggtgtgctgcacccattaacttgtcatttacattaggtgtatctcctaatgctatcccttccccctccctccaccccacaacgggcgctggtgtgtgatgttccccttcctgtgtccaagtgttctcattgttcagttcccacctatgagtgagaacatgcagtgtttggttttttgtccttgtgatattttgctgagaatgatggtttccagcttcatccatgtccctacaaaggacatgaactcatcatttttatggctgcatagtattccatggtgtatatgtgccacgttttcttaatccagtctatcattgttggacatttgggttggttccaagtctttgctattgtgagtagtgccgcaaataaacatacgtgtgcatgtgtctttatagcagcatgatttatattcctttgggtatatagccagtaatgggatggctgggtcaaatggtatttctagttctagatccctgcagaatcaccacactgacttccacaatggttgaactagttttcagtcccatcaacagtttaaagtgttcctatttctccacatcctctccagcacctgttgtttcctgactttttaatgatcgctattctaactggtgtgagatgatatctcattgtggttttgatttgcatttctctgatggccagtgatgatgagcattttttcatgtgtctgttggctgcataaatgtcttcttttgagaagtgtctgttcatatccttcacccactttttgatggagttgtttgtttttttcttgtaaatttgttggagttcattgtagattctggatattagccctttgtcagatgagtagattgcaaaaattttctcccattctgtaggttgcctgttcactctgatggtagtttgttttgctgtgcagaagctcttgagtttaattagatcccatttgtcaattttggcttttgttgccattgcttttggtgttttagacatgaagtccttggccatacctatgtcctgaatggtattacctgggttttcttctagggtttttatggttttaggtctaacatttaagtctttaatccatcttgaattaatttttgcataaggtgtaaggaagggatctagtttcagctttctacatatggctagccagttttcccaggaccatttgttaaatagggaatcctttccccatttcttgttttttgtcaggtttgtcaaagatcagagagttgtagatgtgtggtattatttctgagggctgtgttctgttccattggtctgtgtctctgttttggtaccagtaccatgctgttttggttactgtagccttgtagtatagtttgaagtcaggtagcctgatgcctcctgctttgttcttttggcttaggattgacttggcgatgcggactcttttttggttccatatgaactttaaagtagttttttccaattctgtgaagaaagtcattggtagcttgatggggatggcattgaatttataaattaccttgggcagtatggccattttcacaattttattcttcctatccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcttgagactttgctgaagttgcttatcagcttaatgagattttgggctgagacgatggggttttctagatatacaatgatgtcatctgcaaacagggacaattagacttcctcttttcctaattgaatgccctttatttccttctcctgcctgattgccctggccagaacctccaacactatgttgaataggagtggtgagagagggcatccctgtcttgtgcccgttttcaaagggaatgcttccagtttttgcccattcagtatgatattggctgtgggtttgtcataaatagctcttattattttgagataagtcccatcaatacctaatttattgagagtttttagtatgaaggactgttgaattttgtcaaaggccttttctgcatctattgagataatcatgtggtgtttgtctttggttctgtttatatgctggattatgtctattgatttgcatatgttgaaccagccttgcatcccagggatgaagcccagttgatcatggtggatacgctttttgatgtgctcctggattcggtttgccagtattttattgaggatttttgcatcaatgttcatcagggatattggtctaaaattctctttttttttgttgtgtctctgccaggctttggacaaccttaatttcttattatgctcactacttcttgtggctgagccaaaacactcatgctacaagactaaatcagtttctggagtttagaagtctttagtgctttcttctactttattgaattagttcttcattgagagagagagagcatatctaggaggagccagcctgtcttggattgtagtgatattttgaatggttcctttacttgtttttgaaagctcataaacccctgttaagtagactaggtgtccagaccttcatccttgatgctggctcaggcccatctgtggagattgacatggctttaacttcatgatgaagttaatttcatcttttaacttcatgatgaagttaatttcatcatttaacttcatgagctatagacccatcatagatccatcgatccagttttccttccaggccccacattaactgtgccaagaccagaaaacacagagacttggcctagacttttttcttggatactcctttcttgtgagattgccactggagctcagcatcttggcctctccctatgagatacagtgggggtgaatgaggagggtaaaccggctgaggatgcaaaaaagagaatgactcactagctgtgcatcttagcaaggcatggaacttctagcacgtggctgctggcaaaagctcaaataactgtatatctgaacaaagaaaccatattcaggactgctaaatcccagcaacttaaggctctgccaggcaaagcaagagaaagaaaggggaaggatttgagaaggggttaattgagggtgaggtaaagaagttttactctgttatcatgttgaccaatttgtatccatttgcctttctcctttgagtcattgtcatttcagttgctgagaagtggactgaaaccttgctgttagatgaggaaataaccctgccaattatacacacacacacacacaaacacacacacacacacattccccacactggcatgccactgcctttttcaagataggaggaatcccttaactagttatttcatcatgcatgaaaaaccccaaagtaaaaatgttggagaattaacaaaaaaaaaaaagttacagccgccaagccaatgttgcattattttctcaaaaactcatgatgtcatggacttagctcacctttagtgcagccatgcgaataatgtgtactgagctttctatcatgtaccattataattagctctgtcaggtcttagccctgcaaccctcatgcagataatatgataatatgtcttcataaccaagtgaccttacatgcacaatatttctccccttatgaagattgcatgtcaataaagtaattgagtctcagaggctgcagcgagggaagatttaggtgattggacgtggagagcagtgatgtatgatgattattattcctcttgtcagggaggcgcgtacaagcgaggatggccagaagatgacagggatgacgggttgcgtttcattaaaaaaaaaattgctgttaatcaccactctattcttttcaaagtcactgaggaaagaaactcttttttcattgtagctacaatgaacatccccaaatgggagcacatcgtaagatttttagcctcagtcccctttcacagtgtctttcttctgttgcaaagaggctaaattaagattttaattaatagatcagccatgggggcctgggcaggggccacccagcttccctgctgtagggctccttgggtttccaaatgcagaaaaggcgcctgccgagatggaattgcacttcctctcctctctgcgttgagagaagtgtgctggtgagctctataaaaagaaagcaaatgtgagagaaccagatccgagacaactatttttacttgaattaatttgtttggacagttttaacacttggaacatttatatttccatactttataaaagcaaacatgctgtttctctagctgtaaatttatcttatgatatcataacagctggaaacttgtagcctggtaggattttgtttcatatttaaacagcttgagaaatatgtcggaaacaaggtatattttcccccatctctgtgtgttttctcctctcgtattaggctaccttaggagtgtcggcagtatcattcagaagatactgaggctccaggatttttattagcctggcattgttaattgctgctcccttgcaaacctcttcctataaatgctgagaacacactggagccccttccagaggagttcaagaatcttttcaaggggaaagaaagctaacagtaaaagcatcttttgttggcagaggggcttctgaagtctttaaatctttgttcataagtaattgactaagatctaacagccttgaaggaaaggagctgatggtatcactttttagtcatagtattaaccttgtgatttatggtacaaaattagccactgcatcctctcattacgggtgctgagtgatttctccaggcaggcaggagggaattgagagctggatttttgtctcctggagctctactgtttcctcctagggaaccacagtgagtgtttttagggataggaatattgttttccttccattttctctgctctgtaaaagaaaatatcaaatgtaagtaaataaataacctaagggagctagaatgttcagaggaaatgttaacccaagggtggtccaagggtggcagtatagaatatagagtttcagatagggtcagtgagtgatttcaacctcctaattgtcccacaaccccctcctctgcctccacaaattcaaggccaaagctttctgagtattttttccattgaatagtatctggagtagagattatatccatttctccatctggatagttttttcctaatgaattaaaaaccacctaatagacttcagggacactaggaagactctgatgatttcaagaattcataatccttattctatgctgacattgaaattttacaagtggagctttatctctacagttcaaggctttggtttctggtgaaaaatatgtctctccctgggaggaagaagcagattaacctattatcagttatttacatctgggtggaaaaaaaagatctaaatattttctgaatgctttaagtagagaacaagcaagataataactaggtgcttggggagtgaatttacgtgtttgaggcgggctgatgcagagaggagcatggatgcgaacgggcccataactaggagctttttgctgttgaaaagcaactttgctgactgcacagtttgtgtgagccctcctacagctcagttctctcctcacatcagcctgcttccctgggtgacgacagtgttaaaagcacagacttcagagttagactgcataagttcaaatcacttctctactacttgcaaattctggggcttgagaaagtcactagtctcctgtatgtagctcagttttctcatttttaaaagtgacaataatggtgccttgctctagggcagttataaatgtaacatcctcataataaccaataataagagtataatcagtgctgcctgttgttattatcccagtggatgataacttagacctatgctggattcgttgtcattggtgatggtggtggtgctgtggatgataaagagatgatagatcctgatatggtttggttgtgtccccacctaattctcaacttgaattcccacatgttgtgggaggaacctggtgggaggtaattgaataatgggggtggtctcccgtgctgttcacatgatagcgaataagtttcacaagattttatggctttaaaaaacgggaatttccctgtacaagctcccttctcttgtctgctgccatgtgagacatgcctttcaccttctgccatgattgtgaggcctccccagccacgtgaaactgtaagtccaataaacctctttattttgtaaattgtccagtctcaggtatgtctttatcagcagtgtgaaaatggactaatacagatcctaaatatagcaagtgtactggtgcttaatttccctttgtaaaacttgagtcctggctgattatctccaaactttcccttgacttctttccctgtattttagttccagtgtgtataaaagtgaaagctgaactttctgaaatgtcgtgggtgtgggcctgggggtgctgctggtgtggtgctcctttactggctctgtcttgccatagatctccacagagccctgagctgtagggctgttgatgacaaaaagagaacataaaatgctagaggaaagatcattctaacacggtgcaaatccccaaaccttccctacaatttctctgtctcccatgcctcacccaaagcaacatttggcctagaagggaactttgagatgatctggccccatgcctttcacactgagctatgcggaattctagcattccaatgagacttgtcagaggtgcagggggaacaagtggtgacccatcagggtggagctaacagggctcccaaagctggcttccaaatccatttttatccattcaatacactggggtctaaaggaaaatatcatttaatgaaaaaattttattgtctaatgtaacaacagaaggttcaagcatcagtgatctagtccatcttgttcattttacagatgaggcgcagaataggcttatcactggctcatgtcactgccagttagtcatggaccctagccttgaaattgctctttggaaaccccactgtttccagtattgtgtctgcatagtggcttccacgggccgagggctcacctcattgccccctccccacatgccctagctggtctcttgaatgactatagcactagcatgtggtggccatgtgtgccaccagtgccaccaccctaatggcagctgtgattatcagcacagaggcccaggaagaaggacagaatggactgctggcggatgaattgggaggggagggaatgggcagaagtggagccacattgaactcagaagtataagtgaagaacccactataatgttgcatggggccttgttcagcaaaggaagattgctgtctcccagtccagtgcagctgaattaagtgatctggccagggtggcagtggggcctgtgttccttctcacaggtatctgtgttaatgggcacccctgcctggagccgccagtgtagctgcttggatttcttattcttttatttccatcctgtctccttgttttctgtcactgtgtcatgtcaaatcattgtcaggtggcagacaccacaccccccaagtacaaaggtatcaggtttcaggacacaggctgaaatgaatataataatgggagccagaacgaggcacagaccacttagcaggcaaggaaacagctaataagtgttgttagtggtttccatggggaggacctggcgtgcatttcttggacaggcaggtggagcacggcctgtcctggggtccagctacagacaggcttgtgcgattagtattgatgcctgtcactttgtggctgccaagctgttgattctgtgaaagaccaaagactctggttatctggtaatcaacactgctctcaggaacgcactggggaaacagaaataggctttcctgagtattgactgaagccatggatcatgttgctggtttgtgttttcctctagccccagccctgagattgctccagcctgttcttcacctgcagtgccaggtaaccattcttatttgtcatgggatcaaattctaaccctcttagagtgagcccatccaaatgctctgactcagctgaacactgatgtaaccagggtgacttgggcgacagcataggaaataagaatgcatttgcatgtcaaggtggaaattcagtctctcacctttgacaaattcccacacctttgacaaattcccaaatccaaatgcatggttgacgcttaggcttcttcttatcccactccacctcacctttgcttttttaaaggctctttaaaaatataaacattaaaatccaaaagggttagtaacagaagaataaaaaatataattcgttttctctcctaattcattttcttggtaactgttgccttctcatatcctcttctttctttcttttttgtattcaagaactttaatatcttatttttccaaaacatcaatgtcctgattatagtgaaccttgaacagacatctcctcctgcccatggaaaatgagttctgacttttcttgggttttgttaagttttaatctctttttttctctctctctttcttatttactctctctctctctctttaattttcttcctttctctcccctcctatctcttcactccctctttctctcccctttttctcccactccccttcccaaagctaaaaaatgctgaaacatgattgcttctttctttcttatgtaaggagcaatgggaactgaggttacacagaatgtgtcacaaactggatatcaccacttagctaacccataaatccacccacttacctacccacccatcagttcatccatccatgagtaccttaggccatccactcatccatctgtccatccatccattcattcatccatccatccaataagtgccactgagcatttaccattggccaggctctggcaagatgctcaggatacaacaataaatgagctttccatcttcaaagagctcaccatctagaaaaataaaaccagtgctggatggtaagtgatctgtgataaatggtatggatatatgtatgtgtgtgtgaatgtgtatacctacctgtacacgcacacactgccacccaaccattaagtgtctgcttggcttttgagttgtattcatttgtagattaatcaaacaactcttcattaatgccagtagccaggcactgtgttaggagttgggtttacagaggtaattaagatacagacccttcttattcttaagtttctcatgaaacacagcctggattatccttccctcccaccctgccacgtttctgccccataaactagaccattctctggtaatctacttagttttttagataaactaagaataatctatatgacatagtccttcccagtacttaaggaagggaaagtatcattgaatatatcacttgcaaaggagcttagagattatcggcccaagcacatctctttgtgaatgagaacactgaggctctggaggagatgaagtgacttctccaggccacacaggaaggcattggcagaactataacttggccttgccaagatgtggcctttcagtccttcccaatgttctcaccccaagtttctctttcatgaggccccagaagctgcttagattcagacaggccactagaggctgatgcagtcatctgaggccatggcatgttacctctcagagcagaagggagaggcttccctctgtggaggggactgagaaggctacccatgactctgaatcaagagtggttttataagtcaagcactttgtcttcctgctcttcagagaagctaaaacaagaaataaccaaaaggagacaatgtctgggtcagcaactgattacatttttgatgtcacactgccttctgggttgggagaagttgaaagacttcatagaatcacccccgctcatcttattcttggtgaatactcttcacacaaatgtcccaagtgccatgctcatagaggggttggtgcttgggtcatcagtaccttaggccatagcagttctcagaagacattatccagaagcaaaaagccattatctagaagcaaagttcaggaatgaagattcggtctctcataggtcctgctaacacttatctttctggcaaaggataatgataaaaagaccgaacagatgacaaaaagaaagcctacattccagatggattgtgagggttagggagaaactgggctgaagcaaaatgctttaatttttgggatattggttatttccccagtttttactttaaatctgttgctccagaaataaaaggacacgctaggctttagttatatgaaaacatgatattggttctgtatgctgagaggagccagaggtgggttgagagcccagctctgtggtgatgggccttggaaccatgtctctgatgttctcatgtgagaagcagatgagtagaggttggtggcagagttagtgaaatagaggctggctcccgcttcccacagtgctcagggacaaatgtggagtatattaataaatgcagagtcattaatgctttctgtgagtgaaaaataagtgtgtgaagaaaagactccattgtcattggactgtaaatggtgaaagggtggaaaatgaaaccaggcttgtgttgccctcctaggatggctgtgatgacccaggccacttggggttccacatgagccctgtggaatgtgggctgggccacctgcaggtcaggctgttcatgctgttgccctcaccttctctacgggtttcaaagtgaacccttgtgcagggaggtgtggcactccctgtgcctttgcttctcaagctgctgagtgacagtgacaagatgctggctttggagcaggcactacaggttcctatgcggagagcatcggtgctcagggaagggaaatccacccctgtgctcttcacacccagacagatgctcacaggttccagggatatacagggacatttctaaatctgtcttggacgtccattcactttatctttagccatggaatgctgacaagtattcagtacggttgagtgaccttctataggtcagagcaggctgtgttctgattgagtttagaaaactcataactctggccaagccttcaattggtcaggtggatggggctttgttaggggagactgcagccagagccagtgtcgcccaccttccttctccctccacctacctgagctgccagtcccttcccactcctcaaacaggacttctctggtttgtgaacacattttctcctcttggtgtgcagagcttttggttccagccctgtcagatagtgatggcacagacccagtggtcttttaatcatagcaatgggctcattgctttgaacttgcatagtctaaaaaaataaataaataaaacaggaccagcaagaacagctggaagaaatagaaggaacttgagtttaaaaagttggacacagcgatggatccaggctcagctggtctcattcctctgcctgaacagcttagcagaccagataacaaagaatccttttgcagctgtttttcttcaagttagagaattttagagccacaaaggaaactggagattatctttatagatgaagaatctgatgtccaaagaaattttccaaggttaaagagatatctgttgccagagccaagataagagcacagcttcttccaacaccttaattttattgttttgttttgattgttttcctttcagttagccccctaggaaatgtttattgaggacctactgtgctcaaagttctgggcaggcttctctgggtaaatcctgaattcaggtgtgtacatctggtgaggaaaacagtaaacaagagtaaaataagacagtcaggcaagagaagacaatgcccagaatccagtgacattcacaccaaggcttaaagtgcaacagaaaatgtgacagcagaggaaccaggaaaacctttccggaaggagccctgggaagagcagaatgggtgcattcaccacctctcctcacctactttgggatgctcatttgattgaatttgtaacaaacaaggcctttgggtcagtcctgcttcttccaccaacctaagggatgatggtcattgctaaagcttcctctgagccagtccttcgccaagtggctttacctgtttattttatttggtcctcataacaaccataaggtaggttgtatcactgattttcagatgaggaaactgaagagcagggaagctagtgacttatcgcaagtcactcacctagtcagcggcaactctctgttattgatggggcttcacttacccttagtgtgaaacagaagtgtccttgagatcacatatgcccaaagacattatcaaaacacagacgtgtggtgatgcaggaagcctgagaacccttggcatctgtgcttttcacatgtagaaggaagaatctcattgcttggacatgaggggatataagcagcgggtcagggcccagcatcacactgaatagagctccaggaggctcacaggaccctcatcagaggctctctgtgtgttttatggttgattgagctttatgaccccaaagaatccgttatttgttttctttatagcaggcctcaaacactgggctttggttattctttaaacttacaatactcattgcatgacagaattatttttcatttctctctttctttcagagccttggaatcccattaggaaatttctagtacaagcatttgtgggagatactagtactcgggttgggcatctgggagagatagacaagctcttattacagcatggaggatggggagattacctggccaagtatcatttcaggttgtggcagaaagagattagctccaatttatcaccgctcacattttcctcttttcccccgttttctgagtgtcatggaaatgatatttgtgaatcccaggggcctctcacagtggtgtcagtttagagatcttcccagatacatctaaatgtggacataaaatgtaatgggaagaaattgaaaaaatatctgtttctcgattctttattactgtggagttaagaaagctatttctcatgccgtttcataaatttgaatccaaatgtatatgttaatgtgtattcagatggcttttggatgattcaaacatgcagactcttttttttaataaagtttgtcaaatttctggcaatttagagatacatgtttagacaatgtatatgtgcatacctgccatatgtacatacactgtgttgtcaaaattgagcctaagtgaactatgatgaaaatttaaaataagtaagcttatgatgaatacttagtagttgaactcagtatttgatttgtaaaatataaacatgagtgaaattaatttttggctgcttagtccattaatattttacctaaattaaatttgaatctaacaaagacaaacatacacatttctctccaggtctattattatctctgtgacacaaaagcacagagggagagttcagactctaaaagaaatgcagtagcaagccccaaagagaatttttttaaatttcagggaaggttttatgagacaggaaagctcaaagacatatctgtgacatttaaatgtctaccatcagcttgtttcctaatattgccattagttttgctaattagggccaattacttaatgcttgcctgggttgtggttgggttgagggtgcatggtggttcatgcacaatctgttcttctgattcaaaaacaccattctctccttgcactgcttgatccttagcagggaaagcgcccagttagaagatgtgcctaaactaacacaaaggaaaggtgttgtctctgaagtttagaaagaattcagtgagctcctaacctcactcaagtgagtttgaaccacaggaccaagctggctgagtgatctcaggattagacaagaagatcaggagtgctccttgatcctcactgctggctgcaggctctcaaagtgccactgcgcctgcacccagtgcttctgagaggtgccagcagggatggatggtaacagtggtagtcccctgtgctaaatgcaggcgtatgggtggggaatatcttttggggtttccctctaaatagtgtcatatctgaaatctcagaaacagaagaacagtcagcatcatgtcttctgaaccaatgctgatcaggaaggttctttacggcagagttttcgaactgtagggtatagaacgaccccttggggaagtctttaaaaatcttacccatcactcaccagaagttctgattcccaaggttgggagtaaagtgtaggagctcacctcactcttggttgcatctcatgagctacattcctcaagcttaagtaactgacactgtacatagatcgttaagttaaagatacaagagcgattaagaatccagcataatctgtaagtcagtgataccaagggtatgggaggcaatgagggcaaagagagtggtgcagtctgggaaggcctctggaaaggtttggaacttgagcaaagctcattggccatgtaagatttagataatatcaggcaatagtgaatgggatgagtcctatcatttgtggacaaattgactaaacaatcacaatgcacataatttcaaatggccaaataaataatcttcatagtcatggttcagggtgggtaaaatattgagggtattacttctcaccccaaaatggcctccatttccctaataccccatctagacctgaaataaggtcagccctcttttagtttcgctgagttcagtagaactgtctgtaactagctttgcaactgatcttgtacaaggcaattaacttcacttagtctgatcttccctcgtttgtataatgggagggttgtggtggatgatttcagatccctttcactctagcattccatttgacccagttaaatgcttctcattattacatgactggaaataggccaggtcaaatgatgccccttcaagcagaaccatcagatccggctgtacacggtaaagatggatattagactgctcaacttatcatcattagtcccgtagtctcataatgggaatgcactatagttcatatctgtcatagttagtatttggaagactcaaagctggtgagattattcacatatttattcctgtgtaccgcatatgccaccccacgtctccccttcatcatgtgtctatgacaatatattgaacagaaaatctccatcagctgactctgacagagtgtattatttacagtggtgtcaaaatgtgctgcttataattgactgggctcataataaaccaacctaagaatcttttcttctcatattccttcttactggtaaatcttccgcttgcattccttccttccatcaacaccttcttcattatttacagaggagggaacacacaccagatggtgcatgagtgatattgtagggtgactctttcatcttgggaaggcctctctctcttctctctctttctctctgacttaagattttgctgtggtaattaagggtgagagaaatcaagtcaattggacttagtttctaaagcaaacagaatacacttctccatttctctgagcttcaggagacaatgtggggtgacactaatagttgcatgggcaatttcattttttatcctcatgttttcacttactatctgtgaaacctcgagaaaattactgaccttctatgtgccacggttatgtcatctgtaaaatggggatactgatagtatctaacccataggaatgttgggactgttaaacaagtaatgcacataaagggctaaacccaaactaagaacaacaacaaatacacctaggccaaggcacacataaagtacggtcattcatgttccccattcatcaatagagagccccctaaaatgttcctgtaccagaatgtgtttggaattgcacagggggagtggcagcctttccagcccccatccagcaggatgtggatgtgcgaggctctgcccccctctcctctccccagctgtgtacctcctcttgttcttctttcaaagactcattacacttggcatacacatgagattcttacctagcctgaggaagatttccaatttttattttgtggctccaataatcataggtattaagtatgactgcctctcctaggctaacctgcaaaagccagaggctgggtttctgtggcaccgtgctcactgaagcagtattttcctagtcatagcagccacctcccatctgccacctcgtctctctgcctggaatatccagaaacactttggtgtattattcccacatttaaatggacaaagtttgctcatagaaagtactaattttgatgagcatttctttttaatttaattgctctgatgaaaaccctcataatcatgtaattcttaaagattagtgtaaggttattgccctgaaaatatgtctagtttggcacacagggtaaatacgtgattattgctaacccttggttttacgcaagaaaattatcattatccatcaaagcaaaaatgtttagtagaatgaagtaactgacggaaaaaatgcctgaacatggggtcctgtgactgagattgatggaacacttatcatgtggctttaatcccagacatttgcatattttctcacaaccttgcttctcctctcagaggtttaggttcttagcttaaaatgagaaggtaaaactaaatcataggccagatgtggtggcttacacctataatcctagcgctttgggaggcttaggcagaagactgcttgagcccaggagttcgagaccagcctgggcacatagtgagaccctgtctctacaaataaaacataaaaaattatctgggcatggtgacatgtgcctgtggtcccagctactcaggaggctggggttagaagattgcttgagtggggaggtgaaggctgcagtgagctgtgaacacaccactgcactgggtggagtcacagagtgagaccctatctcaaaaacccccataaaaaccaatacataaatcatatgtatagtcaagtattttatcttaaaaatcagttgatttctctttttaggcgtgcatagaaatatttgtttgctgagcttctgcgacaagtcttacgtaatgaataaactctggtgttcagttgtcttctaatatagaacattttaatttctgagggaagatgcaatcattcttccatttgtgtgatttctttatttggatggacataagtgaagatttactccacctaggtctcaaaaaattgttcaattttacggtatacaaaaacataatagtggactaatcttatttaactgatgaggaaactgaggcaaaaacacggccaaggatgaattagctatggagtcaggaataggattggggtgccttcattcctagcacagtgtttcttcacctgtacctcctagaatcatgaaagccataaggtacctggtacctgaacttagatcaaacagctttaagacaaacagatgtgtacagtttcaaatgcaaaacccaacatgaacatatttgtttggtttaagggggctttctattttgcattctcttgcaaatgctgttttccaaaatgcttaccgttcaagttgggtaatagccatccttccattgactgatcatccactaccggctcttgactctggcatcacatcttcgagataatccgagctagagtttggctgtcatctagaattcacagttttagtttagcactttgctgactagtactttgcggattagataatggtagttagctttctgagactctgggatggcaagcacatgggccatgatatttgtagtagctagtgttatattgagaaaaactaaggggtctcaccagatgaaaccatctttaatatcactttgctagctatcaatacagcatagtgtagagtttaaagtgctttatccacatttacatttcaaccacagccttgttccctctagacatggtaggtgagatttttcatatgcctatcaccaccagctatatagatttgtaacttaccatgggttgtaaggttatattttggcatttcagaagctgtcctcattggatgccagaatatttgaaatcttttggaataaacaagtaattggttctgtgagagcttatgagttaaaattaacttaatattacccttctgggtttatattggtttcttctcctgatttttattttattaagcacctttctaagtcctggtaaggttgggtgtatggacaaggaaaccttctacttggatgaaagaaagccccatggaaggctgagtggatgagcgccgactcaccttggtatttaacatgactacagaatggataggtcttcacttctcaggcctctgcttcccattccacaaaaccaaagctttgttcagctattccctgggtggggtgtttgcctttcctctgagaaaatatgctggcattatagaaaagggagttgaggggtgcggttttcctctggcatagatcactttcatctaatctgaacctcatagaaagcctctgctgattcagaggacaatgactttgacctatttatttcaaggacccacccaggctcagcccagcaaaggagtacacagtgcttgctcagaacacagctgaaagaggaggtggtgttcaatgggaatcacaaaggctatggtagaagtgagtaatgagagctgggctcgagccctggtctgagttcagtgtggatgtttaaaggcgaccattcttaagaggcaagagaattcgatactgggttcaaatctcaattttattttaaaagtgcatcagtaacttgtagctcatttgatggcctgcagcccagcttgtttagaaatcccttctattctctctggtactccaagtcccaaagaatctgttctgatggtgtggttacacaaccagccaagcacagccttaggttgctctcaactcagaactcaccctatcacacgttgacgaatgcaagagcctgttagagacactggaacccaagatggtgagtaatactaaacaaaggccaaactctctaaaatgcttaggccaggaagaaggacaatggggaaaaaaagtttggatcagtatgtatatgtgtgtgtgtatctgtatgtgtactatatgtgtgtgcatagtgtatacatatgtgcatatatttgtaatatgtaaaaattatatctataattgtattcatgtacatatatacatatatgttcatgtgtacatatatatgtatatttatatccatatatatttatattcatatgtgtatataggtattcccatcgtatgtgcatgtatagtgtgcctatgaaggacaaagcgcggtgcaaagcactgtggggaatacttggtagattaagacacaggtcttcctctcaaggatctagagggcatgtagttattaaaagctgttaactatcccaggaatgcctacccttctccatgatttggtagctgatataggataatttgcccctggattttgtgaataataaagaacagaaggctggtatcacaacacttgctgtggtcagtttctctcctctctcctgaaaggcagtaatcacattttctagttgtactgcctgcttttagaaaaggtctctgctgctatccaaccagcacagtccctctttgcttcagggtcttggcaagagcaggttctgattctgaagcattaacattcttcagggctctgactcccctcagaggtctgtttgcttctgaccctgcagatgcagggcatcacggatgtttatttgtctgttacctaaactcaggacacatgcacagcagtaaattcttcatttgccagagttaatcacagccatgctatagcttatatcattcccactgcccattgggaaagccttgaaaatatagatgggatttgttctccagcaaataagttcaacaaaccagattggtgagactacacagagggagaggtttgagttggagtccctccttgggtaatatcttattccattcctgccaaggatcaaatttaagacttgctgcattccaaaaaaatagactagtgacaacttggagtggagggaaacaagaaaaggttctgtttgtttgctttttcattaaacatttttaaaaattaagaagtaatggagaaaaatataatgttactcatgttttcccaattcaactgaatatgaaaaagtgctaacattttgtcatatggacttcagatcatttttattattaagaaataaaatatttagaaataactgaagtccctcacattcctctccctagtcccagcttccccaaagcaaatattgtcatgcatttggtgtgtagctagtccttttatccttttattgcgtagatctgtatacagctataaatagtatacggcattgttttagtacttttaaaaattattatcacagtgttatactataccttttaacaatgtgtttttattttatcaacattgcgtttttcagaattatctgtgttgaggtatatacattgtgttcactcattttaactgctatacagtactccatcatataaatttgatgcagcttatttattcattcctacacagatgatcatttccaaatttttgctattgtgagcaaagctgcaatgcacacccatatatagtcaaccctccatatccatggtttttcatctgtggatttaactgtggattgaaaatatttgaaaaataattgtgtctgtactgaacatgaaacagacttattttcttgtcattattccctaataatgagttctacagatatcttctatgtcaagattgctaatcatgctgctttttcttctaaatttaattttttcttaatattttgtaaccatgtttatgtgtttctcataaaggtgttttattaatgaagttaagctagtaactagtacttccaaaatctagtaggttaacacaacaaaaatcttgtacaaagtgagctatgtaattgtgtgattcctgcagtccacttggtgactcacagatccaggttttcatctcaagaaaaagcaggttggagctgccacgttgcgtggaaaacttacacccacttacttatgctttggctgggaagtggcacatgttaattccactcagagccctttgggcagacctgccttgtatttctaggtgcagagtggtctttatttattatgctcagctgagttggtgtgtgcctttagtgtgagaatttagagttttccttagttatggaaaagttctctattgttagctgtttaaattgcttctcagtagtcctgctgtggcctaaattctggaaattgtgttcggtatatgttggagactccatactacttgatttctttcttttttttttttaacctcattatgtctcagtgctgcactcagaattatttcctcactactgccttccagttcactagtgttctctttaaccatggaaactcttgcgttaatttcatttatagagtttggagatttcaattatattatttctgtcttctagtttctatattgattattttgttagtcatttttctcattttatatctattagtttacatagtgctttcttattcaaaaggatattatcttttactttaagtattttttaaggtttttcagagacaattatgtgcacttttttctgtagtcaaattttcctctgattgttgagttctgtggatatcttcttggttctgtttttccttattggttttgaattttaggttgcttgctcatctagagtgaaaattatctttaaaaataaacctttaaatatccatcatgttttgcagattttcagtagtttccatgtggctccctgagaatctcaggccagaaacaacttctatgttagtggactaggattcctgtctcatagtggtattggggatattgcagatccagtacttagcagcttgtcacatatctggtctgtgtgacttgctctgttcattcctgtctcacatgtacatggtgatatagttcacagccttaatttttctcattttacccattcaggttggagaccctacgagttttatgctgtgagtcaggcttgtgtccctaaatcagtgttcagtgacagccttctctttgcctttgtctgtttctaacctagagttcaacaaccccatggttccagcattttttccttgatgtctgtttcagtacttttccagtgtataagagatattcatcttgtattgggtatagatacaacttctaatttttgaaatttcagctagaattgctttttgtggtgtagcaaggaaaatgtattgaatgtttaagtttacaatgttatcttgactagaaatcttttacatttattttaaagagtttattttgatagtaaaagaatagatgttcattaacatcttgaaaagcatatagaaaatatttaaataaccaaaaatataactgcataaaataattacagttaacatgtcagtgtgttgtcatctatattttgcttttcactgaatagaattcacactatatatttcgttttatatccttctcttttataccagccattatagggtggatttaccatgccataaaataatcttcaaaagcaatttttttaacagccccttaatgtcccaacatatggaggtactataaaaacataaatcatccaaattttaatatctctcttagcataaattaacaagtaattacttagtaaaagagtatgaatatttgtaaggcacttgatacataatgaaacattttgatccaaatacgctatttccaatttacattccaatggtagcgtaatcattctctagccagtactaggtattttctctccaattttaccagtaggatagatgaaaagtgccgtctgttgacatgttagtgctctgaaatattccgatatctcttttgatattatttcttaaattctaattctttagctgtatttttttctaaatgagactctagattcctctccttttctggttttcccagagaacctgttttaatattttccatttttcatgatttttgcttacatgcattttttcttctttagccttttgttgtgcaagcattcttattttatgactctttaggctgattgtttaattaattaattttagtaatctcctgtcaattcacaggcttacatgctttgttaacttctgagtctatattctgtaagtcttgatatgaatttgcttattttcatttatttccaaagtaggtatagcagatgtttatttactttgtgatctaatgtttattgaggaaatccccagatttatttcatcttttaacttagatttctgacattataattttattaaattgaagtttgagaatacagtttttttctttcaagaactttatcaaatatactaaatgaattgacaaattttaaaatgcctcaggggtatttgaaaagaacttacattttctttttgaagggtataaggaaatatatgtatatatatgagtttatgtatttatttataattatgttattcaaagatttcattccttttaatatttgtttaatctggctgacaattgtataatatttttcagctcttcacttctggtagtttttgctaaatagattttggtgtttgatgaatatattatatgtgtcataagttatatgtcctttatatcttcattgcagaggattccttttctcagcacaaaatattatcttcttttcccagatattgctttctgacttatatattgttgctatcattgttttttgcaagactttctcgtatactattgtttcaataaaaccatcttttacattttatttaaatatttttggtgagctgtatgtacttgattttgtaacacctattaggaaaacttaaggcattcatatctgttgctatagcatatatttgggcttaattttataactttgtttaatgctttcttgctttttcctttttattctgggttttgtctgttttcatcttatgtagaggtttggaagatcaaaatattttcattaattgtactagtgataatccttttgtttataaactatatactaaatcctatattcctctgtcaaattcaagtaccagtttctaatgagaaatgtaaattatctggacttttcctgactttctacttctctgtatttatcagtgtttattccttttacctggtgttatgctatcaacattttatgataaaatcctgatttttaaaaatatatgacttttccagactttgaatttaattttgtgcccatgttacaacagttcttcatatgttttcctaaaaagttaattgatttcaaagttccttgccattttctttatagtttagctattgcagtcttgatttcacagtcttgagttcttgatttctctttttctttattagttgacagacattcatttttcgtgtgctttctcaggaagagaataaaaatgattaatgtttttatgattttaagcttagtaaaatgtcttcctgcaacctttttacatgaacaacttggacataaacctcttaagttatagacttttctagtcattgctctggacaaatcgtttcattgtcttctgacatttatttgattttgcaaagaagggtgaggccagccttatttttgctactttagagataagctctcattcctcttttcatttttgtaggattttaaatttatcattgagatttaaaacacaatagaacttccctaatatttctagtcactaaaaaagttcatttcatttggttctcactaagccattttatttaaagccttataagcatataaaacttataaagtctttctctggggcaatttctattttattaattcttttgtgataaattttctgttccttcctcagtaacacttcatctggatctaaattgtcctccacgtctgtcatcttctcttctatatttttcctcggaatattgagaaatattctttaaattttcttccacattattattttacattgtttcagttttacttctgtttatattgcctcaaatatggactttcattttaccattggattttgggtttcctaggttaatttcttaattcggccagtttactaattatctcttcattcatctcagaataatttttcctttgacactctgattctcttttacagagtctgttttacagagtttttgaggatagcaaacagatgagttctaaatcttgcttttgtctcatgtaaaaataaaatttcaaatatatcctcctcatctgagtcaacatggaagagctcctattctagatgatattgttgtctttttttgtagaatccatagtggcagatgtatacatatgtttttctatgctcatttttgaatagggattgttgtgctctaagaccaacaagcaggttctgtggcatgttccttgcttctatgtcactctaatttggtaggattctactcttgaagtttgaagtgatgtacttaatttgggatgtctaggaagcattcttctgtgtgtttctgatttgcatttttttttttttgagacagagtctcgctctatcgcccaggctggagtgcagtggtgtgatctcggctcactgcaagctctgcctcccaggttcatgccattctcctgcctaagcctcccaagtagctgggactacaggtgcctgccaccatgcctggctaatttttttgttatattttcagtacagacggggtttcaccgtgtttgccaggatgggcttgatctcctgacctcgtgatccgcccgcctcggcctcccaaagtgctgggattacaggcgtgagccactgcacccggcctctgatttgcatttttatagacttttattgacagctggatattttgagcaagctagggagccagatatacttttccattttcctttgaacggtgctgcatgtgaagactatgttcttcaggaagtgcttctccaatgcttttttttttttttttttgtggaggagggtggtggacagagtttcaatcttgttgccctggctggagtgcaatggtgtgctcttgtctcaacacaacctccacctcttgggtacaagtgattctcctgcctcagcctcccgagtagctgggattacaggcatgtgccaccacacccagcaaattttgtatttttagttgagatggggtttctccatgttggtcaggctggtctcgatctcccgacctcaggtgatctgcccacctcggcctcccaaaatgctgggattacaggcgtgagccaccatgcctggcccgatgctttgtctttacccatttataattattttcttcaaaggaatgacctatccctaaaatcttcctgtattttcttcattgcttgattgaggaagtatgaagagaattctagccctctatggctctgaggtcacttatcagatggctcatcagtgtggacaggaagtgggtggcatcttgacatgctttaagtcaactagattgtgtatgcctatgtcctatgctcttattttgcttcttcaaatacacctaagtgtgagggagcattcaatttggatgtagacaataatatatggtaagaagctctgggatctgggtcagggcctcaaggtccatctgattgcagcagggatgtgggaaggccatgtggggtccagaacacttaactctcttttaaatgaaacacctaatcactcacctgtttctgctgccctcagaattttagaaaatcactgaaatggaatgaaattaaaacttacctactccaactcctttaacaggcagatggtgtgaaatttaagatgggaactgaatgaaaaaaaaaaagatatccatcaggtaaagatgagaacagaggatgcagatggctagaaagctggtacaaagatgtgaagtagagggtctaaaagaaagccaggaatagttgacgtatagtgggctagcaagaaaatggaaagcagtgtccaggaagaagatatttttatgttggggtaaggagtttggatttaattaaagtgttattggaaggccctgggggaggatggtttaaaaagttaagtaacctaatatgatcagttaacagcaaaatgtttatgtatttgttttattcactcatacacttgtatattctttcattcaataagtaaactcatatttatcaaataaccactacatgtgatggagttatatcctaggattccaaattcctagtataaggggtatttctattatgccatgcaacttctctactggacagtaaactttgtgtgaacagggtctggacttctatatatttgaatctcctaagacttcaacagtcataggagtacctgacttatggtagcccctaaataaatatacttgatagatgaatgataagtaatattctataatgttcacagaggtctctgaaatagaagaatatttctaaagcacagttaaagatagtcatcattagcagtgaccaggattccctgcagggcacagttccataaagctcttgtaaggactgatcagtgggttggatccattgactcttttaatcaggctaaatatgctgtcccttctatgcatatatttgctgggattctgccatgccagtactagtttggccatgttgatatgaaagagtaaggatttgtctatttagttgccaactaaggtgtaatgaaatctcatggcaaagtgtatatgaattcaaataggagccaagcccttcacctctactgtgggttatatgacatacagagtcttcttgaaacatgtattcccaagactttcaacagtgcaacatctgttttactttgagggggctatgataagcatctgcttagaggaatgatctgaacaaaaccagggcacatttgtttgccatgctatagattatctagtcttacattgttaatgaataaatcatgcaggatggataaaccggtaaccacaacagcatgtttcatactgcatttaagacattaatttatgcattcatatatttttcctgtagacactaaaaaatttatgttttaaatagaagatcacatggattttgatgtagctcagcagttggatgtagattccagaaattcctttattaaattagagcccagttggctgattagggttctaatgttcataattgtaccatttgatgcattaagataagtgagccaaagataaaaatatagtgttttatgagaacataaaatgcatatctatgtacatattccatgtttgtatgagacattacatttaatcctcaaaactcatttcaaagttcatgtcgtgaacgtttacaaaagttcaggaacctcttaaagtcacataggcaattagtagcagagtctgaactgagaatcacatcttctcaggcataatctagttttcctggcttaccacgacaaccgtttcattgataagttattttgaaatcacatttgggggccatcactcacatgtagtatgaagctaaatctagaacaacattcattttgaattctttggtctggtacacataaatagttcttaggatgaatcacatagatggaggagaaagatagacaaaacgttgatctttgggtgattgcattgaggattctaatctctactgacgtgctaaatgttggaattgaactaaaaagagtcactaatcatattacttccatagtgaaagtagcagtgtctgcattgtatgctcttttgttgtttaatgcagactccctaaaaaggcagattttggtcactccgaggctgcattattctttgtaccaacttggctatcctaaaacgagcaaaacaagcaagcagagaatcgagacatagtaaataaacattcttaaaacccacatgttcctttaaacataaagaaaaaaaatgacccagtgagaattggaggtgatttgggtctgcattcgctcagctagaccaagctgttctcaccgccaccccccaccccgcccgactttgacttcctttttatttgtatcttccatttcctttccctgggccagatgtgtggattcccctgttgtgcccaatgacagagtagacttttctggaaactgccaggactatttgtaatctcctgactttacagaggtctcatatgctgagaaggacaaattctgatgtttcacagcaacaggaagagggttagggatgttgagagaaggacaatttgggtggagttttcacatatgtttctctttgatggagaatccagggcagggatctggtttgactggggccaagttgtatttctgctctctttattccatgtgacttgagagagcaaccacatgagtacagagttttagtttggagcatgacttcctcatcctagaatgccagagtcggagaggccattaaaggtcatgttgtccaacttcccataaaattaattttagatgaagtctgcaggagagagtaagagagcctctgtttatagaagaaattgtctcctagaatctaaaactgtctgttgcccattggatcaacatctatggccacccagaattggtgaatattatagaaagaaagtgtgggatggtgttaaaggacattagttcaactcgtcacccaacgcccaaatcccttgattagaaatggaaaatataagatatattgatggtattgaattggtatgaaattctgaaggttttaaaatgctgtttatccccaagaccaaaataagtgaatcctaggctcggctggtcacctcttcctgcaaggtcctgaggtaagagtatgcatcgatgctaatccctgatgggatgagactttgatattagccagggcctttaggaatacaccccagtaaaaacactgatgggctaggatgaatgtcacaggaggctccttaccttagtcagcttagggtaacttaagggtctatgctagaacaaaagcaggccaaaaggtctgttctccttgtggtcacctctaaactcaaattcaagttgcaaatcttatcacttctctgggagacaaggccttacacaccggttagcagcagatgaaagcataaaaattagagtttgtggcccattgtctggcatagatgtgtaggggaagtggcaggggatcagagggtatatgacaagggcaagtgttatcttctgggaccatcctacttagttatgtgggagaggagaaagcccctgaataatggaagggaatgtcccaagggatatatcctgttgttactctggctgtgtggcagagtcgggtagtaaggaatctagaagggccacatcaacttgtataggcccagtgattccaactgtatgcaccacagtgaagaaaaggtattctatgctggccaaccctgctagtatttctcctcttcctccttaggggctgggttgttgggcttgggaaagggtatgaatatccctcagagaacatccccttgcatagcatctctacccgaaaatagtcgttcggtctccattttgttcctggtgtcatctaaaataaggaacaacaaatagccagattcaatttcagcattatggtttgagcaagggcctggcttctagagtggggtgtgttgagatggttttcccactatttttatttaactcaccaaatatattctgtaattgggcatgacccagcaaaatgttccactctgaagttttatcatggaggccaaagagcatgttcaatgtctgccaagttctcaaaggaaatagtagtgggagggcaggccctgagctggagcttccctggtgactacaaaagcaattgcagaggaccacgtgatgtggctccagagcacatgactcagatgtccattgaaaagctgtatttgctcagggtgatggctaagaaaaatgtcttatgccctttaagaaaagagtcttgttttgaagtgagataatccttccattttcataaggtagttactgaaaataagtgttcattttctttgtgcagaccaaggagtaggccttctgagaaagttgcactcttattaaaaaaaaaaaaaaaaaggcactatttcagatgaaagcctgagatgcagatttgagatcttaaaacttgaagtaaaagtcagcactctgatgtgcccagcctgtcctttctaccttcccgttgttaagaggtgttcttttctagctcttgaaggaagactttcattcttaccatgtcacctccttcttcccttcttttttattttttggggtctgaaatagtaatcctgcaacacagaacttgtttggaattctgactgttttaatccttgccttaatttactgaggttaagttgaagataggaagttgagtgttggttttttcaaattgtggtcttagccgtaactccgactttgaacattttcggcagttccatggatgtctgcggatggtcagagtcacatttcattgtctccaagaactgtcatgaccctgtctttagcattccttcaggcttctctttactacagatcaagaaagtacttggcaacagtctcccattaggagagagcattcagggttttagtttcaacttttcgaagtttaatgcttttccattttcttttctccgcgtcagccatgggacaagtaacgtatagttgatcttcagtattccctgattctgtgtttgcaaatttgcctgcccactaaaatctgtagcccccaaatcaatattcatgacacactttctcagtcattcatagtcatgcacaaagcagtgaaatgttgagttgcccgatgtgcatgtttccagctgaggttgaacaaggtgacactgctttttcgttgcagctctcagactgtatgcaaatgtctttccaatggtctatttagtgctatgcttttcatgtgtttgtgttttttttggtgattttgcagtttaaagtggctgccaagtattgtgctgaagttctgtatggtattcctaagcccaagaaggccatgatgtgccctgtagagaaaatccatgtgttagataagctttcttcaggcataagttatagtgctatgggccataagttcgacattaatgaatcaacaaaatatcttaaataagtttccttaaacagaaatatagaaacaacaaggttacgtctcaatcagttgacagaaatgttgtgaccagaggctttcaggaacctaactctgtatcttccttaggagcaatcgttcagtatttgctaattcagtgtttgcagagactttatagggtgtagctgctgcaaatgacaagaatcaactgtaatcatttactaagtatcagctgtaatggtgaagataaatattctagacttaatatgccaggagggatgtgcgtgcctcatatgctctatggacatgttacagtaagggaaataggaggtgtccccctcaacctggaactcctctaacaagccagatagaaatgcatcattttttaggccatttcacttggatcgaagcttgttttctttcacactcctagtgctttcaaaaaaaaaaaaaacttggctgtttaattaaaaaaaatttggcctgttttgtatatatttgcagtctgagcacccatagaggggagtcacccctctcctccagacaagggtgggttgttgaattttatgtgaaatcttgacattgcaataaatctctgaacctgaaccagcctgcactggatatttaatactgttttcatttccaatactaatcaatcctggaagaatgtgctgttattttttagttacatgtaaacatttagatgaatataaaatggcttattgatagcttacatgcaggcaagtttattgatacttttgtcaaattctgtttgattgattgatttggccatcgtactgctatggatatggaatagaaccaatatgacatttttatttcctggcagtggtacctgagggtgaatgggatatggggaagcttgagctctgtctcttggatgagagcactatcagagcctgatcagtggagctcctttctttaaggaatgacctcaactctgtttcacatcagacacagtttggaagaccccacaggccattgcactgttgtatcattcatgtgggaagcccagcttcacaggggccacagaaatctcctctatgtgacacttctggctacagtgcattattttgttttattctgattttttaaggaggtccctagtaggcatcttaggaaactttgaaaatatattaagaagattcggcatttgatgcacagatacaaataaggccattttcctcagcctgcaagcccagtctgagactttgcaacctttctctcttctgattgtgaattccaagtgtcaagacaaaatagcactaagaaatcagtaaaatgtgacggtttttctcaagcgtctactaagagcctagccagatgcacatttcttattccttttggtaaatagattcagatttggtatgattcaatgaactaaaaaatatcccctgctcaaagcttgtctatgcctgctaattgcatgaagcttaacagatcctccacacacggcaccaaataagggctggctggaaatcaaaacctccttgccaagcactttggattttccaaaggaactgtaatgttcctggagatgtttattaatggaaatggggaactttgtggaccagggtgaagtcccagagattgatagcctgttactagtgtttattatttttgactgcaggttttgaaagcttttcctcctatcctccctaaaaggaactttctccgtcacttgggactgaaaatgggggtggagttcaacacctcatggagcaatccaaaatagacgcacagaatgttaataagcccaggattttgccctctgttttgtattgctctgccccaaaatacaaaacctaattagtgcatccagagaagcgttaaatggatttcatgctgtttaataaatgctttacgtgctttggtgccactgcgaaatgtgtggttgagtgagggtgggaatagggagaggaaatggttgctgtaaatgcttcctaccaatgtcaagcactataggatgagcatcagagatgcgtgtttataactcaggtgcttcatgttttcacccgaattttcctccttttggctagcctgttattttccttttgggcttttgtttttttaattttattattattatactttaagttttggggtacaacgtgcaggtttgttaatatgtatacatgtgctcccagacatcgtctccaaaggctcaacccacaattgtctacactcagaacaatgagaaattgtgagtgacagatgtgcactgagtgctcactgggtgatgagccctgaatgggacatgggaattagaaggtgtggccattgcctctggagagcttatgtccctatggggaagatagaacacataatatcctattttcaagatagaccgtcagtctggtgttcaaagcctttcataatgtgtcccctatttagtgactggcctgtgacatctctcctagaggctggtctttattgtcttatatgttggtcagtggttgtgagacttcgctgcacagtagaactgtcaggagagctttgaaaaagccccagtgttcacactgcaccctctatcagtgctttgagatctttaacctgcatcaggatcacccagaggatatgtggaaacacacatttctgggcttcacacccagcatttctaagtcagcaggtagagggctctaaaaatttgtatttctagaagttattgctaatgctgctagtccaaaatcacacttgaggaggattggccttcatcaattaaatcagaattgctgtgtgtctgatgattccagcatgcagccaagatggagatctgtgttccacacattctttaatgcatgtggtggagacagatgatcacatatcgtgaatgcctctgattattttccatgatttagctatttttctctgactagacagtaaaagtcgtaatagcaagaactgtgtatctttaccttttcttgattctctcagggtgcccagcccagggtggtcacacagaagtgtaacttgaatagtgttaaccaaggaaacgtagaagggtggatgggaagcattgcagataccaccagcactcttcatttccctactctccaaaacctctaaggaaagttctttccctctatttgtggactctaagatgcattgcagagctactttctctctcctcttccctccataggggagggtgcattttcagcatttacttttaaagaaagcaactgcaaagagtactgtattcatagataaaaactgcattcacatcctggctctgatgtttcttcttatatgatcttggtgacactacttaacattttcaagtccccatttattcataaataaaatacgtataagaacatctctttcacagacttctggaaattaaacgagtttgtgcttaaaacacttctaaggacaatataaaacacaaaaggcacagtaggccttttgtttataaccacattgtagcaaacacacatttttcctggaaacataatgggagtgctcttgggttatgggaagtagcaaggggagatgagcaaatatttgtgcctcatcctgacctcgccatgcatggtgtgaaatgtctaggtatgccatcaagaaccaaagtcctgtgtaacagaaaatctccagtgagcctgtcatgatgatggagacaagcctctgttgaacttcactgccagtgaactctactaaaatgtcagtcctgtattcgcatagcctatcagtcagggagcaggctatgagcactgagatttccacagcaacctgttggtgcctttagtgcattgcttccagaatgattcccatgaaataaagagatctagcattgtacttactggttcttagcaaatgttcttccccgtaggtagagtgccttaactctagaaccataaatttgttttcagaatgcaacaagattgcatagttgtgtaataaagctcctgacagagtgttaaagataggagggggagatggtgaactgggagagccaggaatcctcatcaaactattatgggaggctctgccctctgagaagagaagtgctgtcttaagaaatttccttgatactcaaagggtgttttacacagaatcacctgggcttttgttaagaatgtggactcaggccgggtacaggggcacacacctataattccagaactttgggaggccgaggcgggcaggtcctttgagtccaggagtccaaggctagcctgggcaacatagagaaaccccatctctacgaaaaatacaaaaatcagccaggtgtgatggcatgcacctgtagtcccagctacttggtgtggcttgaactcccttgaaccagggaggtcaaggctgcagtgaactgcaattgtgccagagtgaggaccacagagggaactctgtctcaaaaaaaaaaaaaaaaaccacacacacacacacaaaaacaacaacaaccaaaaaaaccagaatgtgaacaacaaccaccaaaaaaaccagaatgtgaactcaaacactcagacaataccctagaccttctgaatcagaatctgcattttttttttcaggagtcccaggcaatttgtatacacttaaatgtttgaggagaaagatagaagagtctcttagaactagactgggaattaagacacctgacttggtattcttttagttccatcttcacctcagtttctccatatgaaaaaaacagataagtagaataagttccttcccatcagttgacaggaattggtagtaaaagaatccccatagaaaagatttagaagtctaaggtccagaagaaccatcctcttcctcttcacccagctcctttttgttaacattcttcgatgcccaatctcacttccagctgctttggggtttggccgctatagctagatgtctcagcagcttccaattcccattatgagaagttgaaattctcccataggtacacagttcttctggcatcccgcaccatctttgcctgtgctgagtggtgtgtggtctggccttcaagggagccgtttccagcagtacatgtgaggagaggacctgtctcttggctgctaggaagcactccagccagacaacagccctctccagctactcagtgcctcccacattggacaactgggaaagcacacagggaacagtgggggttgttgagctcagcgagtgtttcctatagtgcataattaaagaaaacacctgtgtagctgctaaatcacttcccgctgttcccctgtgcaaatgctgtgctcaataaccttacaagtgcctcattccttctacccaaccgaggcagtgcacagagccacaatgcataaagctggcaagttattagttcagggccccttaaaagatctcttaggattgatttgttactagtccatggggtcccttggttagtctggtggcattttgctagactgcagcttcagggaggctcagggatgggtagtgggcctactttctccaaactgcccttctttgatcagcacttctctgtatccaaggcagtcccgtggaagagctctagagctgcaggagccagaaaaccttaaaccacaacttcaatactgtaattgtgggccagatgcttccccaggggaaaacagccaacaacagtgaaatgagatgcaagtgggacctatggattttgtttgaaattcaggaaagggaagtgacaataaatcaaaaggaaaagctatcattctaaacagacctcttcctgctgctgaagtttatggggtgctttggttaccactaggatcttgtggggcactggctgcccaaagtgaagaagatagactcccttgtagcagcaggtggattggcaacaggattcagtgtgatgacaggctagctttgtaatttacttcttccagggcaaagcaacatggctttcactgcaagttttagagtgtttgagcagatgagtgaatgtgcctaagagacccagtgaagaggattgctggatgttgggcggtggcaggggaggggggaagggctttaaagaaacagaactgaggagaaaggacagctgcagattcactcagtctcttctgcttcactgctttgttctcttcatagccttggtcataactgaaattatcttgtctatgagtttgtccgcttgtgtattatgtatctccccaaataggatgtgaacgctgcaagagctagactcttatctaacttgtgcagagctggatcttcaaaactagtcagtccagtgcctggcacacagtaggtgcaaaataaatttttttttttttttttgtgagatggagtctttctgtgtcacccaggctggcatgcattggcgtgatctcggttcactgcacatcatccacctcccggttcaagcgattatcatgcctcagcctcctgagtagctgggattacaggcacgaaccaccacgcccagctaattttgtatttttagtagagacagggtttctccatgttgatcagggtggtctcaaactcccctcctcaggtcatccgcccgcctcggcctcccaaagtgctgggattacaggtgtaagccgctgcgcccggcagatattctgaatcttgaaggaggaataggaattgactctgggctaagctggcagagaagggtattcccggaagagagatgaggattatgatgcatagaggcaagagaacctggtgtgttgggaactgcaattgtaaggtatgagtggacgagtggcgagagactagaatggcctggtacccagtcaacatgcctacaacagacggggctgggaaaagagctcctaggtgaggacaatttctcagacatgagaatggccagggcagttaggtgaactctagtacagatgtacacactggacaatttaactaagaacaattcatgtgtctttacaaagggttatctttccagctgttacttcctctcttccagctcatctgttggccaccttgttgtttacccctttgagtaaaaataagcaaaaagccagaagaatggggtaacctcaaatacctccttaattttgttttttgagcagctgcttaaaatgtctgaaacattttttgagttagaaatctgaaacaaaacaaggcttccaaatgattcatgagtttccattattcaagtttccctcatatcttcatcaccgtgtaggtaatgggtgtgaatctctgtgtgctcatatacatatgcttgattatatgatcatctcgtggaggacatgtgacacgggaagacaatagggcacatgatatgctctttgatctaaggtaagagtagcttctctctcctccctgtttcactatggctttatggacatgtgggcacacagaagaagcagaccgcactgcagaggctgtgcttatagacataactgcttctcaaggccacagataagaggatggacaggattgaggtaagtctatattttggcagacaagaactcttggtggcctctccattcagtgctagaatgttcctactatcacaccacttagttgatgtttgtgatttcaagtgctcaagtggtcagctcctctgataccactcctatgacactaaggggtcaccaggaatatttgtggccatgggcatatgagctccaagaaataaaagattcattaagggctgccatagagattttctggttcttttgtgacttgagctgaaattgtaagacctgtgtgtgtcatttcctttctgtaagtactctagtcctcccaggagcagcctcctgctccactgcctttggagctatcactactgccataagaaccaaggacagtagctatttgttcccgagacacttggtgcactatccacagtgacccatagcaataaagttaatttcaatacaactacctatgaaaaaggaaagtgaaggatgtgtctaaaacaaccctggaaccccatctttgaggatctgttttgtacgaccactcctggacactagcgtatgagttatttttctgagataatttaagagaattgtttaagtagggtatgagatttctagggcttccataagaaatgccactcgctgggtgacttaaacaacagacatttattttctcccagttcgggaggctggaagcctaagatcaagatgttggtggggttgatttcctccgagaaccatgaggggaggagttgtttgtggcctctcccctccccttgtaggtggctgtcttctccctgtgtcttcacatggtcttccctctgtgcctgtctgtgccccaatcttttcttacaaggacaccagttatatgggattagggcccaccccaatgacctcattttaacttaattctttatatacactatctccaatcatcagtcactttctgaggttctgggggtttagaacttcaacctgtgaatttttggtggggcacagttcagcctgtaacaaacagatataggaggactgaaaaggcaaggcaagggggaaacattgaaataacaaacatagtaattgcaagaagcaactaccataaccttaggactagaggaataaaaggaagaggctggagtcatgagaacttagcagcttggagaaggagtcttacaggactggtgcccagaactctgaggggcagagggtatgagcagctggtactggcaagtatgaggggtagacaaacagacagatgccgggagcatgggataaatggagaggagcgtttcctttctctcccctttcatcttcagatcttgcttttgtgcccctcgtaggcaggacctaacaggtgtccgctggcaaaaaagaagtgtaatctgcagcctacagcatgacaggccatgttattgaaggatggatttttactaagacacaataactttaataaccaacacaggctgggcgtggtggctcacacctgtaatcctagcactttgagaggctgacgtaggtggattgtttgagaccaggagtttgagaccagcctgggcaacatggtaaaacccctactctacaaaaaggacaaaagttatccgggcatggtggtgtgtgcctgtagtcccagctactcacaaggcagaggcaagagaattgagcctgggagttcgagactgcagtgagctatgatcacaccactgcactccagcctgggtgacagagtgaaaccctgtctcaaagaaaagaaaagaaaaaagaaaataagcagcacagattccttcagcttcttttaaaaagtcgtatcttgctctgcagccttgcttttattacttagcagcacatacgaaaaagtctccagtgtccatcctcttccagcacatgaattctaatggctgcagagtatattccatcataaggatgtatcatcacttacttaaccaacttcctattcttagccattcggtgttttaaaattttgccactcttataaataggactgcaactcaataaatctaagcacacatccttaagtaatcccttaggattaatttttgaagtggaattactaaatcaaaaagtatgaggatttttcaggataaaaactcacttttctcagctatggaaaacgtgaattaagtgtggcttcttctgtcctgtagtacagtagggtgagattacaatgtactagaacatggggttgaggcaaggatttaaatactattggccgaaactgagtaataggatgtaatgatttcagagtgaaactaggcctactctttatgaaagcatttaaaggtgaggggacagttaacagtagcatctgccccagctggtggaaacgccatgttgttactgattttaatgcagttgcattcttagcagaactaattttgtaaagcatttctctaaataatccaattttacttggtgcttatggttggacaaaggagcaggcaggttttgtatcagtatttatggagtgtagccttgtaggaattactctggccagaggacattgctataaatctataatgatggttgtgtttttgattccatctttagtttctgaatttcagcctttgtaattaaaaatccatatcataaaattttggcctgtgacaattttatttttctcctgggatgctatgatttttctgaggcatgccttgctcggtccttcatggaggctaaaggtctgggggattttgagctgggtgtttggagcccatcctcatgacagatatttggcatgccagcttgggtgctacccttggaagatccgagtccaagcttttactggctccctgaggacaattctgagaaagttactatcccttgtactggtttctggtgctgggtatatacttgcttttgtaagactaaataaattgataaattcagctgattcagagcgtttacataatctttccaatgtcaacagtcatttaaattatcctaactttatactgaatctccaaaatccaattactagctaataataattgtcagttttactttaaacctttaatgataggtcacaagggaagtgtagcagcaggattaaatcgctgtagactgtagctatgcccagtcttaaattactcgcctcttatctctggctaacagagccactatatgttttgtcaccatttttgctaaatagaatatatgtcaccaaaattaatttcatctcccttaaattagcttcttagtgtgatttctcacttcagtcaaaatttatttcttcaggaatttaatttccttcttcatctcttttattcgagagagcaagactgttctggaacaaatgtcgtttaatcactggctggcaagttttgaggcttgcttttcattaataattgctgacccctttagggggagtgttggaggatatttctgttttatttaagctattgtatgcttttaaacagagtagactgggctctttctgaatagtcttagagaagctgtaaaccttgcatagaacaggaaagatgaatttaccacaaagaaaacatttttttcacatgagggatgattcagcagggagtttgtaattaggcactttagttgtttttcctactttttaatcattttcaggtatacacatctgacaatagctatcctttaagtaaggcatgtgtttggaaaaaactgtagggatttaaaagttaaacttctcacagaacacataaatacacagaagacttgcccaactctgaaatgcatcctgaagatacgatagtagcacctgtaacaaattccctttgctcatcaacagaaacctcaaggcactaaaacattaagaggcatggagagggagaagagagaggaagtgagaaagagagggaaagagagggagagggaaagatccatttctagaaaggcaaagtgcgaggagctctgtgacctgctccccagtgaagcaaatgtaactggtgaagataatgaaaaaatatccaaccattcggagtctctggatattgtactaggagaatacagcaaatgaagaaacagttatttaagagcaactactaaaactcaaaaggaacaatgggattctgtggcacttaaaccatgacctgttcctttcctcctccccgcagcttactttgaaggaagctctctattacaggtaggtgtggctaagaaggtggggctcccttgcccctcatctcccaatcaagggatatggcatcttacccagaagagcaggctgccaacatttcttattccctccgactctgagatgcagaagttaagttcctggtgaggtcagccaagaagtcagagactactgttctctgcccactccccccaactcaaatgtggcagttctaccacaggtgaagctaactgagaacacttgggccctcatcattcttgctcaagaatgatggggtggagggtccacactgggagaggcaagctgagaagactggagagtgtcatatctgcctcagtctctggagcagtggcttggaggtttttctcagtgggagagcagtccataaatacatagagctctgaagctctgaagctctccttaggggaactgtctttgaaacagagtgagggaagttcaaggctaagggtactttcttccataatgaagattttggtggtaattaagaggagactaataactccatgagagcaaaaacttacaccagaggcaagcaagtttactagagagaaccatggaaacagatagctaagaactctcctgggttcacaaaaaacctaaaggactagcctcaaaaacttcccctacccatgtacaattcagtggcatctataacattcacagtattgtgcaatcatcaccactatctctttccaaaacactgtcatcatcccaagaagaaactctagaatgattaaaccaacaacttcccatcccttctcccctatgatcatggattaacaattagctttcattagaaacaatggagaccagaaaccaataggatggcataatcaaagtgctggaaaaaaaataaaaaaactatcaagcaacaatcttatatccagcaaaactctctttcaaatatgaaggtgaaataaagacatttctaagtaaacaaaaactgagaagctttatttgctagcagacttcctttacaagaaatactaagggaagtaatacaggctgaaagcagtacaccccagacattaattcaaaaccacacgaataaacaaaaagcaccagtaaaggtaattatataataataaaaagatagtataaatacatattctcctttctgcccttaactaatttaaaaagcaattgtacgtaagcatggaattaccatataatctagcattttttacttctaggtatacaccccaaagaactgaaaacaagaactcaaacagatacttgtacacctatgttcatagcagccttattcacatggacaaaaggtagaaacaacccaaatgtccatcaagggattaatggataaaaaatgttggatatacgtacaatgtaatagtattcagccataaaaaggaatgatgtactgatatataatacaatatagttgggaaaagattattctaagtgaaataagctagactcaaaaggataaatattataggaatccacttaattgaggtatctaaaataggcaaatacatagagacagaaagcagaatagaatagaggttaacaaggactggtagcagaagggaagagtgaggacttgccagggagagaagagtaggcagttatagtttaataggtacagaattgcttttgggaaaataaaaatattctggaaatgtatactggtaatggttacacaaaattttaaatgtacctaacaccactgaattatgcacaataatgacaaaaatggtaaattttgttatgcacgttaaccacaataaaaataattaactctaaaaaagcaattatataaaataatatgtatgtaattatattattgggcttatatgtaaatgtaatatatttgacagtaacagcacaatggagatgggtgggaggaaacctgtattggtgtaaggaaatggcgccagatggtaacccaaatctataggaacaaatgaaaagaatcagaaatgataaatagaaagggaaatataacaagctctatgaatatatgcttactctcttctattctcttagcttctttaatagacataaaattatataaataataaaatgtattggtaggtttgtaatatatttaaatataatgtgtataacaatattagcacaaaaggaggaagatggaacagagctatataggtgcaattttaaaattttttgtgaaattaagttagcatatatctgaaagagattctgatgagttaaccactaataaaatctaataaaataactcaaaatatagcgaaaaattattaaagaaattatattacactagaaatattcacttaaagcaaaaggaagcagtaaagaaggaacagggaagcaaacacacatggggcatataggaaacaactgaaatggaatatgtaaatcctatataaataataatatcaaatataaatggattaagcaactgaatcaatagtcagagattttcagaatggataaaaaaacaaaatccaactataggttgtttataaaacacacactttagattcaaagatacagatagtttgaaagtaaaagaattgaaaagatgtatcatgcaaacaacaacaataagaaaattggagtggctatacgaatagcagaaaaaaatagactttaagacagaaaaagttactagagtaaaagaggacattttgtgatgataaaagtgtcaatttgtcaggtatgtaaaacaatcataaacatatagacatggctacatagccacagagccccaaaatacacgaaggaaaaactgacagaccagaagggaaaaataagctttcaacaataatagttgtagtgttcaataccccactcttaataacagatagaacaactagacaaaatatcaaggaaatagaagacttggacaacactataaaccaacttgacctaccagacatctgtagaccttccacccagcaacatcagaatgcacactcttctcaagaacatggaatagtctctaggatagaccatatattaggccataaaacaagcctcaataaatttaactgggtaaatcatgcagagtgtgttctctgataacaatagagtgaaaataaaaattaataaatttggggaattctcaaatatgtagaatataacacattgctgaattgccattagtcaaagaagaagcaataaagaaagttgaaaaacactttgagatgaatgaaaaagacacacaacataccaaaagttacagggtgcagctaaagctaaagtaaacagagggaaatttgtggttgtaaatgctactacaaactgagaaaagagttatctattcaataacttgattttccaccttaagacagtagaaaaacaagagaaaactaaactcaaagaagatagaaaccataaagagcagaagttaatgaaataaagaataaaaagcaatgaaaaaattaataaacccaaaagtttttctttaaaaggatcaacaaaaatgccaagtagttagctagattgaccaagaagactcaaatgattaaaatcaggaatgaaagagggagcattactatcaacctgacagaaataaaggattgtaaggcagtactatgatcaattaaatgccaatgaattagataacttggatgaaatggacaaatttctaaagacagactcaagaagaaatagaacatttgaatggacctatagaaagttaattgattgagtttgtaaacaaacaaacaaaaaacaaccgtctacaaaaaaagaccccgggcccagaatttacttcactggtaaattctatcaagcatttaaagaaagtaaatgttaattcttcacaaagtcttcccaaaatagagaagggaatacttcccaatttattctctgagcccaccatcattctgattcctaaaccagaaaaaggcatcataagaaagaaaaatatgatatttcgtgaaatgaaaaatccttaacaaattattagcacatcccatctagcaatgtgtacaaatattacacacaatgaccaagtaggatttatttcggtaatgcaagattaatttaacattacaaaaccaattaacataatacaccatatcagaagaataaaggacaaaaaccacatgactatctccacaccattaaaaaaaaagtatttgacaaaagtccacatccacacacattcatggtaaaaacattcaacaaactaggaaaagaaagcttccccaacgcgataaaggacatctgtgaaaaactcttggttaccatcgtacttaatgggaaaagattgaatgttttcccccctatgatcaggaacaagaccaagaaatccactatctccacttttatttaacattacagttaaagtgttagcccagaaattagacaagaaaacaaaatcaactggatgcagattggaaagaaagaagtaatagtatttacttgcagatcttgtatacaggaaattctaaggattctgctaaaaaaaaaaagaaaaaagaaaaactgctaaaacaaataaatgagttcagtaatgttgcagaatacaagaccaatgtagaaacatccatcgtaattgtgaaattaagaaaacaattccatttataatagcatcaaaagagtaaaagacttagaaataaacccaacaaaagaagtacaaaatctatgccctgaagaacaacaaaaacattcctgaaatacaatgaaaataacctaaataaatagaaatacatcctatgttcctggatgtaaagacaacagtactccacccacatttgatctacaggttcaacacaattgactctctagccccaatttcaaaacttattaaaagctacaataatcaagacagtgtggtactggcattggaatacacacatagatcaaaggaatagaactaggagtccagaaaaaagtcattgcatttacagtgaattgatttttgctgagagtacaaagataattcactgggggaaagcatagtaatttcaacaaatggcgctcaggtaactggatagtcacttgcaatagaatgcattaggaacctcgtgccatatacacctcacaccatctacaaagttaacttaatatattagtaaatcaaagccctaatatcaccactaaaagcataaaactcttagaagaaaacatagacataaatctgtgtgactttgggttaaggcagcagtgtcttaaatatgatatcaaaatcacaagggacaaaagaaaaaataagtaaattggacttcctcaaaatttaaaacttgggtgcctcaaagaacatcatcaggagtgtgaaaagataacctctagaactggagaaatttttataagtcatatatctgataaggtatccaaaatatataaagaacacctataactcaataataaaaagtcaattattatctcattttaaaaatggtcaaaggaattgaatatatttgtctccaaagaagatatagaaatagccaataaacacaccaccagaggctcaacatcattagccattaggaaaatgcaaatcaaaatcacagaaatatcacttcacatccactagaatggctataatcaaaaaagataaataataacaagtgtagggtgtggagaactggaaccctcatacattgctgttgagactgtaaaatgatgaagctgctttggaaaacagcttggcagtttcttaaaaggttaaatattgagcaattccactcctaggtatatacccaggagaggcgaaaacatacatacacaaatgcaaacaaaatttggtcattaatatctatagcagcattattcataatagtcaaagagtggaaataatctaaatgttcatcaattgatgagtgcataaataaaatgcagtatattcttacagtagaatatttggcaattaaaagaaatgaagtactgatatatgctacaatgtgggtaaaccttgaaaacattatgctaagtaaaaaaacccagttaccaatgaacatatatagcttaaggtaaattcatagagaccaaaagaatagtggttgcttagggatgaggaggctagggaaaagagtcagacattactgatggtgggcatgggatttcttttgggattgatgaaaatgttttcagattgtggtgatgattgcacaattctgtgaatatgcataaagttttgaatatatattttaacgtagtaaattttacgctatgtttattatatctcaataaaacttttatttaagaaaagatgaatacaggagcacccagatttataaagcaagtccttagagacctacaaagagacttagactcccacacaataataatgcaagactttaacaccccactgttaacattggacagatcaatgagacagaaagttaacaaggatatccaggaattgaattcagctctgcaccaagcagacctaatagacatctacagaactctccaccccaaatcaacagaatatacattcttctcagcaccacaccacacttattccaaaattaaccacatagttggaagtaaagcactcctcagcaaatgtaaaagaacagaaattataacaacctgtctctcagaccacagtgcaatcaaactagaactcaggattaagaaactcactcaaaaccgctcaactacatggaaactgaacaacctgctcctgaatgactacttggtacataacgaaatgaaggcagaaataaagatgttctttgaaaccaacgagaacaaagacacaacataccagaatctctgggacacatgtcaagcagtgtgtagagggaaatttatagcactaaatgcccacaagagaaagcaggaaagatctaaaagtgacaccctaacatcacaattaaaagaagtagagaagcaagaggaaacacattcaaaagctagcagaaggcaagaaataactaagatcagagcagaactgaaggagatagagacacaaaaaacccttcaaaaaatcaatgaatccaggagctggttttttgaaaagatcaacaaaactgatagaccgctagcaagactaataaagaataaaagagagaagaatcaaatagacgcaataaaaaatgacaaaggggatatcaccaccgatcccacagaaatacaaactactatcagagaatactataaacacctctacgcaaataaactagaaaatctagaagaactggataaattcctcagcacatacacactcccaagactaaaccaggaagaagcaaaatcacttaatagaccaaaaacaggctctgaaattgaggcaataattaatagcttaccaaccaaaaaaagtccagaaccagacggattcacagccgaattctaccagagttacaaggaggagctggtaccattccttcagaaactattccaatcaatagaaaaagagggaatcctcactaactcattttatgaggccagcatcatcctgataccaaagcctggcagagacacaataaaaaaagagaattttagaccaatatccctgataagcatcgatgcaaaaatcctcaataaaatactagcaaactgaatccagcagcacatcaaaaaccttatccaccatgatcaagtgggcttcattcctgggatgcaaggctggttcaacatatgcaaatcaataaatgtaatccagcatataaacagaaccaaagacaaacaccacatgattatctcaatagatgcagaaaaggcctttgacaaaattcaacagcccttcatgctaaaaactctcaataaattagttattgatgggacgtatctcaaaataataagagctatttatgacaaacccacagccattatcatactgaatgggcaaaaactggaagcattccctttgaaaatgggcacaagacagggatgccctctctcaccactcctattcaacatagtgttggaagttctggccagggcaatcaggcaggataaataaataaagggcattcaattaggaaaagaggaagtctaattgtccctgtttgcagatgacatcattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccagcttacaagggatgtgaaggacctcttcaaggagaactacaaaccactgctcaacaaaataaaagaggagacaaacaaatggaagaatattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccgaaaaagagcccgcatcgccaaggcaatcctaagccgaaagaacaaagctggaggcatcacactacctgacttcaaactatactacaaggctacagtaaccaaaacagcatggtactggtaccaaagcagagatatagaccaatggaacagaacagagccctcagaaataataccacacatgtacaactctctgatctttgacaaacttgacaaaaacaagaaatggggaaaggattccctatttaacaaatggtgctgggaaaactggctagccatatgtagaaagctgaaactggatcctttccttacaccttatagaaaaattaaatcaagatggattaaagagttaaatgttagacctaaaaccataaaaaccctagaagaaaacctaggcaataccattgaggacataggcacgggcaaggacttcatgtctaaaacaccaaaagcaatggcaacaaaagccaaaattgagaaatgggatctaattaaactcaagagcttctgcacagcaaaagaaactaccatcagagtgaataggcaacctacagatgggaaaaaatttttgcaatctactcatctgacaaagggctaatatccagaatctacaatgaactccaacaaatttacaagaaaaaaacaaccccatcaaaaagtaggcgaaggatatgaacagacacttctcaaaagaagacatttatgcagccaacagacacgtgaaaaaatgctcatcttcactggccatcagagaaatgcaaatcaaaacccaatgagataccatctcacaccagttcgaatgtcgatcattaaaaagtcaggaaacaacaggtgctggagaggatgtggagaaataggaagagttttacactgttgatgggactgtaaactagttcaaccattgtggaagtcagtgtggcaattcctcagggatctagaactagaaatatcatttgacccagccatcccattactgggtatatacccaaaggattataaatgatgctgctataaagacacatgtacacgtatgtttattacagcactattcacaatagcaaagacttggaagcaacccaaatgtccaacaatgatagactggattaagaaaatgtggcacatatacaccatggaatactatgcagccataaaaaatgatgagttcatgtcctttgtagggacatggatgaagctggaaaccgtcattctcagcaaactatatcaaggagaaaaaaacaaacactgcatgttctcacttataggtgggaattgaacaatgagaacacttcgacacaggaaggggaacatcacacaccaaggcctgttgtggggtgtgggggaggggggagggatagcattaggagatatacctaatgtaaatgactagttaatgggtgcagcacaccaacatggcacatgtatacagatgtaacaaacctgcacgttgtacacatgtatcctagaacttaaagtataataaaaatatatatataaataaaaaaagatcacaaactaaatattgagcttataaaataaattagaatgaaaggtttcataataaaaaaagactaaaatagaagttggaaacattggatgcaatcctatatttgctttttcctaccaatatgactttggaaaattttcttatttgtggaccttagctttcttatcttatgataatgtttgcaccagcaaggtcttagaggaggtactaggcaatgtggggcaagggagagcgactttattagtggttacagtgaccaaagagggctcctctcacaaagccagcttcatggtgtgtaacctgtgcagtcacaccccacgccatgctcagaagggcccaggcttggtttaattctctgctgtatgttttgaacaagggttcctgcattttcattttggggggtcctatgaagaatgtaaccaattctgatcctactgatagtgagaaggggctagggagcctttaatgtcctgcagagcacagggcagccctgtgcagtgaataattgccctgtccaaaatgccctgatgagaaacaccaaatgctaagtcatggttgaactctgaagggctgcaatttttaactagcttactagaacctaatctgaaatgttcaagaatagtgtgtgtttttcaaaaaatttgctttgatttatttcatgtacctaaaaagagtatgacgggtcgaaggcgactgaacatttagttcctcattttttttcctgagactgataatataccctatatgagccttatatgctttgaccttgcttctcatccattaactgagctgttgaagtttagatgattatagccttaacttattttatttctggttattagatttgttaagaaattgccaactcagtaggctctgtggcaaaaacaattatgattcctggagaatctctgatgaataataacgttctaagctgagcattttacttacattatttcatttaattttcccatcaatcttttaggttgatcattattatcctaactttatagataaggaaactgagtctcagagggcttaagaaagattagatgaaaatgatgtgtcttcttttttgacttctcaactgctattagatgaaacctgaaatccgtgagtttctttcattccttgaattttcccccagatgtattaggcctcactggaagaattaatgttggaatctactgatatatgttactgttatatacttatactgtagtaagcccctaagttggtgatattttcatgttgcaccaaaatttattatctacttggttgagaatataatactgtacatgataaaaatatactgaattaggaagtgcaagatttaatcatttctgaagtcatagaatagtagagctggaagaaattttaaagcactcctgtgccaatccatacatttcacagatgttgaaactgaggttaagataggtttaatattttttctgtattcacataatagatgtatggctttagtgacaaagccaggaatataatttatgagttaaagtgaattattggctcatcactcttcccaaacatttccttgcctccctttggtcagttttatctagatgaaataaaacaaccaatttgatggtttgacagatttcttcttcaatggaaataacttgcatggagtttagatagtctgtggatttcctgtaatatgggagttgtaacattttggagcatgtttaactcaacatagaggtgtcctctttcaaaaggacttcaacttaggtttgactctatgaataacccagcgaaaaataatttcccagtaagttcgaagaataccttaaaggtaatcatatgtattgagaaacagtaagtcctgccattgggacagcgactcaatggtatgaataataggatgaaaaagaaattgaggcatttagggaggttagaagggatattctaatttatatttttggatcaatttagaattcagaagcacttatttgtagcttattgatattcactttttgggtccattaagatgtaaagatggtcaattttataaattaatgtggatcatgaggacttctagatttcctcctgctttctacaattctattaaatgatatttaaaccaaggagataaagcttacgtatattttctttattcaactgtagacttaaaagaaaataaaactcttcaagatacatctcagacccagtgtttgatttttagattgtagccttgatatgctcagccttctccttctcaggcctctgcaatgggcctgaaatgaccttttattggcctggttcctttgatgaatgaactcagcacatttttgacagagatgaaggctggcttttttaaggccttctttagggagatataaatctcttgctgctttggagctgcatactgtttataaaccaaacttcatgcttccaaaatgagaaaactttcctccttctagtcttgcagggtctcacaaggatcactgcgcatgtttatcagcatttaaaagaaatagctaattatggggagtggtctaactaattgggcaaaggtctcaggtatacatttagctcttattttttatctccaactttctttgtgcaataggaaaacagattaatgtttttctttcttaattcaacttacagaaaatgtagggtcagattaactcataagaccctgcatcccagttcataagtcctttccaataacaagcccttctctatactgggcttctctaatatttcctaaggtgctgaccatcagccatccttacttcttattgcattcatactccttgggtaatacattcatttcatgaccccaaacattatatacctcattgactcgcaaatgtgtatttcatgacctccatgtattgcttgatctgcaaactatgttttcaactgactgttagatgtttccacctagatttccttcaggaacctcccagttaaacagaaatcattatcattcttgtgtcaacaccacccgtctctgcctgtccaattttttctcttcatatattttccttcttggttcataacatgataatcttatccagtttgggcaattgaagtaacttagataaatcctcagctcttctctcttgccacccattttataggtcattaaatatgccttttgggcactttttattgaagtattaacatacatttataagtatttacaaattttaagtgtgcagttcattgaatgttcacaaagtgaacagacctgcaaccagtaactaaattattcgcacacttaaatcccccttttaccccactgtcttcattatctctgcccatcaggggtacttcttacttagcatttaataaaatagaatagttggcctgtttttgaacttaagataagtggaaccatactgtatgtattctttttgtctggatacttcgggccaaaattatgtttataaaattcatccatgttgttgcatgtagcagaactttgttcattctgattgtctagtatgtgctggatgaatatttcacagttcattgagtcattctactgttgatgatggacatttgatttgcttccagtttggggctatagtcatgttgcaatgagcattctcatacctgtcatttagttcacatatttatatatccctgctgagaaaacacaaggtcttgctgtgaatagaatgtgcatttgttcagcattagcagatgttgccagatagttttttaaagtggttgtaccagctcacattattcagttcaattcagcagttgttccatacagcatgttgttcaataccaattcagcagcatatgagaattttcggtttctccacatgctcactaatactgggtattatgagccttgctcatttttggcataatgttccatatgaagtggtagctcatcatatagttctcatttgcattttccctgttggctgatgaagttgaacactctttcatacatttcttgaccatttaaatttcctctattgtgaaatggattttcagtctttgttcattttttaaaattgaattatcttattatgtcctagtttcaagttctgcatcagattatgaattgcagtttttccttcccacattgtagtttgcatttttcattcccttaatggtgtattttgatgaacagaagttcttaattttaatgtagcacaatttatcattgctcccttaatgatgagtgtttttaattatctatttaagaaatattagctatgttttacaacatttaaaaactcatttgatggtagtatacagacaatgacactctgatgggtaaaaggcagaactctttgttactggcagctccaaatcagagaaggctgccaggcagggccccataggggatttcacccaagaccatggtaacaacaagctggagctacacggggcagcttatggtaagcaggatgtgtttagctaggtcttccaagcttctcacggattgcctaatctgaatgatctccggggctccagtgtatagggactatccttaattgtttcctacctggttctggggcaataggggcaggcgcacagtggccttagtgtgtgagatcaaaatagtagaaatagttgaagtgtggctttaatcagctgctcagaaaggaaaactgattgtcctctagccagggcttcaggactgggtcaagaaaccattaaaaaaaaaaaaaaagcaaatgtacagactaccataagaagcattgctttattttccatatttaggtctagagttaatctgaagttaacttttttatgtgaactgggtgcaagattcattattgtccacatggatagctacttgattcatcacaatttattggaaaaaagttccatttgcaaccatgatgcagctgtttatttacctctctttctactaataccatgccatagtaattactatagctttataactacagcatctgtagggatcttgatgtcttaacatctgctcatgttactctttcagctgctgttgtacatttgccgttttcattgtcatatgctcttcctccttcttttccctcatccccattccctttcccttcttcttcctcctctttctcccttttcttactttttcttgtcccatcctccttcttcttcctctcattctccttcttctctttctctttttctcctttacttcctcctcctccatcttctcctccttctccttctacttgtcattcttcttttcctccaatttttccttaactgttttagaaattatttagaagttctttgcctttctatagaaatcttaaaggacatttctcaaaatcccaacattttaattagggtagcaatgaaacaatagagcagttcaggggaagaaatgacatctttataatatgagtctttcattccatgaacatgatatggctttctattgatttggtcatctttgattttctcctttggtgcttggtagttttcaacatagaatcctgtatgtattttgttagatttatacttcaatatttttgagccatttaaatggtattgcttttatttaatttctactgttgtacagataaaactgatttttgtataatgatctttaatctgtgatcctgataaaatcattttagttttatgtagttttctgtaaattctattaggttatctatatagacaatcatgtcatacacagatagagacatattatatctaacttaattggatttgtttatttctgtttatttatttctccttgcagtcctagtacttttttgcctcatgtattttgatgctctgttgtcaggtgcatacctgataagtactcctacactttctcggagaattcactcttttaccattgtataatgtccctctttatctccgataattttcctttactaaagtcagctttgtctgaaattaaggtatctagtacagctttctttcgttagtattagtgtatctttacatatcccattttcaacctgtttctgtatttatacttaaaatagtttttctatagaccacatgtaattgggtcttgttttttatctgcttcaacaatctctttcctataataggtatatttagactattttcatttacagtgattaccgacatagttggattaacatctaccatgtttgtaacttttccacttattgaacttgttcgttgtttcttttccccctctttttctgcctgccctatttttgactgagcattttatatgattctatatctctcctcttttatcatatcaactatatttctttaaaaatttttgtagtggttgacttaaagtttgtaatacacgtttacagctattctaagtttgacttcaaatagcactataccacattatggatagtgtgggtaccacataacagagtattcataattatttcacttatcctctatgaaattgctgtcattcatttcacttattcatatagtgttatcaccgaatacagtgctactattattacattaaccaaggagttatcttttagatcaattaaaattttttaaaaaatattttattttacctttgtttattctttccccaacactcttcctttcttcatatctatctggatttctgacatttgtcactttctttttccttcaataattattttaacatttctcatagaataagtttactggcaatgaatttttcagatttgtttgtgggagtctttatttcttccttactattgaaggataactccactgaaatatagaagtacctctttttgcttgcatagtttctgataagacatctactttaattcttattctgtttctctctcggggttttttactactgtgtctattagaagctttagtttgggactgctatagctcccaggctaggatatataaaaggcaaaaatgaaactatacaaacagaaaaagccaaacaggggctcactgaatctttctttgagtactgagatccttattcagttatcctgttgtgatccctttcagaatattctaatagatgcttcattatgcattttactccagagtttttggttacagatatggaggaaatagagtgacatatgcttactctatgttgtttgaaaccagaagtgacatttttaatactatgtgtgtgaggctaagtttcttgttaatatcctctgatacatagaaaattttttaaagccggcaatccacccagtgatatccataccgcaagttctgttttgccttctgtaggtggtaattccaatgtcaattaagtttgcacagccttttctatattccctgaagctgcccagtgcatgcattagtcaaggcttcatctaggacttgggccatggattatattgtggatcattctggataccttcactgcggtggtttttgtttagatttgttttgttttttggctctgtgctgcacgtacataggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcagaaatcactttttcctatcaaaaagcagaaaaatgagccatgatgattggaatccttcctgatcttataggtagactgggaaagcatagctgggaagagcacagacagggagatcagaagaacctcggactgccacaaaatgtgtaatgccaggtaacctaagccagccagtcaatttatctggggatcacttcttcacttgtacagcgaacaagatgaattagataattgtataattccttggagctctgaaattctactgcacaaatagatgcctcgtgatcgctgttgagatgaggtcttccagagcctgtgatcccagatgtgattgatcatcttgccagagctttagccaccttctcacctgttagacaattcctgcccctgtgtctctactgtatcgcctttcacagctcatatgctgcacctatgcagtcttcttcagggtaagctgtgtgaagtttaagtttcttataactattaaacttcatcttgcaaaggattcttcctttgaagaccaggttgcaaagtaaataaaaatgaaactacacttgataaagcagggatgggaagtctgtaaccttatccttattgtgggatatttgaattgtctctattttttgctatttgtcttcaagttgtcctaagaaggtgggatcaatatcccccatcctattggttcagagtcaagactaatgatgccacacatgcatgaagagtgtatggaaacatttattatttacatcatgaggctttctagggagagcagaggaaacacccaagcttttctattagatttgagtgaggaaggcacaagtggctttggtttctactgtgtgtgggtgtgggctggcattagggctcccgtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaacattaaaaaattaaagaagagcaaaataatagaaagtccatattcatgaattaaaagtcttaatattatcaaaatgacaatatttctcaaatttatctagattcagcacaattcctatcaaaatctcagctggcttttttttttttgcagaaattgaccagctaattttaaaattcatattgaaaagcaagggatccagaataacaaaaataatcttgaaaaagaagacaaagtaggatgacttgctggtatggtttggttctgtgtccccacacaggtctcctcttaaattgtaatcttgtaattcccatatgttatgggagggacccagtgggagatgatttgaatcatggggatagtttcgcccatactgttctcgtggtagtgaataagtctcacgagatctgatggttttatcaggggtttctgcttttgcatcttcctcattttctcctgctgccactatgtaagaagtgcctttcatctcctgccatgattctgaggcctccccagccatgtgcaactgtaagtccaattaaacctctttttcttcccagtatcgggtatgtctttatcagcagtgtgaaaacggactaatacactcacacttcccaatttcaaaacttcaaaaacagttatgaagaaagtatagtactagtatgaggataaatgtatagatcaatgtaataaagttaaaaattcagaaataaagccttacatttaaggtcaattaatttttgacagtggtgccaagacatttcaatgggaaaagaacaaccttttcgacaaatgatgatgaggcaacagaatatgcctgtactcataaataaagtttcaccccttccttatacaatatacaaaaattaactcaaaatggatcatagactaaatgtaacagctaaaatgataaaatttttagaagaaaacataggagtaagtcttcatgaccttgggctaaacttcttagcaatgataccaaaagcaaagcaaccaaagaaaaaatagtgacccttagaatcaccattaaataggaagatagtaccccttgtattatgggccttaatttctataggccttgtttttttaatctgtattgggacatattaactattttaaccagagatggattattctattttaggttcgtggtattccatttttttaagctgattttcaatgtcaaagatttaattttatttcaatttattactcattgggttaggtcatatctactacgtgatatatgttaaggcaacaggtgctaaggccatggagaatttagagaaggaaagtgtaccagtagtcaaggtgaggcatacctgtttgccctctactttgcatttggtaagcaccctaagagtatggtaactctttattacatatagatcaatgtaataaatttatgtttaaactcttaggggagttaccacatgcaaaatagaggacagtttaaatttggtgagatccccaaacataactgtaatttgagccacagaattagttaagaccatgaaggtttgccaattcttttcagcttagcagattttagagttagtttcaaaccctgtgttttaaaatacaaaagctaattggcatcctttttacttttcaatttttattatatatttttagtacattttagatttctaattggatcaaattatggatctctgttttagtttcccccaccactcacttttatttacttgcttttaaatttgacggttgctggatacactttaaaggggttgtgtcttctttgttcagatgtatatatacacattttcccttcagagagtaccaactcattatcatcaagctgagggacctctcccatggcagttgttttattggatagggtactggcttaagtagagtttgaattagccctttaacatgttgataagccacatcactcaatgaacaccgtgtctttgttggtcaattttatatataatagttgtctgttagtgtcctctggccctttaagtggggcagggataatgcattcaagtctacttctcataaaggtctgtgctttggcagccatggatactctttccctttaactttgaggatcaggttttcttttggtggcagagggataggcaggtcaggtatgtgtgaatgaactgttcctaggagtgtagacctcagtatgccacagggtgactgtttgtgacacaatggcacccaaagggtccatgtattacatagcttatcagtatcagtcttttctgtcattattgaataggattctttcctggttgagacacagaacaaatagtattagggtaagaattgtttccctgaacctatcataaaccacagcttatgctagaatagagatttaatctgaggcacaaagataggcccaggctgagacatatgacctagggcaactttaagtagcaccccaatcccatactctcgtccctaaatgccaatattgaaacttcaacttaggttgattaagtctatagaagaggcacagtaggactcagcaaatgcagctcaaaatacatgctaacctgcagccttccaaagtgtctacttgcctgccagaagcagagcctgttagcccaccaaaagcaaaggacaaaagctccccaggtgatagtggccatcacctagatcatcctcatcaaagggccagttgtcaggtggttgcttagcagagaagtggaatcaatcaccccctcccaaaattggttcagatgtcaagacggacaatgccacaaaagcaccaggaaggtgtgaaaatattcattacatcatgaggctttctggagagagcagggcaggcatccaagtcagtttgtttggcttgagtgaaggaaggagcaaaagcctttggttttttattgtgcttagggagtagtgttggggagagagttcccacatgtgtgccaatttttgcattatttgaacttccctccttgtgccaagcgagggagcacactggctttcttaccagcctgcccagatgtgaggctgggggaaaagtgaaggagtgcagcctgaaaactgtcaatggtcaaatatcaaaactggaatcacatactttattacgccatttaaagtaatgccattgtagcatgctggtgcacacgtcttcatgggatccatgaagaaatgggcttcctggaaagctagaaatatgaagatagtgcttttgttcaagtacaattggtactgactactacctctacctgcacaagaacgaagaaagttcttgcctataaaactgctaataaatggatgtgcataaattattgtaatatattcttctggcatgattatgcaagctttgagtgtaaagggcagttgtattgaaaaaaaatgagctgtctattaccttgcaaagacatgtcccaacctactaaacatgcctttcagggactctgagaactaagaaataccatggtatgctgtgatgtgctgtttctgcttctgttctgtgtggccacttcacttatgggacttaatctaatcctaaaatgtgggagtatgtggaaatgtttgttcttgtaactccatagttcattgaaattaagtgtaaagcatttctgaattagctaaatgttcttcagctaaatgtctagaaaataaatttaaaggccagtgtatctatcaaaaaaaggttttggaaactttcattagttaaatatgattatttggggcaaattgaacctcgaatttagtggtgtaatttcactaacttaagtatttaagccattaaaaaataatgaatgtatattagaaagtatggtagattagacactctgaatacacgtctttttttctcttttttttgagacagggtttcactctgtcacccgggctggagtacagtggcatgatcttggtttactgcaacctctgcctctcaggctcaagcaatcctcccacctcagcctcctgagtacttgggactacaggcttgtaccaccacacccagcaaatttttgtattttttgtagagacatagtttttcctgttgcccaggctggtcttgaactcctggactcaagcaatctgccgcctcggcctcccaaagtgttgggatttcagccgtgaggcaccatgcccagcccccatcctcttaaacagatcttatttctagataaataattattgttagtgcatttctgggtcagctagaaataggagctatcaccaaacaggagaaaacttaagaaaaatgccaagctgaaatcagagaaagaagtacgtgttttccccaaattcagacattgaaatatagagacaaagccttggacccaccatacactgggggatatgaataaaaaactcctttgttagatctggatccttgaagtttaatcaagtggtttcttatttgtagcacagatccttcctaaaagaaagtttcataagcttaggctgtcaagatttccacaggttgataaaaggcaaatatgagctcatgatcagaaattagcaaacacttaaggaaatctcacataagagttagcaaaagaaacagatttgaatgccaaaatggtatcagatattaaaattatcacaatcagaacataaagcaaatttgtatgaaatgattaaacaaataaaggtgggttaaaacagagaaagcaataagttttttttaaaattattttattattattatactttaagttttagggtacatgtgcacaatgtgcaggtttgttacatatgtatacatgtgccatgttggtgtgctgcacccattaactcgtcatttagcattaggtatatctcctaatgctatccctccccactacccccaccccacaacagtccccagagtgtgatgttccccttcttgtgtccatgtgttctcactgttcaattcccacctatgagtgagaacatgcagtgtttttttttgtccttgtgatagtttgctgagaatgatggtttccagtttcatccatgtccctacaaaggacacgaactcttcattttttatggctgcatagtattctatggtgtatatgtgccacattttcttaatccagtctatcgttgttggacatttgggttggttccaagtctttgctattgcgaatagtgccacaataaacatacgtgtgcatgtgtctttatagcagcatgatttataatcctttgggtatatacccagtaatgggatggctgggtcaaatgatatttctagtcctttttaacaagtaaccagtttgaaaaatatccaagtaaaactttcagtataaaaatattattgtatatactttaaaacccacagttaaatagactatcattgaagagagaatattagtaaactagtaagttgctctaaagatattaatatatacagaatgcaacactgaaataaccagaaatggaaagtctaagaggttagatgatatagaggcttgaatgagaaagtttttcattcaacaaatcaaagttccaggaagagagaataggaaaaagataggagagccatacttgaacaggtggcagctgagaattcttcaaaatgatgaaaaccatgaaaatatatacgatacatatggcaaagcatgcagataaacttaaaagccccacctaaccaaaaatattaaaactgcagagcaccaaaaacaaagagaagattttatgagtagccagaagacaaaagttacctataaagaaatgacaattagaaggcacaaggcagatttcttggcatcaaaatggaagcagggaagcagtggaattatattttcagagtgctgagagaaaaataaatatcagcttggaattgtgttagaagtaaatctatctctcaagaaggagtgcaaaataagaaatattggtatggacaaaatggaaagaatttactaactgtatattcaactaaaagaacttctaaagcaggtacatgagaaaaggtataaattatcctggaagaaaagtgtgaaatgatttaaaggaatcatgagaaaaaaatggcaaacatataagtaaatctaaaccaacactttctttattaaaacataatttgtagattttcacaaaaggacagaaggaaatcactgtcaaatgtaacatctaagtcaggaggaagtgatcagagtttaaatgttcaggcaaaggatttaagatattaatataagattttttagatcagcaatttgtgatatattttcacgaatcaccgccaaaaaaaagagtgtttaaatcccaacctagtgaagcagagaaatatatatatataaacatatatatatatatatatgtaatcaagaaaagagaaaaagaagcttagaagtggaacaaatacaaattccgaagtaatatgctagaaacatgtctaaagggatcaaccatcacaatcactaaatggactgaactcacaagtgaactaccgacattgtcctattagatgaaaaaataaataaacccaactatatatcctttaaaatatatgtatgaaaatataaggacacacatgtttgaagatataccaggcaatggcaaccaaaacaaaatgagaatatctatctatatatctgtctatctacctacctacctacctatccatctatccatttatctatcatctatctatctatctatctatctatctatctatctatctatctatcatctctatctgtatctctgtcgaatagaatatatctctcatatatagaattcaagacaaaaagtattactggggacgaagaggacctcatgtaatgatagacctttcgattcaccaaaaagattttttaaaatctaagtttgtatgtacctgttaaaatattatatttcatcatacctaagataccgacatttgtaagacgtgctgttattttatctaccactgtcaacagtaaaaaactcctgcaactaaactatgaaataatggtttcatattatgtcaattataagagatcttcattttgagatgttaaatatgaaaaaaactgtcttagaattaatgaagtatgatagcttcacaccacttaaagcaactatttatgtaagagaaaaatatataaaaatctacataacagtaaaagatttcaaaatatttctttcaattgtgatagctcaaacagaacaaaaaaagatataagagatgaataacaagctgattttaatggacatatgtagaactgtgcacagagaacacacattcttaagcatatatggaacattttttaatttgaccacatcttaagctataaaagcaaatgttaacaaatttcaaaaactaagtatcacatgttctctgactacaataaaattttaatttagaaatttatactaaaaagttaactagaaaaaccccatctgttggccaggtgtggtggtttacatgtgtaatcccagcactttgggaggctgagaagggtggattgctggaggaaaggagttcgagaccagcctgggcaacgtggtgaaaccccatctctaccaaaaatacaaaaattagccagtctcataacccagcctcaaaaaaaatttttttttgaaattgaaacacatggctcataaaaaataatggaaattaaaaatccctagagttgaacatttatgaaaataccgtatattgaaaaagtggcatgcattcatttataatgaaaatctgtcaaggaacaaggagttgaatggaactttttagctaaataaagagtatctacctaaaacaaacaaaacctatagcatactttgttcttaatggtaaaaagttagaagcatttcttgtaaagtcaaaagtatattcaaagaaaagtaaattttcccttccatccagactgtcctgcagagacaaaaacatattcatatatgtttggcagggagaaggacataaagagaaagattttgttttggtttggcttgttttaagatttttttaaatgtttgatatacggtgacagctttcccacaaaactgtactaattgaaacttctaccaacagagtgtgagagcattcatttcactacatgatcacaaacattacgtactaccattttaaaaaatagcaaaatgcctctttaaaaaatttatatgatgccttgtgggactcaacttgctcaatgagtttattgactatttttatttttatgttataaacagctcttcttatggagctgttaataatgtttgcttttatttgtaagaaatgtttactaaagtaggtaataatccttcagctgtcatagatgataaaaagcatactttttttaagtttgtaatttgggttttacttttttatggtgttttaccatggcagaggaaaactttttacatggttagacctaacaatattttcttgtattttttcttcctttgcttttattgtatatccctagagattggagagtctctaatcgtttgtggtgatcgttgtctaatagttacttttcttgtgttggagtatctggttaggattgcaaattcatttagtcctaatatttattaaacagtgcttcatttcctcactgatagaaaatatcaactttatcatagtatatattattttgtgatagaatcttgttcttttccttctattttgtaacactaatctttcagtttttttttttacaagttccatgttgtttaactattgcagcattatttctgagatcatgataattcttattactcaccctgattattcttttttcttttttgctcctttttattggatactgttttaaaaattacaaacattatccaccctcttctatttcaagatgacgtcaactattctttttaaatgtattaactaagaggaatgcagaatcattttctaaagttaaaaataaaaacttgtccaatctctgatatatttttttaatagtgtttgacccataaaattagggacatctgaagtaggattctaaagtaagaaatatacctgtttgtttggaaaggtagaaaggaaatagttacattctcacgtaaccaaagttttaaaaaattatctagtgtcatttatctgacattatttctctaaagtgcctcatcaactccagccagacaaatctcttcattattcctgcttcaggccatgcacatttcaaattctcaggctttgctgagaatgttctttgccagggatattttttctctttctttctgtttattaaaatttgtttctttaaggccaaactctagctccttcatcatgaagcttcttttagtatatgttccacagagtttaaacattttagaactttttctaattataaaagcaagaaaataaactcatagaacatttgataaaaaatagagacatattttctataatattaactccctattatgaattatatatatttccttgcagtatttcatatgaatacatagttgtaactctagtgaacttacaatttcatgttctatgttagcatggtttcatgcttttctctgttgctccattctattcattattaccatttttttttttttttttttgagacggagtctcgctctgtcgcccaggctggagtgccgtggcgcgatctcggctcactgcaagctccacctcccgggttcatgccattctcctgcctcagcctccagagtagctgggactacaggcgcctgccaccacgcccggctaatttttttgtatttttagtagagacggggtttcaccgtgttaaccaggatagtctcaatctcctgaccttgtgatctgcccgcctcgacctcccaaagtgctgggattacaggcgtgagccaccgcgcccagccccattattaccattttaatgactatccaatggtccatagagtcaatacataattatttaaataatctttgctttactacctgtcccttatcataaaaagctctgcagagaaaatctttgttgtgtagctttcctttctttggggaattagttccttagaataaacatcaagaattggaatttaggggagagaagcgaaaagcattttcaggctcttgaaatgttttttcaggtggctttcattcaccagttttatgtatgagagttctagtactccagttgacttgattccctcagatataaatattttttcgttattatttaagaggaaaaaagcatgttaagcattttgccccaattctctgttattgtgtattagttagctctcatgtattaattttgtttccccaaagagactgtaaggtccttgcatgagactagagataatgacttatatttattctttataccccacaatatctccccaaaagtgtggcagacacagttgtcttcagtatttgcttcttaagtgattgaaaccttcacaaaattcctttttgttcctcaaactcaaggccaattatgatagaaaatttggcaagtagcatatttgtggagtctcagctccaaaaataaacccttacccaaacctcacttgtaggggttaaacttatgcttggaatcaagattaactgaaattttcaataaacatgtgtatattgagtttttcttgaatttcagactcattttatcctagttcttatccaattaattcacaaaacataagctatttaaccaccaccattttcagagattgctcataggaagaccaaagaacatagccctagtcctctaaaactggtgtcctaggatgctagaaagtcccttgcctccacaggaaagcaaaaggcaactataattgaagtaccctattgccatgtgttttcagctacacttgttccccactttatcctagttctagaacggtgccagggatatgataaacagtcaataaatatttgttgagtggttgaatgaatctgtgtgcataggttgaatgaatcaatcactctgcaaatatgtattgagctctcgcaagatgcaaagcccagtgtactggttactagaaaaacagataaagttgatggatcttatacgtggcagtgggctggatttaatgaccttgaggtttcatccagtgcatttttctacaactcatgtgcatttcttttgaaacttacacgtcacatccacaagccgaataaaactcctcaagctgcatttctaggatgatcccccgccacctctccctgagggcctgaaaagttgtatgctgctgatttctggtgcgggcaactcctgggcagggacaaggatggctccagatggatggatgcctttgtggagggctcccttttatccttagttgtaagccgcctgagcagttatattataaatgggtaatttaccgcctcatccccaaggcctcttctgtgggctctttcatggacactgttaccaaaagttaccaatatgcctggtgcctttgatatttgtgggcactgcagaccagagaaaaagagttgctgccttgtacagctgcacactggctttcacatgtcctgcaaatgggtacctgccagccatcttccccagatgtcatactgaccattgatttttttttttttctgcttgctattgcagttattaactacagtgaggcctgggcacttagctctccactttaattattcatccttatgaagaaaaatttcccccgtgtgctttattgtcctccagccccgacctgagctcacgcagactcttccttctttccctccccaaagtggcttgtgtgtcgaagggctttccactggggtgcttattccatttatgcctttagtatgcattttgtgttctgccaagggggtcaggagggcacatggagaagccagatggcttacctcttccctcaggaaacacgccgctatttagctgggcaccttcccaactcaaggcggggtgagattccactgttggagagagagttggttcaaatgccactgtccctgagatcacagctccaagttcctctaggctatgcacttttctacttctctgccacttgctggagttttctgccagaaacagccttttaggagatattagaaaggggggtgggaagggagggatgggaaaaagcaactcttgttatttatggtcctcgttcaggcacaagtttctgttattttaatccggctgaaataagaaaccataatccatggatgaaaagatggtggacaaactcagttaaatcttgagcaccctgaggatgtgtgtttttccctatttctggtttttgacgttccttccctgctgccatttcccaactttaacttttgaaaagccaagcagtttggctggccaggcccagggaacttatttgtatgcagcacaaatttcagaatctgttctcagcctgtgccgagtgaaaaatggcctgcattttcttgatagcccatgtggttgtaaagaataaatggctaatgaattacagatgaacattgacgcaaattaatcttcccgctgtccctgggttatatggcagccatttaaaagtttaatcaatacactaaagttgaaaacatgcaggcactgcagttgtttggatgtaataaacatcagagggaaccgggaggtttgcacccagtccatgtatcataatgacaggtatttatgtttaatggactaaatattttttattggaagggagcaaatgtcagcttaactttgtgagccccgcattcaactttcctttgaggttggtgaaagacggctgacgtgtcattggaaatgaaatgttaagggagaaaaaaagcacaacggagacaaagcgaggatgggagccgtttggagacgtggtgcagcgcttacattctgcagcaattcattaacgaaaacgtaaactctgatatttctaatgttgctgtaaaatggtttactaggaacaactttaatggttattagtgaaaacaagtacccagatctgccagatatccttttcagtgcaggcttttgtttgaaaactctttaccaggtcatatttgctggagatttataattagtctttttccttaatgtgagaagtggaggagaaacagcgtgatggctctcagctcttgtattccatagatctttccttttgaacggtgtccaatgacttcgaataaccatgtgttctcttttggaatacttatatcttaattacttttcaagtcaatattttgtacctctgccgtgagtctggaaggaccagggtagctaaaagagaaaggaaattgccagtggcagtgccatctcgctggacaaaaacaggctgagacacaggagagcaatggcttcacttgaacagaaaaatacagacttagttcagcttttcattttttttcctccacatataaaataaactaaatatgtcagtggagcatggggtcttagaaaataacacacactttataaaaataattagaaacgttttagacaaaggatatcgtgtttttaatgtcccttctgcaaccaattgtctcaggtcctcttcagtgtctgagggcacattcaatggcagggcttggaagaaaattattcagtagatagcaagatgaggctgaaggatgagaaaaagggacaggggttgtgatacttatccagtgttcagatcttgcaaaagatatgaattgcacctttttatgtgttaaataattttgttaaaatcacaagaatttgtgtttctaatgggcctaagtttcataggtaatcagtattatgtgatactaaattagtaaaccaaactgatgggttcattggtccttcatcatcccttaagcaaaatggggagaaactttctgttatgaaaaccgaagcatggctcactgttaaccatgatgacatctcacccactactgctcctgaagtcctaaactctatttttcttcctacctctttctaccctcttagaggattgagtcctttacctgtttgttcactttgtgtttccgccgtgtgaatataagctccacagtagggggtaggaggcaagaacctgattttcttctttgcttctagtgtcctggggcctggcctataataggttcttgtaaatggcaggtaagtgaatggcggactacatttcttatggtctttagtaatttataactccggctattttttttgttagtcagtatgatttctagtcactgtgttagttgttttacatataatacaatacttgatcttagttgttaactctagaagataagagttattatcttcattttatagaggcaaaaactgatgtcaagagaattgaagctaattatttgtggttactgttagtatgtagcaattccagaatttgaatcctgacctgtttgtctctgtatcagctatacagtactccccaaattcctgtcactcatcttgtccctggggattaaaatctcattaagtgaccacaacatttaattctagactataaccagccagctccccaactggctgataatgaacagaagtattagattcacaatttgcaacctaaacctggtgtcctgagtcctacctatagaaagcaatctttgactgtacaaaagtagcacattggctatttgatgatgggtgatatgtcactcaaatatgtgtgttctgtggtctagggaaatacaaggaactctctcaaatcatgagaaaagtgttcagcaacagaaatctaacaaatagtgactgaaatgcataggcattaatttcttcactcagaagtgagaatggaggtaggcagcccaggacagtgatagtggctgaaagagcagatcagtaggcacccaggtcctttctgtctttctgtcctactaccttttcagcatgtgcattttagcctcatggtctcaaaatggttgctactgctcctggcatcatttcctcacccaaagcaagatgaagaaggatgtctttcccttatgaggcattcgcttttcatttgtggatagacagcttcctaaagatgtctgtctctttctcattacccagatcatgtcattgggaggctggaaagtcaaatgtttcagttttcatgctgttatagtagaggaaggcaggataaaagggagccaatgcatagtgtctcctatgtaagataaatcgcattttttgtatacctaataaagacttgaaactttgctagatgccatatgcacatcaacttatatcatgtttacaaccaccttgttacagaagagtatttattcccattacactaagaagaggtgatctcattgttcaattcccacctatgagtgagaatatgcggtgtttgaaggggaatatcacactctggggactgttgtggggtggggggaggggggagggatagattgggagatatacctaatgctagatgacgagttagtgggtgcagcgcaccagcatggcacatgtatacatatgtaacctgcacaatgtgcacgtgtaccctaaaacgtaaagtataataaaataaataaataaataaataaataaataaataaataaataaataaaaatgccctaaattatcaggtctgacaaaaaaaaaaaaaaaaaaagaagaggtggagctgggatttagagctacatttgtctgtttctatcataggtcttctctctaatgccatgtttctttggccaccattttgatgtcatagtgaaggatgatttcatagtgaaggccattcccagttgttccagctcatggtgaatgtgctgtcttctgagggcacttaacagttgggtctgcctctttgataattaagtatgcactaccatgtgccagcttccatttttgtgtattctgtacagagtgtttaagaaggtgggtcagagactcactgtctagatccagatcttggctctataagttactatcagtgtaatctcatgcaaattacataacctctctgcagattgaacttttggagaccagggacatgattttttttcccctcttgatatctcctaaaacactgacaagattctatttcacattagagccactgagtaaaaactcattctagaatcactttgaatctttgtttcattgatttaacatctttttgccttagcttctgaatcctaaaatggggacaagaatacatctacttcatagggttgttgtaatcgttgaatgagataatgtacctacttaaagtttttagaacagtgtgtgatgcatagaaaaagctcagtgttagctataattattataatcattcatggattgccagtattcaaactctaaaactccatgggatataatataatctgtaatgtatccaaaagcaatttttcttaggccatctcaggtacactattataaagaataaccatatccttctggtgaagccatattgagcatctcctgcaatccagggagtgtggtatatgttggagatacaaaaatgcataaaacacagtgagaaacatgtggtaatgaacaccatgagcaatattcactctcgataataaccaaatgcttaaaaagtaaagcaactcttggatataatatttccacttattaaactagcaaagatgtttaaataggcatgcctggtgctatggagtggattgggtgcatattaatatgtttttgaaaagcattttggccctgtgcattgaggctagatgcattcacttaggaatctattccaagacaagaatccaagatgcataaacacaggatctttatacactaaaatattcactatagtaatgtttgtaacatcaaaacacacaaaaagtcattatccaactagataagaaagctaaataaattatggcacattcacagaacacaatgttatatagtattcaagtgatggttacatcagatttaatacgataggcaaatatttaagtaataaaataaatgaagatggatatatatgaatgcatccatacaacatatggacagaaaaaaggccagaaggcaaaacatccaaatactaactgtggttagttctggacagtggaattatatatgatttttattttttaaatttacacttaatttttttacaatgaacatttaaatataataagaaaacaattaaaataactccccaaacaacaatatagtctttatgaaaatagtttcagagagaaggggagtgataataacaaaaagagtttatgtgagttagttaagaattgtattcagctacaactagccccaaataccagtagctttaagaaaatactgtcctataacatgaatttcagatgtaggcagtccatagctgttatgatatcactaggaacacaggcttctttgattttggttctatcttccaacagactggctcccatcctcaagtttgatttatggtcaccatattattgctgttgcactagctcttctttccaagttccaagtagcaggaaggaagaaaaggcaaggtgagcactgctatgctcaacagcataggggctctgtgtataagatgaaagaggaatatagatactgggtagccggccttactttcagattttaataataactctgccattcaacagcaggttgacgttaagaaaatctcgcatgtcaatgacaccaaggaggcctccagaaccttctgaatacagtgccgtatgcaaccactgtcatcacctgtgcttggtgatgaatctcatttgccattccaagcctctgttacctcctgtgcttttgtttcctcctctttaaaataggcatattgaaaattcactgccttttatgattgtggtgaggataatatgattttatagttgtgaaggtcttttggaaaggcttagtatgctatgcaaatgtaatttttacaagactcatggcagccaatgggaattaagggctcactaaatgctattaatagtcactgctgaactccttatgtgcagaatttcatttaatttggggaatgagacattatgagtgtccccattttacaggtacagatattgagagacaaagaaatttgcacccaagttatctgcctcttgattccatgacatttgttctcaatcttaagtgtgcttaagaatcatagtaagcctgttaaaaatgtagatgtctaggatcagaaattagattctgctgcaggtggcctgcaaactacaattaatggctcagttctacctactctaaactcttaattatccagcaatgtggcaaagaacatgttcctcagacagagctcttcgggctcctgaattctactctgacttttccttgatcttctctggtagggagactatagctcttttgggtagaaaatgcccttttggcaagaaaaacttgccagttatttgggaggctttgtcttcttacatggaaaaaggtcactaatttctgaagctacctcctgtacagtagtatgagaatcctcagaggtaagaagacttgggccaataggtttgactttgttggttggattttcattattttccaaagagaaagtctttgaggccaagcataagggctgatttgccaatgggacttagtttccagtaagatcaagagtgtctaccacacacctgacttttgaactttcctcttagcccactaatagcagaggtgcaatgaggagatcttcatttggcaatggataggctcccaaaacagaaagcatggacatgccatttaaaggtcccaggagattgatttccaactggaatgcaggaagagtctaagagtaactgaaatttggaaacactgctagttatttttaagactactctttcttgaaatggatcagaaccaatagaacaaaccacaggttgtgatagatttatgcactgaggaatataggaagagaaagtaaaaactatgggcaaggattttcataaactgcatcataaattgatttggtgggccccaaggagaacataaacactatgcccaaggactcagggatttgacttttgtttagatccattttataggcaatctgtaaaaggaaaaaagggcaaaaataatattagttatctcataaagttgtttaaaaatcaagtgatgagaataatctatttaaaatacttatcacagtgcctacacataggaagctcgataaagttagctatgatgatgactgtaatgacgaggaggagcaggaggaggaaagggagaaagagaacgagagaggcaagaaatctgctaaggttttgctccatgaaatgtctttcagttgaaaattctcattgaaacagagaagctttgtctttataactagaagatgcagtttgaaaattgtatcatggaatgaaacacaaaatgtttttcattccatgaaagaattccataaaagagctagaccgtactccacgtggtgttctgcacatagaaggtgatcaaataaataactgattctgtgaagggctaaaggagattttcagaatgtgccatgcttctggggacaattggctttctgctatggtctcaatgctgatgtagaagataattctatgaaaagatcctcagaactgagaacttctgttttttccatgttaatgtttagatagccagaggacttatcattctaggtttgggggcagatattttgctatgcctttcctgttactgttagaaagaaaatccccacccctaccccgccactgtcacagtaataaagcactgctcaatgtgtctttagcacttcctgtccttgggaatctgcctactgcttctctaatatgggagagaccagcccctgtgctgaagcagtcagggactgtaattaccttaatacccagtaatggatcgttaggatcatgccacacagtccctatggtacaagagactcggaaattcaagatgggaagatgagaatatgtgaattgaatgacatgggtgagagtaaatttcccatcttttttctagtggaggaaatgcattaagtcttttgatactaaatatgatgttagctatagtttttgtttgtagataacttttatcagtttgaggagcttccccttttttcctgtgttgctgagagttttatcgtaaatttatgagtgctgaattttgtcatttttttctgcatcaattgaaatgattttatttttttaaattggttgatataaatatatcagttatatttatttttgaatattgaaccaaccttgcatctctaggataaagtgtacttggtcatgatgtattctactttttatatattgctgaatcttatttgctatgtgtattatggatttttgcatgcacattcatgaggaatattgtccagtacttttccttccttttcttgtaatgtatttgcctgtttttggtatcagtgtaatgctggtttcatggcaagtattcctaccccttcaattttctggaaaagtgtgtgtagaattgctatcattctttattaagtcattggttaaatttgtcattaaaaccatttgggcctggagttatcttcatgggccaatagtgaactctgcattcaatttctttaatagacatacaggccttcaggttattcacttcttctttagtcctaagctctttttttgaaaagatacattacacctccttcaaacctctactttaagttctggggtacatgtgcagaacatggaggtttgttacataggtatacgcgtgccatggtgttttgctgcacccatcaacccgtcacctacattaggtatttctcctaatgctatccctcccctactcccataccccccgacaggccctggtgtgtgatgttcccctccctgtgtccatgtgttctcattattcaacttccacttatgagtgagaacatgcacaaacctctacttttaatcattgtggccatcacataaccaaagtgttaattcacggcttgactatgaattcttctcataaccttctgggccttctgtttggtaaacagagaaagttagttcctttatacatttatttattcattcattcagcaaagattggaaccatattttgaattgtaggacatgcaatacaggttgtggtttcaaagatgagtcagacagtatccttgggttcaagtaaatttcttttaagagggagtaatagcaatcaaatgcttgactgtgctgcagtgggatatgtgtagtggttgtgtgatgggtagtgcacagaaagagaaaacaaggaaccattaattctgccaaggggaaatcagagaagtcttctaagaagaaatggcattttatttgggccttgaatgataaggagagttttatttggcaaagaggagtcttgtcatgtgaatcatcatgggaggtttggaggaacaagccatttcagcttttcctagggttagaacctttactttaggaatgcattgttttcttcttttgattgggaaaaccaaaatctgaatggtaaatttaaaagttacattgctttagttatcacagttcttctaattgtgtgtttctcagatgaatatgacatgcctcttacgatcttgctacagagtggattttatgttaaattatggcttcctggtgattctcagagttttatatcccatttttatttaaattattttcatagttgtaataacaaataaatttcttattcaaagaagatgcagcctttgaaatggatcttaatttgaatgttgacattccagtaacaaaacaaaaataaccacttgtagatggagagcgagagcgagagtgagagagagcgagagagagaatgaatcacaaacacctgtaaagtgtaactattagtttcaaataggatattattgaatctgtcctaaaaccagttgattgtgattattctaaattttaccttgagtatattgaccatgacaggccaacttcagttcctatatccggattcaactggattcattgcactttgattctaccatgaaaaacaatgcctttgtgtaaagtcatgagcacttctttcccttcttggttaactgtgtttagatctttatcatataagacctgactttatgttcattgttgaaattgttgctggtttcttttgctcttacacacccatgctggcctccaagaacaacttgctgtcattcaggagcttgcaaactcattgctttaattaattaacggaggctctttggaagttagggtcatttgtttttaattttcagttaaaggcacctatggatttctattttaagaatagacactgtctactttacttgcttattatactttgatactaaaatacagctataatggttctgcagcattgccagttatttaagtattcctgagtatttaggtaaaggctggatggcttggaactactctaacatggcaaaatatgtcatcaatgttttgctccaagagtatcctgtaatgtatatgctcaacttgagaaacaaaatatattataattttaggtttcaaagcataaatccttaacatatttactggttactacatgctgggcacagtgccaggctcttaagtgactgcagtagactgtagacagatcagacttcttgttctcatgaagcttggaatctagtgggatgctcattcattgacctatgaatacgtactgtgttatgtgccagacactgtgatagatcctgtgctttgccccacaggtcaaggcactaatatagtattatgtttggtacatagttggcccataactcacagtaaaattaacctttccattctctttaacatattacattattacatattaaggaagaatgtgaaaaaatgtaatcataatatcagagattgctttttgctcacaaaaatccacattttctcctgcttttggggtaccaagctagacttcatttcattctcctttgcagttaggagaggtcacatgagtgtgtcacactcgtgaaagatatggccacatgtgtgtattttagccaatgaaatgttcgtggaagggatgcgtggcagttcatgaccaaggcttttgagaaatggctgtgcctcttccacattctttccctttccactggcctgatgcaaatgagaggactcaataggagaaggcagagccacaaaaattacacctggaggaaattgcctgtattggccttttgagtaagaaagatgtaaacttctattgtgttgggccactgaaattttgggacttatttgttacagcagcttgtataatccttgttaatgcagtaacaggatagttataagatggctcattataaaaattatgacagattatcaaggcatattccaaaaaatattatcatttggcaatgataatacatgtcattcagaagctgaagtttctcattgtcaccttgcgggggtatattgacaaagattattattgccattcaaaatatgaacactggatctcacataagtcatgtgacctgccaaaatttgcaaacctgaactacagaggagctagtaccagcatctaggtattctgtttcttagttctatccacccaccccattatactacctccatgatatttatgtctaaaattattatagttgtttgtttctaaattttgtctgcttgctttccttgcctgtcttccaccagcagattatagtgtctgtgacctaagactttgctatgtgccaggcaatagccttgcatatcctcacacagggatacactgccgtatccctagctaccaggatattgcccagcacatcgtagactctcagtaaatagttgtgtcatgtaagaaagcatgagtccatgaccagaaaataacttttcaagtcaggcattttgtaatgcaaattaaacatgggtcttatgcatttttgtgaaagaaggagggaaggaaggaataaaagaaggatgcattatatatgtggaatatatgctcttgagggggttggaagaagaggaaggcagaggatgaaggcattgaggtggggagggacaaataatttcccattcttaactaattttttaaacaactgattgctgtttgcagaagatgcgttggcctaaaatgatcataatcttttgttagcttataatgcttaaataggtcacttaaataggactcttctaatagaagagaagcccattatacagattaataaaaattgatagagacttgaaaactgctcatggggtcagttatctccaattaaaagttcatatgccaagaaaaacaagcctcttcctcctaaattattactgtgaaaattttcaagcctacagaaaagttggaaaaatagtacattaaacatacatatattctctacctcagttcactgttaatattgggccatatttgccatttccctatatctctgagtctgcctgtgtattatatataccattttattttattctattttattttatctttcagatgaagtttcattcttgtcgcccaggctggagtgcagtggtgcgttctcggctcactgcaacctccgcctccccggctcaagcgattctcctgtctcagcctcccaagtagctggaaatacaggcatgtgccaccatgcccagctaattttgtatttttagtaaagatggagtttcttcatgttggccaggttggtctcaaattcctgacctcaggtgatccacctgccttggcctcccaaagtgctcggattacaggcatgagtcactgcacctggcatatagataccattttaaatgagacatttaaataaattacagacaccatcacacttcatccctcaatacttcggcatgggtctcctatacgtaagggcattttcctgtgaaacaataataccattatcatacctaagaaaattaatgttaagtcaccattgttacctaatatgtgcagtccatagtaacatttccccaattttcccaatggtgtctcttgtaactctttttgttttaatccagtatttaatcaaagtttatactttgcatttgatggttaaggcttttaagtcttttccaatctagggtgatggttctcaagggtgggccccagaccggcagtgtcacatcactggggtctccgggggtcgatccagcaatctttgttgaaagaagctctccaggtgattctgatgaaactgaagagcgattgatctagagcatgttcccacctttcctacttttcatgacatttcatttttatcaaaagcccaggtcaatttcattttagaatgtcccacattctgaatttttctgaacattccctcatggtttgattcaagtttaacattttggcaagcataggtgatattggcatatttactgcatcatgttatgaggcacgtgttatttaatgatcccttttccccttcttagtgatgctaagattgatcatttggctaacgtggttaccgccagatggatcccctctaaaggctatgttcccctttataattaataagtgacctaaagactgtgtgaatattttcttccccaataaactttcacccaatagttgtaacagccattgataatacttgcctgaattactatgttggtgcatggtaatttttctaattttgtcactccttctatattaattagctgtcattctttaaataagagctttctttcttcccttgcatctatttgtatttatatttgcttaaatattatgatggactcatacttattaaaaaatcaaatgtatcaaataattactatcatcattatttccgatattcaaatagtgccaaatttgttcacgagagagcttcttcaaacttctttctgtgctctttccctgctttctggcacaacaaaatgttctaggcttactgtgtacattccctgccccacaacatgaatcagccatttcttccagtagcccttgttattttggaaaccagtatgtggatgctagatgccctacacacgtgcatgacttgagcacatgtgtgcacacacacagtcatatgtgtatattttaatcataatttcttacagatccctccaattcaaatttgcagagctattgtcaccttcttcttatgcttatcctttctctctgtaggtcagaagtctgaccttggtcttcattgagctaaaattcaggtgccaatggggttgtacttctttctggaggcccaaaggaaaattttgttttcttgccttttccagcttctaaaggccatacatattccttgctcctggccccttcctccattttcagagccagtgacactgcaccgctctgacggcttttccatcgtcacatctgcctctctgatgacagtcttaaaagcttcttttttttaaaggagtgatgtgattagattgagcccacccagatagtccaggataatacccccatctgcaaagcctctcttgccatgtcacataacgtattcacaggttccagggattcaagtgtggacatcttgagttattctgcctacctacctcatcttccctcattcttagttttatttctcttctctctgaaaatcctgacttttaacaacctcagtatatttacacattttctctgttctacaatatacacaaaataatttgagaaggataatagcaataacaccaacaacaataagcctactaagttaaagctcaagatttctttgtagttttctgttacttagaatatattcaggcatgtagttgaagtactgtgttccaaaattactttaattaatttctttgtatagttgtactatagatttaatatacaattaggttcatttttttctgtttgtattcagacttagggttcacattttccatcctttccaatttattttatattttgagtgtgtaaactatatgatgataaagagacatattcagagaagtccctgtcccatccatatcccctttaccctatttctacccaccagctacacattgtcattcttagtctctggtttatccttcccacattctttttggaaagcatagatggacatgtgtatatgggtttttttttaaccttgtttttacttctttcttaccaaaaagtagctgagtttattgattttatttttgcttgttgcatttttacttaacaggatatcttgcatatatatgtatatatatatgtatatacatatttatatagttatatatgtatatatatatgtatatacatatttatatacagttatatatatgtatatatatatacacacacacacacacacatatacagtatatcctgggaatcactctatattaggtagtcatggaaatcttgaaaggagtaattattaaattcttaaatacgtcttctggattgtttaacttgttacaactctgtataatatttgtgacttaacacaactataaaaaggcaggcattgaaagaaaatgtcttgtatgccttctgcccacctcttccctccctgaggcagagctaatttttttcctgtgtttgcataacattttgtatattaaagtattatagcaacttttattatagttatttttatttgacaaaccatctccctttctggcctgctagttccacaaatgtacaaagaatttctctctttccttttcttttttctttctttttagaggtgggagtgagtagcaatgattatgcctggcatatggtgtttctccatttacttattttgcctgaaattccattagagatttagtcagttggtctatttttataatagcgtctattttaaaaaaggtataacatcctaatatgtattaacttatcagagactagccacttcttagaaaagctatgaaaggtcagatgagaaaaaaggacagtggtgtttggattctgtctctgatagaaaccccaaggaaggcaaggaagagtacaagggttgtagatactctaggaagaagagaggatgaatcaaggaaaggaaaagaggagacagaaagagaaggtctgtatcatgatgtccactatgtgaggtactcacagcacaggaaatctgcctagatgataataggagtgatgttcattaggaaagaaatagccccaaggagttttttctttacatgctaagaagctgaggcccagagagatggaacaggtttcccagggcaatagcactaggaactggagctgcaaacttttgagtccaccatatccaccctgagttgaggtgatctttcttatgatcctgagagggaacctttgaaatcaagcaggcacccctacttccccaggggtgggcagagggcctgagcaatccctccttttagagcactttgcagctgggccactcatctcaagattggaatgtgccatctccatctttcctgacctccttcagtcaagtcagctgtatttgtggaggtgcattgttcagtctcagagcattgtttaaatttaaaatcaatagagaaaagtgtgccagcgagaggcacagactgattaagtgctgtctatatgaagaggtttatcctctgccacatttctgttgaaagcctgtgaaacatgaataggatggagcaaagtgaaaacacattaaaaattatgtcagatacccaaatgcagtaaagcaactgcatctctgacaggtaatcaagaattgggtgactctgagttctgatttggcgtaatgatatcaacatgttcacacacacacacacacacacattccttgtatacacataacacacatacaagatacacacacgaagtagacacacaacatgtagtatgtgtattgtataacacaacttacataaagacacacagaagacacacacaacacacatacaaacacctacatgcccatattcaacacacatgcacgcaaaacatgcaacacacattagtgcctgcacacatgtgcacatgtgcacacattgagcaacacaataaagatgtaacttttccatctcccaattcattctacatttttattttgatgaaaagatagcagtagagggggaaatctcttcatcagaaaatacagtgaaaaaattcccaagacattgtcacgtattactggttatttttggtggtgaagagaattatttgaaaacaaagaagcctttcacaaagcctctaaaatacaaaagatttaataacatttacatctgtgtatcagccatgtctgtaatgcgagtcatgaataacacataaaccagagcacggaaagaacagaagtgctcacacatcatttaaaatccaacccaccccatcgtcggtggaatcaaatacacagcaggggcagttccagttgctacacacacaatagagtcattggaaatgaaaacatattaattatgttccttaaggttaggagagaaatagcaggattcactaaacctttctaacttctctgttgaaaatttgtaccaaagagtacatcctgggttgcctctttatttttcctaagaaactgcagaatgagcatgtgtatttgttttgttttactgtttattcgagtctgcacttggggctcagacttgcctcattgttgtactgaaaatggaagaaagttggcttgggaagatggatctttgttacgagtgaataacttgcagaaaaattacttgttttaaatgcttgacaatacctgcacaagtcccagtggtatatgtggaaattcttgctgctatgaaatgagtcatatagtatccagtcctagcacccatggagcaacatgtttgaccatgaaggaaatcattccttagtctgatttggataactgtccgtggcccaaatttggaattgtatgttcctaggtccattcatttggctcctatgtatatccagggtatccagggatcttctaggctggtgagagatcatcaaactctgctaggaggcaacctctagtgccctaatagagaagggtgaagccgggaatgctggctcacgcctgtaatccaagcactttgggaggccgagttgggtgggttacttgaggtcaggaggtcgagtccagcctagccaacatgccaaaacctcatctctactaaaaataccaaaattagccaggcatgggggcacatgcctgtgatcccagctacttgggaggccaaggcaggagaatcacttgaacccaggaagtggaggctgcagtgagcccagatcgccccaccgctccagccagggcgacaggatgagattccatcttaaaaaagagaaggataagttcagggaaaattgaactgatgatttttgggtgagttcatatttattctttaagtcagtattgtgtttttgtttccaggggtaagaagatgttcacataatgctaatgttagattagcacattttgtttgcaggcttttgttttggcatttatttctccttcttcctctgctcactatttccccttctactgctaggcttccttctgatggtgtcagaacacggcatgccagtccagagtagtttaaaacgagctctgtaaatgtcatggaacccctgcctctgcctcccctatgtgtctcatttcagtgtaaaatttcaagcacttccctgtccttacgccgcaaaaggttaatagtcatcttttttttatgtactgtaaatgctcaattcctaaggatagtgtttcagggcaagttgagtgtaattgctaaataatatagtaattctctttttaaatgagtcatacttgcgttgttccagatgctcctgcatgcatgtgtgtgcatgtatacatgcatgcatgtaggtgtgtgcacgtgtgtgtgtgtgtgtgtgtgtgtgtaggcaggcatgagtgaggcctccccttgggggaagtcacagccatctcataggagtttgcacattttcacatttgggttttaaatgttgtgccacatcctgggcttttaggtgctgcggattatgtataatagatgacctgcatttacagagatgtgtgctatacagatgtaaatgttattatagcttttatattttatgttcttgttgaaagatcattttgtctttgaataatatggccgctcaattttttttggaggggagggggttatctttaaaagagaatatgaaatggatattgcacatcatatatttcttaaaagtaatttggaattttagggtctgggattggggctgactgatacactgccgtgatgagatataacccctggaaaataacagcacccgcacatgcctgcatctgtctaacctcataattcactttcacattggattatggatgtctgcgttcagtgagtctatcttccctttaggtattatttcagccctttgagataataaggaaagtttaattgcgttgttaattgattttttgcacaacattattaccttgattgattgcagagttgatgaaaatgttagacacaggcagcgtggagtatcagccaggcaaggagtgggagccttgtggagaatagataaccttgatgttaagagctatatccttcagatatgtcttcccttgacatattgatggcccctgaaaagggaaaagctgattgtatgcagaatgcaatcattaaacccacttcagctcactgttgattaatttgttttttcctgaaggatctagttatagggaaggcctcacttgtaccaaccacagccattttccaggttccagactgtgcttaaccctctaggtgaagggaagtgaggaggctggcttgcctgagacgggaagattatcttagggtgcgcagggtgtgtgcttaaggctcacaaggtgtctccatgctcgggaacactctatgtccttcaccatagtgctgattttccttaaattattgattctttaaaatgccaatagcaaggaacccttcactgagacctggtgtaggatgaaactgtcacttggagattctcaggaaggtgttcaccagtccagtggtgtcgggagagacatggcactcaggagcttttattatacattaggtaaaaccctgcatgagattgcccccatgattggagaatttagttgttattggggtgtgcctgtgtgtgtgtgtgtgtgtgtgtgtgtgtgtgtgtgtgtgtgtgtagagagtgatgataagaagggatttctgcagacagtttcttatattgtcaattactcctctccctggccttatatgacactttcttagaaaagtttattgaaagccatcatcattttttctgagtccagggccatcttcatggtagcaaaaatcaggttgattgatcagttggtttactgattgattaataggacttctgtcctgtttccctcccctcaactcacaccacttcattcgcaactgcccaaccctgcacagagactcagtgggctgaatttatgggcaaagaagttgcccctctggaagaatgcaagctcttatacatgcagtactcctagagagcctcatcttctagggagaacggattgctacttctgccaccccctcgccagcttccatgcttattactcatggaacattctggcttattttgccctcttctttcctttgtggctgtgcccaatgttcattcaaataaaatttcaattgtatagcattgctggaggcctaccaatagttacatcagcttcctggagtcctgagccccccccaggagaggtcatgtgggcttctccctgcaccacagagcaccctgtagacggaattctctgtgtgatgctaagcacagtttctcctcaggctgccccaccgcctgcattatgagtctttcttctcctgaactcaccactggtgctcagggagtctaatatccatagagtcttggccctcaattaccgtaatggcttataatgagattttggccaagtagcaggtagcaggttattacttcctgctcagcgtgggcaatgtctacgctgttaatttgtgttgccgaatgtggcttagagctgggcatcaaactgtcggagccagatgtattctattaggtgcgaggctcacattggcccatgggcaattttttccccccaatatggaagcatgttaacttaccacagggtgaatcctgacaaattcaagccagccaaataaaaggggtaatatcccaagccatcaaagtagtacattctagggacagataacacctggtaccacccactgtcagcagtgtctgtctgactggggcattctattgataggcaaaaaacacacccatcttaatattgctggagaggctctggtgccttcattaagttttaatgagcctgaccctaatgaaagcccttataacatgctcttctactattttccttgtctttatcttgggtagaaaaaaatgtacagaggttcatataactcttataacctgctttctactattaattcttccttaacctacagtttcttgcattaacatatacatacacatatacatttacatatatacatgcacacacacacacacacacacacacacacacacacacacacacagctttttcccaaagcaggttagaggatgggaagttgaagatcaggaaattatgaacatattttaccatttggcactgggatgagctagtgtccaagaattatgctgtgctttctgcaacaacagactgggtcattttttgtaaagcaaacttctttcggttagattatatatcatcagattccctttgttttcttttcagagaaagcaatttagggtgtgctggaattaggaaagattatggtgatatcagtacaggaagagtttgtttggattctaatgaagagcaggtggaggctggaccaatgggcccaagtaaggaaggccttttccccaatccttgcagggtttgaattatgacaaacccagttgttacagggtctgcttaattttatttgaaaggtttctttttttttgttttttattttgtttttttttttttgtagcttgaagaattaggaaaacaagaaagcaaattgtctttattttcagtgactctcttgagaaatttcagcctgcagaaccagacagaactgtggatgttccctgcttttgatgtaagctctctaataggaacagatctgaagcccaaaagcaaatttctgcttgagagcaaagccaaaattcccattcagactctgcaggaggacccccactgctcagatttcttcatacaagattctgtcagttttggggaagtccaaagtctttctgtgaaatttttcctgcaagttattttttgattatactccataaatgatggttcagatctattctacatatccaaagaaactgttttcttcttttttcctgttaatgtaattgcacattactaaaatttgaatgtttatggtttttgttttagataaagagctggaacaaccttttattattattattattattattattattattattgttattatttaggtatcattagctttcagactgctattggggataaaataaaacctccatttaccaaaactcaagacactagaaccctcagttaaccagatttttggatctctgattttagacagtcttgattttacaagagtaaaaagcaatgtcacgagttttactttttaaaaagaaataagggcccctctgtaggttgtcctaaaacagtgtttcttaaagttggtccctcagcatcggcatcacctgggaacttgcaaaaatgcatactcttggccccaactcagatccatggaatcagaaactctggggaacggggcttggcaagctgtgttttaacaggccttctcagtgattctgatgcatgggcaagtcatagaaccactgtcccagggccaacccatacatttctacctataactgtccagggatgtataataaatgctggggttcagaataagtatgctgagatcttttcatctattccacaatttaaaaacaatgtactgcatacctactgtgcccttggctttatgatgcatgggcgaaagtctattgttttcgattttttggagctcatatgagcaggagatcctaagatcttgagaaatgttcaatctgcagtcttcccaccccagctaatctcctaactgtactatcctcactaaaggcactccagaaatactcagttgtggtcactatgattacctagtaagacagtgaaactgactttgcttttagtgtcttatgtgtgaaaattcaaaaaggtttctagctaaccatgagttaatgagataatttaattaacaaggacccaacattctccgagtggctagttagtcacatgactgttatattaggaaagctaagaagatgtgtgagggccattttatacttgcctcactgaccacttgagaggcctctcggctgaaatggagaataacacctggacccagctctggtttcccctgcctagaaggccagtaactccaatttgtgtttactccttccctgattgaatccactcatgtatttttatcctataaaattctaatttaaaatgccattccctagaatgttatacctttattgctgtttgtttgtttgtttgttttttaataatgatatgtttgaaatatctagaagcccacaaatacctctttctcctaaagggaggtgatcatctgttgttccaggtatgaaaatagttacttgacccatgtaccagagaccaatgatggggatcagatgaggatcaaacagcagctggaattattgtcatatttttatctgagtagcttctgcctctcttttttgatgacactgagaccaggtaccctgagagggaagacaatgctaggtagatttgtggggagggggagcattaaaagaggataactttgtgtgtattgatccatttttcatttttatttatttttacgttttttacttttttgactgtcaaatgatggcatatctttttgaactttcatggtaaaaatgatgttttccacctaagaaatgcaggaaatctttagtattttgaatgcttctttacatttgtggaggtgatatgcaaaaatccccaatctctgagcctggaagattaattagaacaattgatggtaaagaaattcagtccctgaaattgaggcaagaagaaccccaaaatggggggcaaggagtgtctgatagccccattcctgaaaaccttcagcacagattgaccaaacatgacatactgatcattaaggaacctataattggtgaccaaaagcacagtgtggctataatggctctccctgaatagttgccgccatttatttatttatttatttattttaagcaagcggctgctttcctaacttcatgctgccctctagtggtgatgctcccgacttcagctagaaggtggaaaggatgaatgtagagataatggcgggaatggaggaggtggtgacggggtggctttttcctttctttcttttttctctcctgtctgaaagatgtctgagtttctcactcaaacattgagaaagaaacgtgaggccagagcacttgaccactgtccgctttgactgacagcctggttgatgtgacatccatcacggacccgcactgaagggcacttcacaaatctgaagggattcgcatcccatctcggcatgcactttggaatccagcccatctcaaatccattaagccctacctagaatacagacataggagagaagggaaatacactcacaccaaactagtcttgcagttcaagtttctctctaagaaaaagcaagtaagaatgagcctgctaagtaagggtgtgggtgatctttgatgttctccggagacccctggttcctgtgaacaggactgaacaaataaataatgaatttgaaaagtaagcggaaaagcaaaatttatattcctgtcgccaaggcagtatcttataattcagggatatttctgggctagatagagttgtatgggtgcctggtccggttctgtcactttccaaaagccagttggaaccttatttttctccgctgtaaaatgaaagaatttacctaaaatgaggttctttaaattctttctcagcttgagaatcctccaatacagttaaagaaatacttacaaagaaaagtttaccattctgtattgaagcatactaggcagtacagcaaatcacagagaatccttataggacagtataagcaattcattgtttaggaagtcaagaataaaaactgtttcaggcttcatctttggcttggaccaaaaaaaaaaaaaaaaatgtaacctgaggctaaaaaacaaaatttggactgctaagaagatttagcagtttatttgggggctggggaggagaggggttgttggagtaaggaaatatttaccatggagtttgacctctcatatttataatacatttctgtttgattgaaatacaatgtgtatagaggtaggagccaaaaaagggagctcccaataaagggggctagtgagcccaccctccaatctgagaatctttctgtcagttggtactcacttgttactacccccaatccaaaaaaataggaaattaaaaggcattgacatctaagcaaaagtacattgtctgtttcctttccaggattcacataatggaaatattccctgccagataatgtttaatctgttagcctaatatttctttcatgtggaaaggactgaatggcccactcagtctggatagagccacaacgcctgtaacctgagtgtggggtccaggacccaagatgggagagtagagaatgtcactaaggatctgctcaaagatgcagtaatttctcagacttggaccagcttttccattttccactgacagattatatgacagactatatgaggaacttgccctgcatttttttctcctctctttccttccccacctccccttcttcttctaagatgacaagcctcatttcagctgccctgggagcccagggtatgttttcttgaggctctggtttgtcacacgacaatgagcctgcccactctgtgactacctgtgtagcctccctggtctgggaggctagccccacagccttgcctgctgatcaccttcacgacaaattttgccagtatcccttccctgctgactgacttccttcccctgtttttccttccctacaaacaagtgggtgagacttgacaaggcccagcatttgtctgagcaggctgtataatctgtcctctcccagtggaaagctgcactggacgggtctgagcattggagtcaaatgccctcttgtcaaaaggataggttgcctggcatttttgctagctttctttccaggtatggtgcatcctaacccttgaattggtgctccacactctaatattttgtctggcatttggtagaagacagcatatcagaaccccacagtttagaccctatcatgcacttggtattcacctttgtccttcatactctttgtgctaagaaatgaataaaaactagtgtttactctactttatgataacaatgttggtagaaataatcaacctgggaaaaaaaggacagcaactaatcctgcacgtaatataatttatgatgaatgaaaaactgaccaaagatttatatcttgttgatatattgaaaaccacacaaatacatggggaggaattaaccttggtagaaataatgaaaacaaaataaaattgaaatgagctaaaactacacacaataaaatttgttgactaaagtttaagagcagactcaagtcttcttgtcgcaatttagatctgcaatattttactcaagaaaatgggactttgtaaaaataaatgactctaaaagagatttagaagatgtaatcagcacaatttaatatttggccagagctgattgaggaatttaaccttactgtaaaaattacgtgataaagaattgatcccattgaaaataaactcaataaaatagaaatgaaaatgttaaaaatagaaatggttttttgtatttaaaaattgattaaggaattaaattggctaaatggagtttgctgtgaataattaatgctttctcaaagacaaattaccagactagtttacatgtttgtatttataaacctgaagtcaaagcattcctggactcaaatttggagaattcaaatgtctaccaatgcaagacatcagggtcagtgtagcagggtaggaataccccttgtggtgttgtttttgtacagtgaaggtgaaacaggaagcatggtttgaagtggtcactgcggtatttagcaaggacagtgtgcagtatccccgcccccaaccccccacccccggcccccatggtgcaagagccctaacagaggttttgggggttatagcatgcactgttgcgatgcagtaccccattcccacccaatatgcagatgataaaccgagacacttgcctgaagtcctgctcagctaggttgggaaacaagtctcacactttttttttccttctccaccctcccctgggtaaggtgtagagcctttcttcatttcatctccaacctaaggcatctcagatgtgcggcagatgaagggaaaatatactgggtggagaagaaggtctttgtcctccttcctcaaaaactgcttccacacaatcccttcccctaagaccttttaaagtctctcttctttattctgtcttagtatttaagtagcttacactgaagtaggatgttgtgctaggagcctgtcatttctcaggctccactaaatcctgtgtgatagccacagcagagctgatagcacatcacatgggctgacctcagggtattgctccagctacttctcaagatcataaaacatgggtgtttattcctttccagttccccatgtattcacggcctgcacttaacaaagactgaggaatgtgctttctggggaatgtcccttcccactgtatgatgtttacagctctttaggccagatgataatgttcactgcacttctctcttttcaactagatgttgtgattgctttgtttttgtgggaggaaagtgtttggggtaaaaacaccaccacgatttaggaactgtggctgttgcctcctattactctttgttgttcaatggggcaaatatttaatccgtatatattttcagagtgtttcaaatgtctgaagtcataccagaggttaaaagatgagtgtccagcaattgacattccttactttgtggattctgtgtaaattttatgtacatgattattttaatggtattaatttatttaacaaatatttattgaacatctcatctgtaccaagtgcagatgctctccaacttacgaaggttcaacctataattgtttaaccttacaaagccgtacacatttgatagaagatgtaaccccattgtaagttgaagggcttacaacttcagatagtttcaagtaatgatgcatttttgatttacaataatttcaacttacaataggtttattgggatgtagctccatggtaaacaagatgcttctgtatggttttaggtaccgggtgttagaaattggggaggagggagaatattataggggatgacacatttatggacatgtatagagtcccatggaaacattgttctagagccttctgcagtggaccaagacgctcctgatcaccttttcctctctgtcactgggcccatctacctcttcacaacattgttatcaccttttgcaggggtcaggaggtacctagttccttcgtttctcatacagatgagagaacaggagttctgtgggggaacccttcatcccctgcctccatcctaggggtaattataaactcctagtatcacaatgggatcaagatatgtttgtgatttcatagctacatttataaactcatatgaaatgcatttaaaataatgatccctaaagtgatgactaccaaaactaacaatagtgataattattctattttacaaatataaatgtgttggtccaacctgcactccaatgtcaaatgcatttttgtatttttatatgcagattgtttttcaccactaaaatattaatgacagaccacttgctttgatggctgggctttagttctgttgaatacggagttatgagacttgggcttatgccaaagccagtgggatacagcttagttagtggtcagcacttctagctgtatgaaatgcagattgcaggaaagttaatgaaaaccctttcctcaaggattttggggtcccccagaggcccccttctatccaggttatactgtggggttacaggctggatgggtttcaagggctgacttagtccaaatcaatttttttattgactgacctgttgaatttgtctcctgcatcaggcaatattggacctggtgttctcatcttcataaggaaaacattggaaaatgccaaatcacctatttcagagctaaaatgaacctctgagattatctggccccttgcccttgttttacaaatggggaaacctgcccagtgagagaaagggatgtgtacatggtcacatgactgttggggcagggctggatctaaatgcaggtcttcccccacttccccttactaaatagactattgaactgcagctggaagtgtgaggccatccaggaatcagggagtccaggatgctggatgaatggatgtgcaagaattcccttccctggactgggctctcagggcctcccccagcaaaatctctggtactgaccctgcagtcccagcctcacatccaagaaaggaggctgattcccacccacttaggcagccccaaggttataacttaacctgcataattaggatgtccattccagaggggaaaaacatggaaaagataaagggcctctttaaaacagattcttcctgatacttttttttcataattatagctttaacagcttatggtgatgggaaagctggctacttaagaaaaattaggagtctcatttggcaggagagaattccccaggggatgttgccctgtcatttttcagggtctttcgaaaagaaaccccacacagacagctgcacgtcagcctgacacagggcaagcctgctttacttactatggccaaagccagatcttttaattaaaaacactgcatatgccattaaatgtgttgttccccctccagtcccaagaagttgtagtttgaagagatagaaacaaatgaatccgttgcagatgtgtagagaaaccattgcctactgagtcacaaaccagcgggttcccaaattccagcctcggagtgcctccccatcaaaatgttctttgcaagcaaactgttccctccgtaattttcacagttgatggcagttgccatggcgggagaagaagggctgtggggaggacgagggagagagaaacacaatgccacctcacttaatttacgagcagagcctcatattttacaaataaccttcatgataaataaaggcctgtggccacacatgggactgtgctgtttcgtgcatgtttgcttttcctggttaattttatttatttatttttgaacacaaaagtcacatattgggggtaatcacatcccaactctgagctctgggaggagactcacagaggcaattctcgcttaatttcagctgctggagatggtttgagtttgacaatttcagccgattcttagcattgctagccagagcacctttctccccgggcgagcaccagcagctggatctcattttcaactgccaggccgtccccacgccttcctggagcagcccacagactgagtgccgtcctttctgggagtttattcaaggtgacagctcctcacacaatggccttctgatcacctcaagtagccaagatatcagtggggtcgggcgtgctcctcctgcaaattccaaatttagattgactgaggttatccttaggccccttgaccccaccactccagcagaacagaactgccaggacctttgcagccacagtgagttttgtaatgatgtctggggagagatgttctgcaggggcaggcagagacgaccccaagtgatggggagtgatgtcagctttcgttagagccgcaggcagcgttagaatatccttggcataatatggcgctggtatctctgtcagtatctctgttttctgtcaccgcacacaatcctgggcctgtctgcaaccctgatggtgtcttttcagatcaggctgttgccagcacagagactagctcggctcttcaccacacagcccctttgtttgaagtctgcccttttgtcgttaatgcacttgatgtctatttaaatctgacagtgaatgcagtatctgttttcctgtcaagagatcattgacaatattaatacctcatgtccttgcctcattttccaagtgctgacacctagccgcagtctcctgcattcatcaaacagccttctctcaccaggatgtctataaacattcttgcttccaggcccaaagaaacagggtaggccttaaaaaggacttttatcaatgccagccagaaagaaggctcgggaatgtggcacagaacacatcccagcccacgttccaggagcatccagcctgtttctagggcggcacttgccattcaagttgcatgtaagtgagatctggagtcgaagtttaccctggagaaagggaagaaaaaaaaagcagttgaatccgtgaatgtactggagagtttactggagagagggcactcatggtgggtggtgtgtgtgtgtgtgtgtgtgtgtgtggtgtgtgtgtgtgtttgcctttcatccttttgcttaagagaaagattgtgttctttatgacatccgacagacctatctgttcctttttattaaaattcatgttatcctagtgccatagaaataaattagcatcctttggccccatgcttccacattcttcagggtttatttgaatcaattatgtttaaggaagccctctgtggatacctggcagaactgaggcactcccacccaggcctgtagtggatgctattcctggagcagagcctgatcagccaagcccacagaccagcaggatcctggcatgggtgacaatattagtacaatgctgatggctacataattcagcacgataaaggaaacagctcaatgccaacaactaaaagaataatttaggtcccaagaagggtctcagtgaggttccatccaagctcaaagtttccaggcaccagaccaatactgaaaaccagaaattggggattaggggccaaggagaaagcatgaccaaggaggaggaatgagccacagtaaacttactcatgggaacatggcaggaagtaaaactaatgagagtgagcccaaggccagctttgaggccgtggaacaatgtcaccctctctccattgccaactctgatagactatttgaccccagcaatttctagctttgttccaagccatccaaaccagggagcatctgctctgtccttaaaagtttctaaaagtcattttgatccttatgtaagaataaggtttgaagttttgtagtggagaaacatctcttttacagttgcaaaaatatttactacttagaacttctgatgtgaagaacctggttaatttcaagtgctaatttatcacaaattaaccaaaaaaaaaaaaaaaaaaaaaatgggcttgttggtttcacactatcacactgatggaaaaaaaaatcatcatgtccctaggtagctattttcacaggcagatttgtggctattgaatgactgtcttatggacatttcctttctttgtttttttctagttgtgtacagttcagagactcaagtccgattagcgctaagacaactctgtccaactgaatttaaaataggtttttctaaaaatagaagaaaataaaaatgcaggtggcaaaaacaaaacagatttttccttgataatcctacagagctttcataataactatggaagtgatttcttatgggcatttagaataaataatgagttgattaaaaagttcaaccctattgtaggggcatttttcattgttaagtctcctacaatctccttgaatgagaggagagccttatacggagccacagagttacttaaagtaaaactgaaaatggaaatcaaatgcattctgaccagagaaagagagttcaggattcctgtaagaagccatttaatgggaggctcttgttcctgtccatgtggtgtttttttttgtttttgtttttttgtttttttgagacggtgtctctccctgtcgcccaggctggagtgcactggcgcgatctcggctcactgcaagctccacctcccgggttcacgccattctcctgcctcagcctcccgagtagctgggactacaggcacctgccaccacgcccagctaatttttttaatatttttagtagagacggagtttcatcatgttagacaagatggtctcgatctcctgaccttgtgatccacctgcctcggcctcccaaagtgctgggattacaggcgtgagccaccacgcccggccattcatatggtattttgtcaacaccacctctcttccttaatcatcccatatgtgctcaatgcctggtgcctgccagaatttggaatattctctctggaagtcaacaacattgcttcatgataaagggtatcaaaatagtcacattctgggaagattgttctacatcttttacttgggctgggttcatctttaaactcttaattttccattctttgaaactctactaagggaaactggcgtgaggagaggctacattctggggagtaattggccaaattagaaaagtacctagcatgtggaagagaagtcatgcagaaagtgatattcctaggagcctatacttgtagtgacattttatttcaatgtcaactctgaggttgacagaatcttcttgtctgtgaggacaaaaagggagagttcttcccttctggagcttcatccactttctgctgcccattggatctatgattatcttgcatgtctgcttttcagcacctgtgtttccctgctatgctaagtgtgccacctgtaatgatgtgtgtctttttatttgcaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaa

SEQ ID NO: 2653 - DNA, 203290 bp, Homo sapiens
cgattctccttggcccctcagcctgcgcctgagaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatggtgaggagacggtggaggccggggaacggtggaggcgctggcgttggcggcgtcgctggcctgggccgcccgcccactgcgggaccgggcagcgggaccctgggccgaggctggcggcggagcggctggagggatgggatgggagctccagaaaggaggctgggggttgcggagcggacccaggggtgggggcagcggctccgccatcttgtggatgagaggccaagtgacagcgggagcttaatcgaggagggggctccaggcggcgcgcggggccctggagggaaaggggcgtggggactgttactgaaaagcggaggaagctctctggagaaacgccgtgaggccgctggcggggccttcctggtgtcagggttaccggtaaggcccgggagaggaggtgcattcacgactggggaagggagcgcgggatagagtgaagacagatacggtgggtagaggggaacgggcagggctggatgcagatggatttaagggtggaggagggaacgctagggctggtgagaggcttatagttttgtagaatgaggagggaggatagcctttgccttgagggtggaatcccagcttggccaaactactgttgacaaactctggaagggaagaggcctcactaaagaagataaggactgggaatgaggacctagggctataatgacagtccctgggaggggaaaagggtgttgactgtaagctagaattacaaatgtcagggaggggtacataacgctactttgaaaggagaagctaaatactgtaataaggacaaggtgatgaaaagtaagagcagattgtcagggaaacatgggtacaggagattggggcaaaatgagtatctaatagggtaagcaaaacaaaatttaaaggtaaattgtgggacggtaaaatgtggaggccaggtgctttgtatcattttctgggaaaggaaaggccgtggagatgagagttgcaaagacccataagaagtgatgagatcagttgagaaatttaggagataaaaagggtggaggttggtagagggaagtaagtcagggataagtcaggatttgtggttacccgtcagttttaggttgaagcacagtgtgagcaaagattggattttgtgggtgtgcttaaaccccttggaacatatttctttaactttgtatcacgcttttctttttgctgtgcttatctttggcaaactcgtatagtctgatatttgatgcttttaatctgatgctttttgtatttcctaggtgtaaaaccagactttgtggttacaactaaagaatgatggaatgcatagattttaagcttaacaggtggccttagggacattgatattatttgcagtccagtcttgctttttcagaagttattgtgacttgtcactccaaatcttactcctttgcttaaaaaaatagctattttgtatctttgcctaaaataccgtaacaaatccagataaacatggatactaacaaaattgaattttagactttaaactgccccatttataagaatacttttttggaatctagtcaaattcactaaaactttatcttgcattagtgttttcgaaaacacctaattaaaattcaggggtatcattaacaaaatttcattgagcctgaagaaggttcttggatttctgcccaacattaaaattctaaatatgaagaagagaccttgaacttttactggactttagaagtaagtgaaagttactacacttaagttagaaaactgttactgcttatttttgttttcctacttagagggttgactcctttttttcttcttttgagatggagtcttgctttgtcgcccaggctggagtgcagtggtgcagcctccgcctcctgggttcaagcgattctcctgcctcagcctcccgagtagctagaactacaggtgtgggccaccacgcccatctaattttttatttttagtagagtcggggtttcactatgttggccaggatggtctcatctcctgacctcgtgatccgcccaccttggcctcccaaagtgctgggatttcaggtgtgagccacagcgcccagcagagggttgactcttaatcctaatcctgacatttgtgtcagatttatggaataatgtgatttacagatcataaagagacattatgagatcatcctttttactctcagttagacttcagcctagtaacattctcagctacttaatctctgctttgtaccagtgagttatgttttgataatggcctccctggttgagttaaagtggacttggagatgaccatatagtagttgcagcttttagagcaccacacattattaaatcttgaatcagttttcatagggagaagccaattttttcttttaattttagttactttcattattgaccttgcctgctgttttggctgccatttgagaaaaggtcaactagaagagggtcaccagaatgacaccttaataaaagaaacagagaatggagagtttgagattgggtattctctttcagtgcagtaacagtcttatgaatctgagtaagtcacaacttccctttggtgccatttaccctgctataacatgtctgtttattcagagtcagttttaagaaaggaagataggccgggtgcggtggctcatgcctgtaatccaggactttgggaggccgaggcaggcggatcacgaggtcaggagatcgagaccatcctggctaacatggtgaaactccgtctctctaaaaatacaaaaaattaggcgggtgtggcagcgtgcgcctgtagtcccagctactcgggaggctgaggcaggagaatggcgtgaacccgggaggtggagcttgcagtgagccaagatcgcgccactgcactccagcctgggcgacagagcaagactccgtctcaaaaaaacaaacaaacaaaaaaggaagatattggccaggcgtggtggctcatgcctgtaatcccagcactttgggaggctgaggcgggcggaacacgaggtcaggagattgagaccatcctggccaacatggtgaaaccctgtctctactaaaaatacaaaaattagccaggcctggtggcgcgcacctgtagtcccagctactcgggaggctgaggcagtagaatcacttgaacccaggaggtggaggttgcagtgagctgagatcgtgccattacactccagcctgggtgacagagcgagactctgtctcaaaaaaaaaaaaaaaaaaaaaggaagctatttgagctagcatcaaataattagtgcacagtacacatggaagaactatccttttaatcaaacgggcatttttattactatttggctttgttctggtcttaacctttccctcaattgtgaatcgctaatgacaacttttatacagatgtcatgatttccatggtttaaacaaatgtaaaattagtttaaaatgccagaatgaaatggatactctcacaaatttgctcattgctatactaaagtgccttgataaagaattttacaataaaatcctgttaataagactgctgattcagagatgaccataattcacacgtgatcgagacttaaagcttattgttttacttgtgaaaaaagtttaagcagaatgtttaacttttaaaaacaaataaatgatattgaaagcaacggtttacattaacttacgtgctaatgtctctcattcagctttagcaggtcctcaaggacctttcttaatacttttttggttaacaaaagtataaatggaaacttgaagagaacctaagaagagaaatgaaaatgattgagggaatatagaccccaaaacacacaaacacacacacacaagcacgtttaagataggggttgaaaagacatactgaggaggaatttgaactttatttttgttttcacctttgagacagggtctcactatgttgcccaggctagagtgcagtcatagcttgctgcagcctcaaactcccaggctcacatgatcctcctgcctcggcgtctcaagtggctacaggcacacaccactatgctggctattttttttttcttttttgtttttgtagagacaagggtcgccctttgttgacaggggtggtttttgaactcctgggctcaaggggtcctcctgccttggcctcccattgttgggattacaggcgtgagccaccttgccaagccacgtttatttttaaaaacaggataaatatattcttgtccagccaatcccagaatcaagtacagtagcttgaaatagatgaaataattttagaatgtattgttttatttatagagctgatagataaatgaaacagtataaagggtaaatatttgctgtttaacagacaacctcaaaacttagcttaaaaaaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcggccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttggtcaggctggtctcgaactcccaacctcaggtgatctgcccgccttggcctcccaaagtgctgagattacaggcgtgagctgccgtgtccggcctctttttgctaattttctaaatttatgtttatagtagattttcataaattatcaaaagtgaattattagatgtggagtaaaaattcaactttgagtagttttagaaattatttattgctaaattagaaaataaactttcaaaagagatctcttttttttaaaaaaacttaattgagacagggtctcactctgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacagggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttttgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttttgtatttttgtagacggggtttcaccatgttggccaggctattcttgaactcctgacctcaggtgatccgaccgcctcggcctcccaaagtgctgggattataggcattagctaccgcgtctggcctctagagatgggatcttgcttgctctgttgccaggttggccttgaactcaggctagggttaagtgatctttgtgcctcggcctctccagtagctgggactacaggtgcgtgccaccactcgcagcctaaaatactttttaaatctcacctactttctagcagtattttattttatttgggcgcagctctgccatcagtaggctgagctccctgcagcctcaaactcctgggctgaagcaatgcctctgcctcagcctcctgagtagctgggactacaggtttgtgccaccacacctggctatatttttatttttttgtagagatggggtcttgctgtgttgcccaggctggtctggaactcctggcctcaagttattctcctgcatcagccttccaaattgctgggattacaggcttgagccaccatgcccagctttagcaattttttttttttgagacggagtctcgctctattgcccaagctggagtgcagtggtgcgatctcagctcactgcaacctcagcttcctgggttcaaacagttctcctgcctcagcctcccaaatagctgggattacaggcacgtgtcaccacacctggctaattttttgtatttttagtagagatggggtttcaccgtgttagccaggatggtctcgatctcctgaccttgtgatccaaccgcctcagcctccctaagtgctgggattacaggcatgtgccaccgcacctggccagcaatattttaatatagcacagaagtcctttctaaatgtgtatagtgagaatccattgaggatgaaatagaaaatatttaccaaagtttaacaacttagtcaataaaaataaaactttctctttccgtaataagtcaatctcagcattctaaaataggcaatggaggggggaagaaatctctatgggaagggtccactggatcttaacagtttcaactagtgttccacaatatttctgctgtacttggggagaatttctggataattagaatagtctgaggcttattccttttagtttcccatagcctgattgagatagagctataagaccagctataacattgtacagaagactcagagataaacaagtgaaaaagataactgagattaatgttgaactaagaatatgattgttctctgaggcactacctgctagttcctggattacctttatatgtggccaaggtggggattgggaagcaagggagcaaaagccctagagctaagggagagagaatttctgcctgcctaagatgaaccttctgagttggatatttttttttcttcccccttgagacggagtctcactctgtcgccagactggagtgcagtggcatgatctcagctcactgcaacccccgactccctggttcaaatgattttcctgcctcagcctcccgagtagctgggattacaggcacgtaccaccacacccagctcatttttgtgtttttagtagggatggggtttcaccatgttggccaggacagtctcgatctcctccttgtgattcgcccgccttggcctcccaaagtgctgggattacagctgtgagccaccgtgcccggccttgagttggaatttctttctaaagtcttgctcctttctgtagtttggctttcctttcagggtatctgattttgccttcctgctcctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggttcaagctattctcctgcctcagcctcccgagtagctgggattacaggcatgcggcaccacacccagctaattttgtatttttagtagagacggagtttttccatgttggtcaggctggtcttgaactcccgaccttaggtgatccgcccgcctctgcctcccaaagtgctgggattacaggtgtgagccaccacgcccggccagaagaaattttttgtgttttgttaatacagtcagccacgaatagctaacagctaacagctggtccctcatatttgtgggttccatatctgctaattcaaccattgattgaaaatattcagaaaaagagaccacaataaaaaataacaatataacaataaaagtgggaattaaaaacaatacgtataacaactacttacataacatttacattgcattattatatgtaatctagagatgatttgaaatatatgggaggatgtgtgtaggttatgtgccgtttaaggcactataagagacttttgagtatctgtggattttggtatccgatgggaggatcctggaaccagttccctgcagctatggaggtttgactataattatttagcatgtactatttgctgttctaaatatactgttctaagctctttatatatattatttcatttaatcctcccagtaatcctgtgagatagattcagtattattattatccccatttctcatttaaggaaaattattccagagaggttaagtaacttgctcaaagtcatgctagcaggtatcctgagattaaatccaggcagtctgacttgagagccttacttacgtgcagtatacttcctctttgaagagcaggaaaactgtgggatatggtggcatgtttccttaatatctgttaaggcacactttggtaaatgctaaaatagaagcacaaagtgctatagaatttaagggaggggaagttcgtttttgtttttgtttttgttttttcttttttttgagatggagtcttactctgtcacccaggctggagtgcagtagcgcaatctcagctcactgccacctccacctcccgggttcaagtgattctcctgcctcagcctcccgagtagctgggactacaggtgtgcaccaccacgcccggctaagttttgtattttttagtagtgctgggattacaggtgtgagccactgtgcctggccgggaagttcgttttaactgaagagctctttagcagctttgtagaagaaagcttcatattagatcttgatgaatagatagattttgacagatatctctctgaggtaggcagtcaagcggtggccagagtggaagaattactgtccagatttacatataggtttcctgattatttaaattaccgatgaagtgcagtaagactctactgttgtcacagtatcatttcagttagctattggcgtttagaatcacaaaataccagcatcttacagtgataggtatttattctcttgaaattgtgggtttgctgggtagtggatgatctaaacttggcttactcaaagtcaaaagcccaaagtcaagcagggcagggagtaacttgcacaatactatagtgacagtaatctactgcagtgatctagtacagttgatttagagaagaatggtaagatgcttattatgacaactattgtgctttcttctttctgctctctattgttgacactctcctgatagcactttttcattttggttgctgaataatacctgttgattggatactcctagaatcataatgtaatacagcagatttcttctcttcatgttatgtagaaaaaaagcataaagaaataatcagaatcttgactattccacagtgatgccctgaaaagttcagcaatatcatggtgctattcttctatctttgggactgataagcttgatgtcactggaatggcatttgtaacagaatttgaactgtaacagagtttacatcaaggtcatacataataacccaacaactcctttgttaacagttttaacagctttccatctcttcgctgcacctaaacttaaggttgcaaagatcaggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctcaccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctttaattctttttctttttaaaaattttttatttttatttttattttttttgagacgaagtttcgctcttgttgcacaggctggagtgcagtggtgcagtctcagctcactgcaacctctgccttccgggttcaagcaattctcctgcctcagcttcctgagtagctgggactacaggtgtgcatcaccacactcagctaatttttgtgatttttattagagacagggtttcaccatgttggccaggctggtcttatactcctgaacttaagtgatccacctgtcttggcctcccaaagtgctgggattataggcatgagccaccatgcctagacttctttcaattcttttatgttttacggattttctacagtgaatatatatcataatcggaaaaagtaaaatttagtatattgagtatatgcatttataaaacaaaatgatcatggactacattgtagcaagtgtactggccagtgggctgacagtggctgcttaaacgactccttactctgagctccagttttcttaaccagaaaatcagctattgttaattttacctacttagggtctctctctatttttcctttcagttcatgttaatttctaaattgccatgtataagtaaggggttgtcaatttacaccataaaacccctttatgtatccaaggttttcataggaaatttaggactgtatgatcctaaattgtgctggagtaccacattttctgttaagtagtacttggcaataaagtataggaaaaaaaaatcagtgggttgacaaagagaggtcatgatagtgtacctgtaatgtaatttgataaaaaatgtgagcctgaactgattgcaaagcattgttacatataggggaagacattatgggggcagaggggggtgaagatacaaagttgaataaaacttctctagagcttcacaatctaataagataggcatttataaatatctcttaaggcgcactttgttaagtgctaaaatagtggcacaaagagctatagaatttaagagaggcgacaggaaaaaaaagtaaattgagttaaaggaaggagaaattagttttaatgagagattttttagaagctttaaagaagaaagttttgtattggaccttgaagagtagatagattttgacagacttgtgtctgaggtgggcaattccaagaataggaagtaacttgggtaaaggccaggagatcagaagttgggcaggtgcagtgagttataggtgggtagatagatataatttgagtatagcagataaggaaaatataaattggaggcccagggagtttggacttaatctagttatatatatatatatatatatatttttacatttatatatatatttatatatattaatatatatttatatatatttatgtatattaatatatatttatatattaatatatatttatatatatttatatatatttatatatattaatatatatttatatatatttatatatatttatatatatttatatatatatttatataaatatatatttatatatttatatatattaatatatatatttatatatatatttatatttatatatttatatatataaatatatatatatataaatataaatatatatatatatatttttttcgagctagagtctcgctctgtcgcccaggctggagtgcagtggcgcgatcttggctcactgcatcgtctgcctcccaggttcaagccattctcctacctcagcctccccagtggctgggactacatgcgcgcaccaccacgccagctaatttttgtatttttagtagagacaaggtttcgccatgttggccaggatggtctctatctcttgaccttgtgatctgcctgcctcggcctcccaaagtgctgggattacaggcgtgagccactcactgcgcctggcctaggtctatatttaagaagaatgttctagtgtactttatgtatgtgttaatgtgagcttttttactaaagtaaaatatatatacaaatagttacatatttttaatatgtacaaataattatatatagctcagtgagtttttacctagtgaacacatcttcgtaaccattatctagatcaggaatagaactttgccagcactccacaagttgccttcatgctccctttagttactaactccctaatcccaagggaaaccactctcttataatatctgtagattagttttactgttattggtatgtaagctcatctaaatggaatcattccagggtgtattctttggtgactggtatcttttgtcccacattgttcgtaagatgattcattcaggttgttgtgggaggtgtggtgtgtttattcttgttaatgtattccactgtgattaatcattcagattagtcattctatttttgatggacacttgggttatttccagttttgggctactttaaattgtgctattataaataatcttgtacagtttttccttaaacatatgtacatatttctgttgggtaggtacctgagaatggaatcgctgggtcacagggtatgaaaatgtttagctttatgctatggtttgaatatagcttgtttggccctgccaagtctcatgttgaaatttgatctccagtgttggaggtggggcctggtgggaggtgtttggattatggaggtgcgttcctcatgaagggcttggtgccatccttttggaaataagtgagttctcgctccattagttcctgccagagttggtagtttaagagtctggcacctcccttttctctcttttggtttctctcttggcgtgtgatttctgcacatgcagctcctcttcgccctccaccgtgagtggaagccgcttgagactcttaccaggagcagatgctagcaccatgcttcttgtacagcctgcagaactgtgagccaaataaacctttttttattatgaattacccaccctcaggtattccattatagcaacgtaaatggactaagacactttagtagaacctatgcaactgtttttcttttttttttttttttttttttttttttttttagagacagggtctcactctgttgcccaggccggagtgcagtggcatgatcatgggtcactgcacccttgaactcctgggttcaagctgtcttcccattttagcctcctgagtaactaggactacaggcatgtgccaccacagtcagccaatgtttttcattttatactttctttagcagtgtatgggagtcccagttgctgaacattcttgcagtgctcacttaatatcgtcttttttgaggccgggtatagtggctcatgcctgtaatcccagcactttgggaggctggggcaggtagatcgcttgaggccaggagttcgagtctagcctggctaacgtggtgaaacctcgcttctactaaaggtacaaaagttagctggatgtggtggcgggcacctgtaatcccagctactcaggaggctgacgcacgagaatcgcttgaacctgggaggcggaggttgcagtgagctgagatggtactactggactccagctttggcgacagagcgagactccatcttaaataataataataataacatcgtctttttcgttgttgccactgtagtggatgatggtactatcccaccgttttaatttgtgtttccttaatgactactgtaaacaagcacctttttaggtttgttgactgtttagacatagtcttttgttgaagtgtttattcaagtcttggccttttttcccctattggagtattattatttttttttttttaaagagatgggttcttgccctcttgtccaggctctcgagtacactggtgtgatcatagctcactgcagcctccaactcctgggctcaaacatcctcccacctgggcctcccaaagtgctgagaggcatgagcctcattattttttgtgtgccaggactccttatttattttgatgcttgaattgttccctatttggccagtgggaagtgcattcaaactgcttcctctgttttttggtgtcattgagcattttcttgtttactgaaagatactccaggctcttcttatactttttttgccctagccctggaattagtgatttctctgagaagctcttttagaagtttcttttagtagagaatgacatgtagaagtccagatctgggtgttaagcgtgctcattgctattggggtgtcactgctcacaagccatcatactggacacaccacacacacaggtgcacattgcacatttacgttgttattttatcttacatattatttaaaaccatgagttcacactgatatccccaattccagtctaataccacagggttcgttcgataatttcataattgtaactccattttctgacagtgagtaacttggctttcattatcctcaaaatattttcttagtcaatcagcccctttctatgtgaccactctcatgttgctgctgttccccacacccactatatagatgccgtccttgacttacttaggctccaaaaccccatgtcagattgctggcctacacccttccatgaacacccttgtccgatacctgtgctagattgcttttcacatcacatttggacttcaacactctgtgcagggctgccatgttacctgccatatttctgtatggacatatcccttatcctgtttttttgtttgttttgagacaaggtctcactcttttgcccaggctgcagtgcagtggcacaatcacagctcacagcagcctcactcaacctcctgggctcaggtgatcctcctgcctcagtctcctgagcatctgggactacaggtgcttgccaccacgcctggctaattttttgtagagatggggtttccccatgttgccctggctggtctcaaactcctggactcaagtgatcctctggcctcggcctcccaaagtgctggtattacaggtgtgagccatcgggcccgccccttcttccttatcctgatggtactctgtcatcctgtactaagacctctgctgatcctgcagatgtctgttttgcctggccctgacaaaatgagtagaggtttattgtagtcaaaatgtagtcaagattttcaatttttaaatttatggttagcactttttctctttgcttatcccaagatcatacagatccttccctccctccctccctccctttctcccatctaggctcactgcagccttgacctcctgggctcaagcgatcctcccacctcaacttccccgtagctgggactacaggcatgtaccaccaaacatcggctaatttttttgcatttttagtggagatgaggtttcttcatgttgtccaggctggtctcaagctcctgggctcaagtgattcacctgcctctgcctccccaagtgctgggatgctggggttacaggtgtgcaccacttcactgggccaagatgttgattttatttatctgcacacacagacacacatacatatgtacctatatacatacacacacatataagcttcatttaaacattttttattgtggtaaaatacatgtaaaatttaccattttaactatttaaaatgtatagttaagtagtgttaagtatattcacactgttttgcatatataatctttagaacttttttgtcttgcaaaactgaaactctatacccattagacaaactatcgatgtctcccttatcccagccactggcaaccactattcttttttttttgtttgtttggtgttttttttttcccccagagacggagtcttgctctgttgcccagactggagtgcaatgaatggcaccatcttggctcactgcagactccgccaagcaattctcctgcctcagcctcctgagtagctgggactacaggtgtgtgccaccatgccagctaatttttgtatttttagtagagacgaagttcaccatgttggccaggctggtcttgaactcctgatctcaggtgatccgcccgcctcggcctcccaaagtgctgggattacaggcatgagccactgagcccagccttctattttttttcctatgaatttgattcctctagatacctcatttaagtagaatcatacagtgtttgcctttttgtgactagcttattttacttgatgtcctcaggtttcatccatgttcttccttttttaaggctgaataacatttaattgtatgtatataccacattttatttgttgtcaatggacacttgggaagcttgtacgttttgacctttgtgaataatgctgctatttgtatatgttacaagtacctcttcaagtccgtgagaagttttatttaccatttgcatttagctctgcaatccatctggaattaatttttgcatatggtgtgaggtagacgtcagcattctttttttttttctttctccatgccagacaggtaatgtgcctatgtaacaaggtttgagggaggcacacctcacacatgaggctgaaaacccaatcgtcatgcttacaaactacaaaaggatcagaattctttttttccttttctttctatagccagcttattcagcactatttattgaaaagattgttctttttctattgcagggtcatttttgtcatattaatgtctatatatgtatgtaggcctgcttttgggattttctcagtagctccattggtctattcttgtgccaataccacactgtcttaatttctatatttttatataataacatttcttgatatctgatagtatatgcccctcagcttccccttcccccaagattgcattggctatcttggccttttgcgttttctttttctttttctttttctttttttttttaaatggagtttcgctctttcactcaggctgcagtgcagtggcgcaatcttggctcactgcaacatctgcctcctgggttcaagtgattctcctgcctcagcctcgagtagctgggattacaggcacacaccaccacgcccggctaatttttgtatttttagtagagacggggtttcaccatgttggtcaggctggtctcgaactccctgacctcgtgatctgcccgcctcggcctcccaaagtgttgggattacaggtgtgagccactgtgcctggcctgcattttcatgtgtattagaatcagctaggccggttgcggtggctcacacctgtaatcccagcactttgggaggccgaggcgggcggatcacctgaggtcaggagttggagaacagcctgaccaacatggtgaaatcccgtctctactaaaaatacaaaaattagccgggcatggtggggcatgcctgtaatcccaggtactccaggttgaggcaggagaatcgcttgaacctgggaggcagaggttgcagtgtgtgatcatgccactgcactgcagcctgggcaacagagcgagactgtttccaaaaaaataaaaaagaattagctagtcagtttccacaaaacatacttttatgatttttattggaattgcattgaatccatatataagttttgggagagctgagatcttaacactattgagtttcatagtccacaaaaatgatgtgtctttccatttatttaggtttgaatttctctgtttagaggtctttatatatcttttgttaaattattcctaggaagcagatgtttttaggtgttatttaaaaaatttaatcctctttgttgctgatagtgcagaggctttaaatctgtggtctgtggcccctgtacaagctataaacatgtgaatactttttcctgaaagatctgtaatttacatttgaatctgattcccactgggagcaataacaacaaagatgaaagagcacttagtgctttagagtggattagactagggaggggtaccagagaggcagggaggccatttaaagtatgtaatagtctacgcaagagactgggcttgagctagggcagtaggtatggaaaaggaggaaagacattcaaggatattctggagacagaatgaagaaggttgctgagagtagggtagaacaaatgaagaaaaagagtaaaatatagctggcatcagtcatgttaagggcaattagagggttatcaaagcagtaggtaggtaagggaaaatgagtgtttggtgggtgaagatattgggatggtccctaactataataaggagactttgaatttaagatatattcgtataaataaagatgggcagggccgggcgcggtggttcacgcctgtaatcccagcactttgggaggccgaggtgggcggatcacgaggtcaggagatcgagaccatcctggctaacatgatgaaactcagtctttactaaaaaatacaaaaaattagccaggcatggtggtgggcgcctgtagtcccagctactcgggaggctgaggcaggagaatggcatgaaccagggaggtggagtttgcaatgagccgagatcgtgccactgcacttcagcctgggtgacagagcaagactccatctccaaaacaaaacaaacaagacagaaaaaaaaaaaaaagatggtcaaagtgatagaatatatgagacttggaaggtggaaagctgggtgatgattagatggagattatatattattctgtacttttttgtatatttaaaagtatccatgataagaggttaagaaaagtttatctgctgggccaaatggtatttccagttctagatcccggaggaatcgccacactgacttccacaatggttgaactagtttacagtcccaccaacagtgtaaaagtgttcctatttctccacatcctctccagcacttgttgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaaaaaaaaaaaagaaaagtttatccgcataaaaagtaggctgaactgaagattgaagatctctggaccagctgtactcaaattgttatgtgagagaaatatcaggatttggttttgagtaatttcataaccgctgtctattgggaacacagttttatcaagatctgccagttaaggaggcacaaagctacagaggccaggtgctgcagggtggctaggagttggggaaaagaaattgactaggtgtctgttggcaactcaaccaggtgtgtggacgcaggggaacttagcaagggaaggtgatatgatttggctctgtacccacccaaatctcatgtctaattataatccccagtgttggaggtggggcctggtaggaggtgtttggatcatgggggcggatttccgccttttgtgctgttttcgtgatagagttctcacaagttctggttgtttaaaagtgtgtggcaccttctctgcccccctctcttccccccttctcttcttcctgcttcggccatataagatgcacctgcttcccctttgccttctcccgtgattttaagtttcctgaggcctccccagaagcagaaaccatcagaagcagaattcactacgcttcttgtacagcctgcagaaccgtgagccaatgaaacctcttttcttataaattacccagtctcaggcatttctttatagcagtgcaaaaatggactcatatacaagggtatacattcagcaggagaataatggcagggagtctggggcagatattctggggagatcaataggcagaaagcatcagtgaatactagaaacaggtagcaaagcgttgcttcaagcttgaactcaaaagtggaactgggaaacctagcaaggaactaaataattgattcattcagcctatactgattagtgtctattgtaatagttctacactttaccctgtataggaattatttggaatgcatgttaaaatgtagtacagattcttagttctttttcccccctcttcccttttacttggtacgcctaaaaaattggcatgttcagcaagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgcagtggctcacgcctgtaatcctagcacttcgggaggctgaggcaggcggatcacctgaggtcaggagtttgagaccagtctggccaatgtggtgaaaccccgtctctactaaaaataaaaaaattagccgctcatggtggcccaggcctgtagtctagctacttgggtggctgaggccagagaatcgcttgaaaccaggaggcggaggtttcagtgagccaagattatgccactgcactccagcatgtgtgacagagcaagactccatctcaacaacaacaacaacaagtgatggcagaatgagacaaatctcatggccaaggcttggactctctgaattccaactagttggtagtaagttggtttcagaaaacaatttacttctgtaggctgtttgcagctagagaaatagtgaaccatgggagtaggaatataagcaagctgtgacacttagaagaggtatatctagtggaaggacaatagcaacatcccagaatgtggccactgaggtactacattaaaatcacatcacaataaaactggtagtttttcctagtactatgaacagattgtgtatcatcttcatttattttaaagatgctgtggctggtccctcagctcataatcaccatcagccatggcatctttacatagaggaaaaggatgtaattcagtacaattaaataaggtaaatgtaaaggtgctttgtaggtcatagggtaaggtggtggtggtggtggtgctttcacaacaacattctaacacaaagcaattcatacagactcccaaagtttattgaataggcattccactctcattccattttactctttaaatatatatttattcatgcctgctgtatgcaaatttttgattccaatttttttaatggacatacagtaaaatggatttttcttaatgtacacagttttaggaattctaatatgtgtagtagattcatgtaaaccacaatcaggataagaacaattgtatcactcccccgcaaaaaactcttatactcttcctccacctctaaccccctcttcctcacttcattttatgtttttgagaatgtcatataaatggaaccgtgcaatatgaaatcttctgttactgacctcttccgttcagcataatgcctttgagctagattaatccatgtttttgcatgtatcaggagttcacgtcttactattgttgattagtattttattgtgtagtgtaccagactgtttattcactcctgaaggacatttgggttgtttctggttttggtgattataaataaagctgctataaataaacacttgtgtatagattttgtgtgaacattttcatttctctaaatacccatgagggagaattgcgtgataaatgtaggtttaacctttttagaaattgctattttccagagtgattgtaccagttggcattcccacaagcaatgggtgagagttctagttgatctacatccgtgtcagcatttgggattatcagtatttttaattttagccattctaataggtgtatagggatatcctattgtggtttcaatttgtatttccctaatgcattcctcgattcttgatgcttttattgatggaggatccaacacaaaagataatgcatggtcatgagaacaaaatatttgatatgcctaactttaacattctatgaaagacttcattaatatttttaaaaaggagtttgtactattgaatattcatggtttttcagtgaagtttgaggtactctgaagcctatctacaaagttttaagtaagccatgtgacagtgtggataagagagtgacttcagagcattttttttttttctggtgacctttggtgtgtagaacacttgtggcctttaataaactgaggagataggatgaccaaaattttttttatatgcctgtaatttttttaaagcagaaataagtgagaaacgcttatggacactgtgatcaagatcgtgaacaagatcatgatctacatttactgatttcatgttcctagtagcatagatcaatggtatgattttaataattcttattcagggaagtaatttagatggaggcaaggaaggctttcccttgagtaatatattaatttggccccatctatctcttctcctttgtagatcatcccaagcagcagtctgtattataagaagcaaacttaaatgattgctaattaaatgtttagtgttttttttgagttggttattagcttgaggttaaatttgtttaatgagtaaatatggaagaattatgtttttcacatttggaatgcatacttgctgatcattggtatgttactcccattttatgaagctggaacataatttccttctttttaatgactgtgagttttacagttatttaatctttgttttggtggtgttagtcatgtcagtactttatttgctaccgagttctcagttaggaaataggctcccaattataattttttttttttttttttttttgagacgaagtctcactctgtcacccaggctggagtgcagtggcgcgatcttggtgcactgcaacccctacctcccatgttcaagcgattctcctgcctcagcctcccaagtagctgggactacaggaatgagccaccacgcccggctaatttttgtatttttagtggagatggggtttcaccatgttggccaggctggtctcgaactcccaacctcaagtgatccgcccacttcggcctcccaaagtgctagaattgaaccactgtgcccagccccagttataacttgtttccatgggaaaacatccgctttgaagcagtattcagtaatatattgaaatgagaaataggcggtcaagcagtgattcaggtttagtgttcagtgtaattaagaaaaggtgacttaagttgaagaacattgatgtatctgtttttaaattgcacctaattataatgacaacttacaagatctctttccttccttctctcttggaatgttgactataaatttcacataatttaaaaacaatttaaaagctagtcaaattaattgagaagaatcctgctttatcaaattttgcctgtaatcatatccagacatggcattttgaaaatcagaaaggattgcttccacttatatcagagtttgaaagtagaaactcttttcatgtaggtatgggtcacctttgattatatggtagtcttctgaatatggtcctcttacctgacacatatgcacctcatcaataaactacatacaattcttaggtttatatgtggtcatgttacaaaggatttcttaagtactcttaaatgtgttctactaatgtcttgtggaaaaatataatcttttgaaagcattcgtgttaaaaagaattagacgtgatttatctcatttagacctgttctttttcaatgtgtctttaaaatgtaggtacagtatataagaattcatactaaaggatcaactgagactttgatttaaatatgttataaattatagtatggaggcctgcataatatactacatatttttttttcctaagaagcttatttaaatggttctgttaagtgtaggaatgttctgatgattatctttttaattaaaatgagaaatctttgtttaaagtggcactcgtttttttatggcctgttacagtctctgtaacaatcatttcttaagtctgaacgttttatttccaggaatccatttatataaaactatgtttagacttaattaaggaacgattcttacaaagcttgtaaatagccaggaaaaaagggacagaaaataaaactgacattcacatttaacaaaatgattgttacaaggtatgtaataagctataaaaatacaataaagccctttttataagagttcatattttttgatccttgttttcaaaggtatttaagaaaaatatcaaagctttgcaaagtgacatctgtttgctgaatggactagttataacttcttttgtttataactgacaatacgagaattctacctgttttgttagtgtgtcttctttgaaataccttgtaattagtttagattggtaggtaaattttacgttgtaccatagtgaaaacaagacctggttttcaggttctgcttcctagatgtcatagatattgggcatgttgcttaacctccttgagtctcactttcctcatatagaaagcaaagataatatctacttttgtacctcaaagagctgttatgaggagtaaatgaaattattataaatagagcaaatattttggaaattataaaggactgtaagcatccagatcatgtgtctcttaaagatgaattagatttaacaacctcttttttttttttaattaaaaagtaaactttaatgtcaaaaatgcaaacttggggagggcagaaagatcacacacaaggctgtgccttcacacttggagggttgcacagcagccgggcagaggtactcctcacttcccagacggtggggcggctgggcagaggcactccccacttcccagacagggcagcggctattaagaacctcttttaattagcaaacttccttctcttgttcatgcattctgtcaagtacatacatgtacatcctttttgaaatgacacttatttttccatttccttgtctaagtataagtgattgaaaccactattggcatagtggaaattacacaagaattggagtcagaagaactggtttcaagtcctgtcttaactacagtcatgcattgcttaacaatatgtgatacattatgagaaatacattgttaggtgattaagtggttgtgtgagcttcacagagtgtacatagacaaatctagatagtataccttactatacacaaatgccatgtgatataacctgttgcttgtgcagtttgttactgtacactgaatcctgtaagccattgtaacacaatggtatttgtatatctaaacatagaaagggtacggtaaaaatacagtgttataattttatgagaccactgttgcatatctgaccatacttgactgaagtgtcagggggtgcatgactgtatttttacttattctctgaccttattcttgggtggtgataataataacaataataatggcagccaacacttgtagctcagtatataccgtgcaggattctagacactatatatattaactcatttgatcctctcatcttattaggtgtgtattattattatcatcctgatttacaaatgtggaaactgaggcacagacaggttgttactttttccagatcaaacagtttgtgaatggcacagctggtattccagctcagacattctagctccagagtgagtgtggttaatcattgtgctatactaaccatgttccttaatttcctcttctctaaaatgagaataacaataactgttctatctactgggttgaagatccagtaagagagtacacataaaagcactttgacatcacagtgtaccataaatagaagttatatgtgaactgtagaattagcatgcaccttagagtaggtattttatagttttttggtgggtgagggatgttatcttttgacttatttttgagaaatataattttgaagagaggtgttgatggtgtcattcttttttcaactcctcagaaaaattatgagaaacacacgatgataactcatatatccctcacctgaattatctaattgttaacattttgccacatttgacttttcctagtatatactttctttctaaattatttgagagttgcagacatgatattttaccttctgcatgtattttctaagaacaagagcatccttattcctaacctcaatacaagatcccactcaggaaatttaacactgatcactgataaccttttattatttaatatacagttcatatccagaacccctagttatcctaagaatgtcttttttttttttttttttttttttttttttttttttttgagatggcgtcttgctctgttgcctaggctggagtgcagtggcgtgatctcagctcactgcaaccttcgcctcccaggttcaagtgattcttctgcctcagcttcctgagtagctgttattacaggcacctgccaccacgcccggttaatttttgtatttttagtagagatggggtttcaccatgctggccaggctggtctcgaactcccgacctcaggtgatccacctgcctcagcctcccaaagtgctgggattacaggcatgagccaccgcgtccggcccctaagaatgtcttttacagctctttaaaaaaaaatccaggatccaatcatgttatatataatatctctttagtttcctttaatttacagtagttccctaatggtttttattcatgaaattgacatttttgaagagtttgaggtagttttacagaatgtccctcatttgtttttgtctgattgtttttccatgattagatcagggtaaaaaatttggcaggagtataatatatgctgtgttttttttttcttagtgcactactacatcagaaggcatataatgtcagtttgttccattattggagatattgtttgatcatttattaaggttgtattcactagatttctctgttgtaaaggtatatttgtaagtattcagaggagcaaacttggagactgtgtaaatatcttatttcacaacattgtttcacgcagtagttttaccatccattggtgattcttctgtggtagttgtaaaatcaacctatttatttttaggtagttctaaataatttttttctttctcaattttgaaatggtgagtgtttcctattttggaaagacattacatgggctttatcctctttatttcatttttgaacttagaccaattaaagtgtactttttacattgtaaaaaagataaagataacttttatctttagtgcaacacactactaaagctgcttagagaattgagttaagtttttaagggctttttgtaacaaaaagtatgtctgaattccctggaggacttgttgggccttccctggagattttttttttttttttttttttctgagacagggtctcactctttctcccaggttggagtgctgtggtgctatcacagctcattgcagccttgacctcccaggctcaagtgatcctcccacctcagcctccttagtagctgggactacaggcgtgcaccaccacgcccagctaatttttttatttttcacagagatagggttttgcccatgctgagtttgccattctttaggcctgggttggggtctgagaatttgcatttctaactagtttataggtgatgctgctggttctgggactacactttgaggactgctgtggcttctataagtcttcctttttaaaaaaaaaaaaaaaggctagtcaagttctgaagcaattggttgtgaacacctgcacttgccattcgagcagatattttgctcatgattatttggaccgttttcttcctttcttcttttctttcttcctttctttccttctttccaggctggagtgcagtggttcgatcctagcttattgcaactttgaatgcctaggcctagggaaccctctcgcctcagccttctaaagtgctggggttacaggcatgagccactgtgctgaccttgggatacttttctacttgtttgctttctttaatagatatgagaataatatggatatagtatagcagagtaaattgaagtttgtattaggggattttgatgaatgttgggaaaattttggcaattggctaaattactgaataggatctcattaacctagctaattcaaaattatctatgttgtaatgaaaatggttatagggtattttatctatttatttatttattttttagagatggagtcttgctatgttgcccaggctggactcaaactcctgggctcaaaagtgattcttccgtctcagcctcccaaatagttgccggtaccacaggcttgtatcaccatgccctgtctaggttattgtaaaacatatttgtagcatttatatttgtcgaattttctttactttgctcaatgaagtaaccaaattaggtatccatagtgatcagtttgtgctttcagtatttaagtaatctctgttatactttagcaactggttttgttaagtctgtgcaattagtaaagcaagtggcaaatttgttacgtcatagagattattttcacttttacagaagttggccatcagccctccttctttgagtctcctattagaaatactataaacatcagagagaagaggatgaccttaatatttgcttcccaggctaaatcacagccttgaagcagctatttctttccgaataaaaagtttaatttcacgccctgattagtgccagtacgtgcaggtagatacttatgttatgtagctaaactgatgtgcctttgcaaattacttgccagtcagcagaactatagtttcttatgagtagtttatggtaaattatagttctagttagtaagttctgtgtgtttttttaaagtgtgtatttattagatacgagtaggaatcagtcactaaattttggccagactagcagttgactaacagcttttttcaaaggctcaggtttggactaacagtccagccaattagcagtaggaaagagtgagatcttattttcagttgatttgaaaatatacacaggacctagaaagagtggtttctgatggaaaagacctaaggagagattatttttcttattgagaagtaaaatacattgtagttaaaaattgagacctttgagaggcttaaaagataggaagatcaactgaggacaagacatagaaggttttgaaatcgtgggacactacttaactgaatttttaattgcttaattgaaactatggagttttaaaaacttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagcttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcactaaatttgcatggagtcataggatttaagagtctagaaggaccatctaattcaaggcttttttttttaatttagtttttctattttctttgttctttctttcttcttcttctttttttttttttttgtgtgttcttctacttgataattcaaggcttcttaacctttttttggttatggacttcactgaaaatctggtatcacaggatccttcctcttcccagacacacacacacacatatgttttgtacaaaatttcaggaggttcagagatccctgaatcctatctatggaccctgggttaagaaccctgatctagcttgttttttttttgattcttgcatagtatatttttatttaaaaggttttgctgataattattattttaatataactaagttgtgacctgttttaataagggtctgactgtaaaacttgagcttcatcataaagtgccattttgagaagctaatgaaatgttgagtatgttgcctagtagtgtcaggaaaaatggtacagagatgacttggctggtagttatcaaaaatcctcccagaacatcctgttctcattcccctagctattcaggcaaggggccacaattaatccctgtctatgatgatgtaattttacttttcaggatatatggacagatacacttaaatcctttgattattattctactgatatttccaggacctttctatttttataagttttattaaagatgtggtataaccaagcaaatgcccagcaaggtcagtttactctagtaagtacactctgcatctagaagcatgtggaataaactctgttctgtcaaggtcagccttaaacattgtcaacatgttcacttatttatgctctgcagttctggggaggcctgggaaacatttatcttcttttctttttcttcatcctcttaaggtatcaacactgacaatgctatctatctaattagctcattcaagaaagacttttttgtgataattttagatcagcagtacactttggccagaaaacctggtttggattttatcttatgttatcccacatgctacttagaaaaagagtttttatgagatatcgataaaaagtattgtggaatacttcttctttttaaaaatgagcacatgaagaaccaaggacttgtttgacttgccagtgtcacaattgatgacagcctgaattagagcccacatttcctaagtccaagtctagttggtgcttttccgagtctttgttttgtttgtggtttagcttgtgtttcttctactgataggtgaattggtggggggtgtttttaattagtacttttgtgatttgtttaagaaagcctcccctaatttaagatcatgaaaatagcctcatattttctactagagactttttgagttttggtttttacgtttagaattttagtctttctagaattgatttttgggtttgatgtgacgaagggattccgtttcacttttttccatatggatttacaatggcccccagcatcatttattggaagaacatgcattctccatcaatctgcagtgttatctccctcataaatcatgtcattacatgcattgatcagtttttggactcattctgttctattgttcatttatttatatcagtgccatactatcttattcatatagcttttttttgggcaaatcttttctattttaaaaaattcatattaaaaatttaacataataagtgtacatatttatggggtatatactgatattgtgatacatatagtgatcagattagtaattagtgtatgtatctcagtcatttatttttttttgtattgggaacattcaatattctcctagctatttgaactatatagtattttattgttaattattgtcattctacagtgctgtagaacactaggacttattcctcctatatagctcacactgctttataatacaccttttttatggtagttaaggtctcataccttattttcttcttggctatttgtggctttttataccttcatgggacttttttttttttttttttgagatagcctcactctgttgcccaggctggagtgcaatggtgcgatcttggctcactgcaacctctgcctcctgggttcaagcgattctcctgcctcaccttcccgagttgttgggattacaggtgcccaccaccacacccggctgatttttttttttcttgagacggagtcttgctctgtcgcccaggctgaagtgcggtggcgcgatctctgcttactgcaaactctgcctcccaggttcaagcgattctcctgcctcagcctcctgagtagctgggattacaggtgtgtgccaccatgcccagctaatttttgtatttttaggagagacggggctttgccatgttggtcaggctggtcttgaactcctgacctcaggtgatctgcctgcctcggcctcccaaagtgctgggatttcaggtgtgagccaccatgcccggcctttggaaatttttatagatagcttgtcaagttcaaaagcaacaaatatctaaaggcaaaaatatactaaacctattgggattcaggttagttgattcttgatagaaaccaaagtatggagttacttcaaaattaaaaactaaaatttgagaacttttagctaggaaagatggctttcttttgttttgtttagaggagaatcttgctctgttgcccaggctagagggtagtggtacaatcatagctcattgtaacatcaacctcctgggctcaagtgatcctcctgcctcagccttccaagtagctaggactacaggtaacaccacaccacacccagctaatttttattttattttattttattttattttatttatttatttttgtagagacagggtctctctctgttgcccagctgttctcgaactcttggcctgaaacaatcttcctgctgtggcctccgaaagtgctgggattacaggcaggtgccaccgccccacctgtgtttattgattgattgagacagggtctcattctgttgcccaggctggagggcagtggcatgatctcagctcactgctgcctcgacctcctgggttcaagtgatcctcccacctcagcttcccaagtagctgggactacgggtgcccaccaccacgcttggctaatttttttgcatttttgtagaggtggggttttgccatgttgcctaggctagtcttgaactcctggcctcaagcaatctgcccacctcagcctctcaaagtgctgggattacaggcatgagcgactgcacccagcccagcctgttttattcttaatgttaagagatagttggatatgatgaaagagcactttattgagccagatcacttaagcatttgacctttagacaagtcttttatttatgttagagtttcttagcccttgggccttggccctcttctctttcctgtctacactttgttcctagatgatcatctattccttttgctttgaaataccatctgtgggctgatgatttctaatgggctaatagtctctaacccatccttttactgtgacttctacctttatgtattcaactgattatccacttgaatgttgcataattgtgattttttgtgtgtgtttttttttttttttttttttttttttttgctgatcttcccatactaataaatggtgccaccatttatccagttactgaagcctgaaacctggaatcatcattggctcctcactttttcttatgccgatatgcaattcacaagattttatctgttctacttccaaaatacatctcaaattcgtctacccctctctgcctacactgctatcaacttactttgggttattatcatttcttttatggaaaagtttaacagttttctagctactctcccctttaaatctagtctgtctccacacaatagccagagtgatctttcagagatctaaaatgttctaatatcttccttttggactaaagctatgcatggtaaactttgttgttttgcctggcagagctggtcctttcccacctatgtctttgaccctgttaggtcattactcccagtcttcagttacagtcaagttacactggccttttgccaaacacctttttttttttttttttttttttttttgagacagggtctttctctgttgcccaggctggagtgccatggaataaacacagcacagctcactgcagtcttgacctcctgggctcaagtgatccttctgcctcagcctctggagtatctgagaccacaggtgcacgccaccatgcctggctaatttttaaattttttgtacagacagggtctcactatgttgcccagcctggtcttgacctcttgggttcaagcgatctgtctacctcagccttccaaagtgttgagattataggtatgagctaaatttgccaaactcttgcaagaccactataaggcctttgcattggctgttttctccaactctgactttttggttgagtccttcgtttatcctttatatctcagttctaatcacctacttagagcctaccctatctaaagtaaatgcccctttccttatttgtctattatttctactagaaaagaaaataaagcccatgatagtaaaattttgtgttttactcttgagtatatcccagtgcatgacatgtggtagacaataaatacttgtgaagtcactcactttcttttttttcattttgtaaaatagaagctgatgataaactgcccatcctgcttcctggagtcattgtagggaataaatcaaacaatgtttatgggaataaatcaaacaatgtttatcagttttgatgtcctggtatgatttttttttttttttttttccgagacggagtctcgctttgttccccaggctggagtgcagtggtgcaatctctgctcactgcaagcttcgcctcccgggttcacgccattctcctgcctcagtctcctgagtagctgggattacaggtgcccgccaccacgcctaattttttgtattttagtagagacggggtttcaccatgttagccaggatggtctcaacctcctgacctcgtgatcctcccgcctcggtctcccaaagcgctaggattacaggcgtgagccaccatgcctggcctggtatgataattttcaataaatgagctttagttttttaaaagacattagagcaaatttgagaaagtacaaaataaaaaaaaagcagcctgccatcccacacaaccacttttatttaattttgtttgtcttaaaaaagaaagaaagaaagaaagaaaaacaacaacttttaagggtgaatgtactgtccagcactctcttctttctaattttcctgtcccaagcagcttccaaacactttaaggaggtgcatcagttaagatagattaattttatactttttaagacttgtagggaattcatttatgtattttgaaacttgcgtggaaagaagtaaatacaaatggttctttatcaaatttagaaattttactcttgataattaaagtttttataagaattttgcctaaagaacttttcttgaaactagcctgtatataatcaggatttcttgatatggaatacaatctgatttgtcttttaaaacaacttgtacaggttactatttatcctgtgtggtaactaccgctcctgctgtgattcaaatatttcagcccttaagcagttatattaggcttggggaatagtgtaatttgaagcccttggaacatctttttgaattagaaaaggaattctctaaataaatatattcaactgggagaactacttttttgaaatttattactttggaatatataaagtttggtcatctttggaagtagagatctaatttaccagcaaatggagtttataatactaaaatatagtattgtttgcaaataaaattctttgtttttgtgtcttaggttaataaattgtctctgagtcaattgttacaacaaataccaaatggaaaaattgctttcatttcttagcataggcacaaccttcgtagttcagccttcccaaaatgctctttgttcatctgatgtatgttggagagactctttataaaaatggcaatgttgacatgtaccttaatttgctatgttcttttaaaaataaatttgggaaatttgctctctagaacagtagcctcctaacccatcagaaacattttaaggatttatcctaaatatttttacttcttaatttgcaaattgcaaattgtactcatgccctgccatcattagctactatattaaggcacaatatatacacttagggtaaataaatataaataagtaaatatatatgtgtaaattgtgtccagatagttgtaatgataatgtctttggtttattcacatatggttagttcaatattatttttaccttgtaaagtgactaatgaagggcttgtgcaaagaattagagaagagtcaattgacagtttacttaaaactaactaatattctttttttttttgagacggaggcttgctctgtcgcccaggctggagtgcagtgccgctatctcagctcactgcaacttctgcctcccgggttcaagtgtttctcttgcctaagcctcccatgtagctgggattactggcgtgcgccaccacgcccagctaatttttgtatttttgatagcgactgggtttcaccatgttggtcagggtggtctcaaactcttgacctcgtgatctgcccgccttggcctcccaaactgctgggattacaggcatgagccactgcacccagtgaaaacattcttaaattctgagcacacttaagttttttgcaatatgcccaaagagaatgaatgagggaagaaaccattggcaacccctttgtgttgtggaattcccaatcttcagtaagtgacatttaaccatttaacatcagattaagggaacacgtatcaaaaaaaattttaaagattattttttaaactaaaaattaattgaaagttttttgttgttgttgttgttttctttttgagacagagtttcgttcttgttgcccaggctagagtgcagtggcggcatggtcttggctcactgcaacctccgcctcccaggttcaagcgattctcttacctcagcctcccaaatagttgggattacgggtgcccaccaccacacctggctaatttttttgtagttttagtagagacagggtttcaccatagtagagacagggtttcaccatgttggccagactggtctcgaactcctgacctcaggcgatccacctgcctcggcctcccaaagtgctggaattataggtgtaagcttccgcacccgaccaattaaaagttttaatattccccctgtggtgctatatatgtatacataggttttcatccatggtcctggttcataactcccatatccctttttatggtcttttgttaataatgttgggtgtgttaggcctcagccgcagacctcaggaaatagtctgtctcctgcccttctttcacctgccccagggcaggactctaatctcccaccacctcctttctgattgtggatcttaagaccctccactgagagggtcccacctcataccctcgtgggaggaaggaatgcttccataaaaactcaagaggactgggtttggaaagcttctggatagctgaacacatggagatccctggagggtggtgtgcccagggagtcatggcagctctgagccccttcgcccataccttgttctatgggtctcttcatttgtattctttgcaatatccttcataataaaccagcagatataagtaagtgtttccctcagttctgtgagccacttcagcaaattaattgaacccacagaggggatcatggtaaccccaacttgaagccagtcagtcagaagctccagaggcccagagttgtgactgatatctagggatatgggggacaatcttggagctctcaagatgaggcccgaggctctcttttaaggggtgttctggataagtcatagcagttaacaagaatgctaggacatacagggacacataattcatcagtcctgtcaaagtacatcacaaaaatccagtatcatgattccaacagcatttcagtcttggggttagggttgaagttagacaaaacaaaaacaaaaacaacccacatttggtcacagagaagtcttctgtgttgatgattattgtagtatgagagtagtggaaaaacacgaggttggaaagagtctttccctacacactcccccaccctggaggatcatcttgcctacctcctggcatgtgcacaccctgctttggaaaccaccttgcctcacacaagggatgaaaatgcattgtggcagaattgagttctttgtcttttctcattttctctccagatttcatatattgtggaaaagcagttgaatgagaaaactaatctttcaaacaagcatagccagtgtaatgcagacttcgtagactgtagagcatgtccctctaaaactgagtgtataattgagtctgtacctaggacttccagggcttttagtaattaaatgatagattttatagaacgcagacattgtttagctaaaaagagatatttccatctcaattctatttagaagatattatggagctagaggtggagatctatgactaagggcatgttgaatttttttatgaaagaaggggactctggtaattaattttttatgataatgtattctttcaatttggaaatggttcgagtacgaactcaattattttcaaatataaattttggaaatgggatatttttagatctaattgccgatgactaatataatgaatctttataaaaatactattttgtatcttggaggttgggggacatgtagatgttgcttaaaatcattgaaaaagtattctttttgcagcatcctgcttgcctggcttgtggatttcaccttgtttctgctggggatattagtttgtttcttaaataaggatttttgtctatttaaagactcagttgtctagtttcaaaggtaaagcttaaagcaggtccttcttccgcttccctactccacaaaatacatagtcacagactgactagtaatgagtaaaacaaaagcaaactgcctcttaatctaggaacagagaagaaataaagaagtccctatttcagagagagtaagggttaaaattcttagcagtcggggcagggtataacactcttgagaagagtgataagggctttcccagtagcctgcagttccctgtagagtagtacatggctagacttgtcagattagggcaagaatagcaatttgaccagtgagttccagcaggtgtagcagcaaaagcacagatttcttacacatacatgtaatgcatgtctgcttatagcggacagcccttgagatgaggtctgaggtgttctgaatgagtcatagcagttaccaagaatgctaggacatgcatgcacagataattcaccaatcctgtcaacatgcatcacaaaaatccagtctcacatgattccaacagcagtagcgcctaaattcacgttattgcactgtaacaaaattgtatcatcttgtgtatagcctaggatctactggcttcagctaatgtagaagtcattatcactaggtggcatttgcttggggagttgaggcctcacacagagggattttcctgaggtttcctaccaatacagcaaactctaaggaaagaagaaggtagggttggagagagatggggttttgtatattatttcaacccattccgttggtttaattttcgtgtgagagtctagccaggcaggctaggataggaaattattttgtctgactctttgccccccttttttcccaacaccctctgtgctgctgttcttcctcccttgactgtaagtagtgtaaccctcccttttgctccagctgctttattttcattattattgtctaggagttcctcattttcctgagtgtggaaaagattctaaagaaaagaccttgatccagtaattaattttgctcttaacatttacagacccttcctctccttaataaaaatggctaaaatacaaattgttaaattgttatttcagaatttgaaataacagtggatttttttctttaaaaaatgaacttaaaatgatcatgctatgaaagatcttagatttatttttggttctcaggtttgattaataaattatatttttcagttcattgcatactacaaaatttattaaattatctcagctgtgattaaaattaaaatgtatcttgttacattagtatgtgaaaattagttctatcctgtaaaaatactaccatattatgaataatcttttacatgcctgtaggggactaatgggaaatttagtaatatttgcatattttttccttaaatagtagtaatatttccatgttttgtttgtaagcgacaaatatgtatatatatattcataggtattttttatatgatgggagaaggttttgtatttttgttttttgcctcagcttttcccagctctagggagaggtttttaatatatctttgtagttgatcaaagttataagggatctgaacttattgatttaagctattaaagataacctttgcatacacaaagttctgttatagcgaatactggtacaacaaagagtcataacaatagagttctttaaaaaaacacactgtctttgctctcatttcccaacatgatggacctagtaatggatatggtgatctagtagccagaatattttaaaatttttatactgccaattagaataatgcttttctttaatttttgtcaatgaatgtgagtttttataaatgctcattttatactgtaaaagtagttgaactttatgaatttctgcaagattctgccactatgcgaaaacttgaatgggaggtgaagatttttttttttttttttttggtagagacatggtctcactgtgttgcccaggctggtctcgagcgaggtaaagattttaaatggagttcagctagtattaagcccactactcacttgttctgtggtactcttaacaaataatgttggattacgacagcaaaatatgtggtatagaactattttcatttttgatctacttaggacaggtattaatggacactttctcatagctcataatcatgttggtattgctgtctcttgtttgtgaaagtctgtggaaacatcagtcactactaacggtagacagtctttagatttcagcagatattcgtcagggtttgttgatgtttgtttttacatgatgaaagtccctatcaaagtaattctatctccaaaagattttttttttttttttgagacagagtctcactctgtcacccaggctagagtgcagtggcatgatcttggctcaccggaacctccgcctcccggattcaagcaattctcctgcctcagcctccaaagtaactgggattacaggcatctgccacctcgcctggctaatttttggtatttttagtagagacgaggtttcaccatgttggccaggttggtctcaaagtcctgaccacaggtgatccactcgcctcggcctcccaaagtgctgagattacaggcatgagccactgcgcccagcctgtccaaaagattttaaagttgggtgttatgttattgaaataaaattcttatataaattctcttatttactttgttagtggggaaatccagtatccttaagaatacaatcctaaaataaagttgttacatattgcagaaaggcagagtgattgtgttgttatggcaactcaaatggggaaaatgaaaacagcccagataagctgcatcctgttgtcatggcaaccacagttgtggaaatgattaaagctagcctagaaaggatgtattgcagctttagtccactgaaagtaaatagtgtaagaaaagacagggagaattggtttttgacaaaagttaaatccctctggtgccacaagttgctagtaccaccatgtgtagacagatctctgtcctttctaattgtgtttcaactcaattttattgcctcagatcataattgtgctatggaggaaagaaatgtaataactatgaaaagcttgtgaataatgatttttttggtagcaaatttagaaagcaaagttaggaaatttatttattgaaaatgacttttaaaaaatagggtgttttcctttcctctttcccccatttctcacccagtgcttaattttcatttttttcataccctgttactgtatcattttagtcttaagtgttgaattgtaatgtaaatatctaataccatggcaattggtaaggcatcacatgcagcattatgattgcctatgaacagatggatttgatgataaatgataaacatcctgtaagtgtgaataaatttattttagctctatctttcaaactttctctgtaatcaaagcttcttaagtgtttttaaaaatgccattatttccttcccaaattccacttgctcatcacagcaagatatttcatcctagtggagtggagacatgttaggaataaacctgatgaaaaccgtggtctttgttcagcagctggctgcttgcacaggtttttgtggtaatggcattggcatctctgtattagagtattgatctgctgcttggtaggtactgtgtaaaataagtcttctagtaaagatgtattaagtggtttaagagcagtttatattacaaataaggtggaagaaggtggagttctgtaagaccggacacatgctataaatatccataaaattaagtattttatctaaaaatgtgtgttgaaaatttctttttttctttttttctttttttgtttttttgagacggactcttgctctgtcgctggagtacagtggcgcgatctcagctcgctgcaagctctgccttccgggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgcgtacactaataccatcatcctttgccctttagtggaggattttatatttgatgttcctgtgttgtggttgaaaactgtgttgtaaactcgtcagttataagaaataatattgaccataggaacagtgttttaaagtaatccgttgaatattttcatgaaaatccaggttgattttgcctgagcataagttggtcttcatcaataacctcttcactgtatacattgcctggttttgcctggctaaccgaaatctggcctttcatgtaggtatagagaagaaaccttttttgttttttttcttttgagatagagtctcactctgttgcccagactggaatgcagtggtgccatcttggctcactgcaacgtccgcctcctgggctcaagcgattctcctgcatcagcctcctgagtaactgggactacaggcatgcgccaccatccccggctaatttttttgtatttttagtagagatggggtttcaccatgttggccaagctggtcttgaattcctgacctcaaatgatccacccacctcggcctcccaaagtgctgggattacaggcgtgagccatcatgcctatccagaaacctatttttaaaaagaagaaaaagatggaggaggagaagggagaactataactagaatcacctttttttttttttttttttttttagaatttttaaaaagctcattcccttttgctgttatttaatggtagcaggtcatgtatgactcatgacttaggtcatacaacttaggatattaaatggttcagatacccagcaaacagttcaaagattgcattaacaagctagctaacattttgtaaaggagttcaaaatgaaagactgtcagtacctatattccgtgtgcctagctgttgttgccccactggaatgtcacaatgcaaggatgtgaatctccctttctcctaacagaagtttttaaagctaacagattttaatagatttgcaaacagaagtttgcaagcagaagtttgtaaatctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaactcttaatactaatgtcctgagagaaaggagaatttcttgtctaacctcagtaataaccataccatcacaaaagaaggcctcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttcaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaacatccttaactttttgttctgtcaaggggagaataaagataccacctggctgtatgtataaatttgcttactaagatggttgattgatttcttttaggtgggtattaaaagtggcttttttggtatagaaaacatgtagcatcaaagcagtgttgtgatgccctgctgtcttctgatgttgaatattttatgggattaaaaacaattgtttttatcttactctttcagattcaacaatcttatagtaaaagcagccatagactaaatatttagaatttattatgctgatacaaatgaaagaaacataaaatacaaatattgagtgaattaagaaaaagaggctgcttgcagtggctcacacgtgtaatcctggcactttctgaggctgagtcgggaggatctcttgaggccaggagtttgaggctgcagtgagctatgattatgccactgcactccagcctgggtgacagagcgagacctcatctcaaaaaaaaaaaaaaaaagaaaaagaaaaacaatgtttctttctagagtgcttagcagggcaaaaaaagaaggaaaaaagaaaaacagaatgttgatgttagaaaaatttggttattgtcttatgctctggagttcttacctcaagccagtgacttttaagatctgttgttttctgtactgaagcagaatagtgaaaatgtttttataggaagttatgaaaaaaagtctatattaatttgctttgggtcattctagtctctctggtaaattcataattaggaaggcctttttaaggctgtatgctagtctcacaggtacacagctacttcatatctgataaatctaaattcatatgtgaggaggttatgtttttttaaagcatattatttacacaattcactggaatggctcctttggaagttgggtgactctcttatgtaattatatacttagtaaccctgctctacaaagcagtagaaattcaagtaagaataatttactgcttatgcatagttattagaattttaaagcatttgtttgttcaaaattctagtttatcagtgttgtatttgactaattgcctacttaataaataatgaatataatttattttagaaggcacccaaattttaacaattgtaaataaacattaggagctgctccccctcttcgctttcttgtttaaagggattctcatccctttagtccaagtttcgtggagaaaataattcctatcttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttataacaatagtgtgagtttatatggtctaacaataatgatatcagactagtaatattttacatttgaatctcagttttatctggtgttttctaatgtttataaatgttaatgtgtggtggctaaacctttaaatctctttttctctactagattataacctctttaaaagcagggactcatttagcttttgtaaagtcaatccagtttcatttttaaagacttaaattaaaatttctaagcattgatggcattgttggaataaatgtagcttcctgaggtgtcttctctggggacgatacacattttaaaattgtatttctgttttcatcaagtactttccatttcaagtaacagattgcttcattccccctttaagcaagaagggagagtattttaagggtacagagatagctcatggaactaaagggaaaaagatggccagtaaggccccataaggacttggaaccaggcattggaatacctttaggacacaaggcagccgcccttgcattcctaagataaatcctacttagtcatggtgtatattcctttttctgtgttgctggattttatttgccattattttgttgaggatttttgcctatatggccataagggatattggtctgtaatctccattctgctgttgagaccatccagtgagtttaaaaattttattttcagttttctcattcccatttagttcttcccctgaccccctttttttacttccccactttgagacaggtctagctctgttgcccaaaccagagtgcagtagcatgatcatggctcactgcagcctcgacctctcaggctcaagagatcttcccacctcagcccctcaagtagctgggactacaggaatgtgccaccaggcttggctaattttgtaagaaattttctgtagagacagggtcttaccctgtttttcaggcttgtctggaactcctgggctgaagcaatcctcctgccttggcttcccaaagtgctgggattataggtgtgagctactgcacctggcccatttagttctttatatctgttgtttctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggtgcccgccatcatgcctgactaattttttgtatttttggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgatatttttgtcaggcattcaacccagttggcttcagtctacaagttgagatttctgtaggattgtggtttcaatgtctgttacattttgaaagcctttgcagttctattgagatatattccatgcgtgtgccacttgatggccattgtggaatctggatgatagtccatcttgtagttcagttctcaaagtctatgcctggccgagtgcagtggctcacgcctgtaatcccagcactttgggaggccgaggtgggcggatcacgaggtcaggagatcgagaccatcctggctaatatggtgaaactccatctctactaaaaatacaaaaaattagccgggcgtggtggcgggtgcctgtagtcccagctactcaggaggctgaggcaggagaatgggatgaacccaggagacagagcttgcagtgagcctagatggtgccactgcactccagcctgggtaacagagctagaatccatcttaaaaaaaaaaaaaaaaaaaaagtctatgccttactgttttgggttatatccacccatgtgcagcttgggggtgaacataggagttcattaaccactttatggggccattttcttgagttcctccctctgtacaatctccccagtactatctggttccctggggccgcctttttcagtcctccagccagaaagctaggactttatttaatcctgcatctgttactgcatatggggctacgcaatgggaggctagaggaaaaaaaaaaagcaatgaggttttgtctcacccttttaggatcacaactcctctgatcagagaggaaggtttccttacttcagagttttagccttctttgggtctctgcttctgctgtggctttcctcatggaattgctttgagagaatagcaagaactttaaagaaaaatgggagatttttgccattctctctgagtgttacgatactccttctgcactccttaagctagaactagagggcttttcctggagctctctttactgacaccaatacccacttgtgggtttcaggcagcagtccaggctggtggatactggaggaataataaaaagataaattcattattggttcagtgttatgtaaaagtcttctccaattacctgctagtatttaattttttgagtcttcaaatagttgttctatatgttctgtccatttcttagtggttgccttcagtgggaaatacaggatggagtgcacttactccatcttacatggaactagaaccccttctagttaattatccttttgatattgatttatgctagtcaacaacatacactgcaagttcagtcctttgaacttccttcatggcccatcttaaggtctgttttggtaaagtgtagcaagtgtgcttgaaaagaatgtgtgtgtatactgcagttgttgggtgaagtgttctagataaatcattacatcaagtttattattactgtgcttgtcacttctttgttgcttattctatcaatagctgagagagttatgttaggctctcaaactatgtagatttgtgtattttccctttagttctgagttttttgcttattttgaaattgttagtagtggtacatatacttttaggattattctcgatgaattaacctttttataattatgaaatagtcctctttattactgcttatacttttttttttttttgagatggagtctcgctctgtctcccaggctggagtgcagtggcgctatctcagctcactgcaagctccgcctcccgggttcatgccattctcctgcctcagcctcccgagtagctgggactacaggcgcccgccactacgcccggctaacattttgtatttttagtagagacggggtttcaccgtggtcttgatctcctgacctcgtgatccgcccgcctcagcctcccaaagtgctgggattacaggcgtgagccactgcacccggcctactgcttatactctttgttccgaggtaaactttcatgttaacatagccatctcaggtttcttttttttttttttttttttttttttttgagacggagtctcactctttcacccaggctggagtgcagtggtgtgatcttggctcactgcacctccacctcctgggttcaagtgattctcctgcctcagcctcccaagtagctggagttacaggcacgtgccatcacagctagctaatttttgtgtttttaatatagacagggttttgccatgttggccaggctggtcttgaactcctgacctcaggtgatccacccacctcagcctcgcaaagtgctgggattacaggcgtgagccaccgtgcccggcctcagctttcttatgactgtttttatgatacagcttctttaagctttttacttttaatttattggtatacattaatagataattgtgtcggtttttaaattaatcatctgtcctgatcatctgtcctgatcatctgtccttctttgtttatacttgcactgtccaatagaaacatttaccacagatgccaaccaagtatatacttttaaattttcttgtagccacattgaaaatgtgaaatgaagctgggcaaggtggctcatgcttgtaatcccagcgttttaggaggccgaggtgggaggatcagttgaggccaggagtatgagacctgcctgggtaatatagcaagaacttgtctgtaccaaaaaaattaggcgtagtggtatacacctgtagtcccatctacttggaaggctgaggcaggaggatctcttgagctcaggagtttgaggttctagggagctgtgatcataccactgcactccatcctggttgacaatgagaccatgtctcttacaaaaaagtgaaaagaaagttgaaattttcataatgtattttatttaacacaccgtaattttttatttttgtttttatttctttggaaacagtctcgctttgttgcccaggctggagtgaagtggcgtgatcttggctcactgcaaactccgcctctggcttcaagtgattctcgtggactacaggtatgcgccactacacccagctaatttctgtatttttagtagagatggggttttgccatgttgcccaagctggtcttgaactcccgagctcaggcaatccgcccaccttggcctcccaaagtgcaagatgacaggcctgagccactgtgcccagcctaacacagtgtagtttaaacattaatttttttctttttctttttttttttttgtgagacagtctcgttctgtcgccaggctggagtgcagtggcgcaatctcggctcattgcaacctccacctcccaggttcaagcaattttcctgcctcagcctcccaagaagctgggactacaggtgcgtaccaccatgcccagctaattttttgtatttttagtagagacagggttttaccatgttggccaggatggcctcgatctcttgacctcatgatctgcccacctcggcctcccaaagtgctgggattacaggcgtgagccactgcgcctggcctaaacattatttcaaaatataattaatatagaattatgaattagatatttcacttttttgtattaagtttttaaaaatcaatgggtattttaaagttgtaacatatttcaatttggactagccaccattcaagtgctcagtagccgtatgtgactagtggttattgtattggagagtatgtttagaccatacatttagtgtagtgatcagtatggttaaatttaaattgatcattttgctatttatttgttttttcccatctgttctttttcttctttttttttaaatttattttctttttctgagacagggtctcactctgtcacccaggctgaaatgcagtggagtgatctctgttcactgcagccttgccctcccagcctcaagtgatcctctcatctcagcctcctgagtagctgggactataggcatgcaccactatgcctggctaatttttgtattttttacagagacagagttttgccatgttgcccaggctggtctccaactcatggacgcaagcgatctgccacctgggcctcccaaagtgttagaattacagttatgagtcactgggcctggccctttttgcctttaaaaaaattttcctgctttcttttggatttattttttgttactatttaagtattccattttatgccttctattggcttactaggtacctttgttttgttttaatgattgctttagaggtgacaatttgcatggtaaaatattgaggttggccgggcacagtggcccacccctgtaatcccagcatttgggaggctgaggcaggtggatcatctgaggtcaggagttcaagaccagcctagccaacacggtgaaaccctgactctactaaaaatacaaaaaaattagctgggcgtggtggtgggcgcatgaaagcccagctatttgggaggctgaggcagggcaatcgcttgaaccggggagacggaggttgcagtgaaccaagattgtgccactgcactccagcctgggcgacaagagcaaaactccatctcaaaacaaaaacaaaaaacaaaaaaagccacacaaaacattgaggtaaagttcacataatataaaattaaccattttaaagtgaacaattctgtgtagtttagcaactactacctctatgtagttgaaagacatttacatcattccaagtaaaagcttttatccagtaagcagtttctttctattcccttccttcagcccttggcaatcaccaatctgcattctgcccatatgaatttatctattctggacatttcatataaatggaagcatacaatatgtgactttttgtgtatgacttctttcacttaccatatttttgaggtttagtcatgttatagcatttattagtagtttatttttatggctgaataatattccattgtatgtacatacagtcatgtgtcacttgatggggatacattctgagaaatgtgccattaggtgagttcaacattgtgtgaacgtcatctagtgtacttacacaaacctaggtagtatagcctactatatacctgggctatatgttatagcttgttgctcccaggctacctggacagcatgttactgtactgaatattgtaggcagttgttacacaatagggagtatttgtgtatctaaacatacttagacatagaaaagatgtagttaaaatgttggtattatcatctgtgggaccaccatggtatatgcagttcattgttgactaaaaatgtcattgtgcagtgcgtgagttaccagaatttgtttatctgtttattcgttgataagtatttttgggctgttttcaaccttttgccaattttgaataatgctactatgaacatgtgtatacatgtatttgtttacctgtttttaattctttggatatatacctagaagtaggtatataccaaaattgctatggtagttctgtgttttattttttgagacactgccaaattgtttcccgtggttactgaactattttatattcccaccagcaatgtatgaaggttccagtttctccacatccttgtcagcacttgttattttctgttgtgggttttcttgttttaattgtaacgtcaaaagcttttgagactggacaggagtttactgataaagcttcttctagtacatctggatttcctggtatgcttctctcctaatatatctggatggctgctttttagctttctttagttctttttttaaacttaccatactagtgggtgtgaagggtacattatcgtggttttgattttcattttcccaatgaccgctgatgtcaagaagagtaccctggctgcgcagggtggctcacacctgtaattccagcacttttggaggccaaggtgggcggatcatgaggtcaggagttggagaccagcctggccaacatggtgaaaccccgtctctactaaaaatacaaatattagccaggcacgatgatgcgtgcctgtaatcccagctgcttggaggctgaggcaggagaattgcttgaatctgggagtcggagattgcagtgagccgagatcatgccactgcactccaacctgggtgacagagcaagactctgtcttggacaaaaaaaaggaagagtacccttttaatgtgctgttgagagtaatatcttttcagttattttgcccattttttaattgagttgtctttttttatttttttgagttgtaaaagtatattctggatagtcaactgttcttagagatatgatttacaaaacaatatgcatctttaacttaacacagcctggaaatatttcacttcacatatactgtattttcagttttctacattcctatcctttgtgttattattgtcatacgttttgttttcatgtatattatgaacactgtaacttattatttttgcttaaattgcttactttttaaaaaaattttaaatgaaacaattttaaaaatattgacatttgtatttctggcactttttttttttttttttttgagacagtgtcactctgtcgcccaggctaaagtgcactggggcaatctcagctcactgcaacctctgcctcctgggttcaagcagttctcctgcttcagcctcctgagtagctggcattacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccatttctggcactttttatagttttgtatgggttggtctattatcattcttcagatatatttggaaatatgcattttccaaatatattttctgcttctgcccatccctgttctctaattttcttttgagacaccagatatgcatgtgttagaccacttacaatttcctataggtcactgaagctttgttcagtttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgcttccattgactgatagtcctcctagttatgaatcatattttgtgcctcttgtcttgtaattttagatttagttgtagacattgtgatattacatttttgaatatttgtattttaaaaatctttttaaaaggatgttgagtttattttggtgctcttaagttttttgcagatcaacttgatgctcttgtggctgattttaagctttattctgatagttttagtgtagcttttattctagtgtagttcatcccagcaactgagatgtgagctttctaaggctcctagtgaatgtcataagtattcattaggcttctgaaatctgaccagtcagaacagaaatgtgccccaggtctgtgtagtttctagttgctgagcttatagttctgttgtagttttttgcctagtgttgtggaatttcactgtatgtatacaggacttagtattcaggaactgagtcaggggtgtcctattcaggtatttggaacctttttctacataattcattcttcagtattctgcctcactaattctttttagccttcatgtattttgtttcctcaagtaagtggtcccattgtactctgtttgagttcccctttcttgtgcagcagcctggacagtaccttcgggtagaagactaggataattttaagggtcaccttatttgtttcccgtcattcagggattacattctggcattgtttgttgttcagtgtcttgaaatatatgtttcacatattttgttcagtttcttgatggtaggaagataagtttgataccaattattgccttatggtagaatctaaagtctagtgcttgtttttactttagagtttaattttatttaaacttaatgtactagaagtcctcatattacatatttctaatgtgcataaatttcagttagcacaatttagttaagtgacactagtcacccaataccatggttccaatttcagttaccatagtatattaactatgagtaactatgtaaagtacaaacttcattgctagtactccagtccacacatgactatgtgaaaaacagatacacactagtctatttacttcaaggtctgttggcgattaagtttatatacagacaataaagtgtctagttgtattgtctttcccaatgttaagcccacatgatattttatagaaatagataatcaaaagtggaaattggccaacagatatgaaacaaagtaacaaaaaatgataaccctttcattgaaatttgagagaaatgtaaatgaagttatagaagaaatagttgaccataggaaaattgacactgtcaccatttgatagactctagatatgcagccagaggaacttattgaaggtgaacttattaacataaatgagggaagtggtttttttgtttgtttgttttgggtttgtttttgagatggagtcttgctctgtcgcccaggctagagtgcagtggtgcaatctcggctcactgcaacctctgcctctcactgcaacctctgcctcctgtgttcaggcaattctcctgcctcagcctcctgagtagctgggattataggtgcccaccaccacgcctggctaatttttgttttgttttgtttttttgacagagtctcgctctgttgcccaggctggagtgcagtggtgcaatctcggctcactgcaggctccgcctccagggtttacaccattctcctggctcagcctcccgagtagctgggactacaggcacctgccaccacgcctggctaatttttgtatttttagtagagatggggtttcaccatcttggccaggctggtctcaaacacctggcctcaggtgatccacccgccttggcctcccaaagtactgggattacaggtgtgagccactgcacccagcctgagggaagtggttttgatgcaaaagatgaagatgtcccagaggaaatctttacattaaaggaaaaaaaaactttatattaaaagaccttgagatatttcacaaaattgaaagtacaaaggataaaatgttagattgtgaccttgctttgtttctaatcttctcttaaaccaatctaatgaattcttaatttcaactttcgtgtttttttatatacaggattttcatgttatatattttaaattttagattccaattttctggtgtaactttttaatctgttttgttgaatatcttaaatatggttattttaaagtctgtgattacttatcacattgggggctgttgtttttaactgtgttaatatgtacataccataaaattgaccatcttaaccatttttaagtgtacaattcagtagttttagcacattcacatcattgtgcaaccagtcttcagaactttttcctcttgcaaaactgaaattctatactcattaaataacaactccccattacccatcacctctcagctcctggcaaccaccatcctactttctgaatttgactactctaggtaactcatataagtggatttatacagtacaggcatgcactgtataatgacatttcagtcagtgatggactgtgtacacgatggtggtcccttgagattataatggagctgaaaaattcctatcacctagtgacattgtagccaatgtaacgtcatataatgcaaggcattattcaggtgtttgtgttgatactggtgtaaatgaacctgctgcactgctagtcataaaaaagtgtagtacatactattatgtacagtacataatacttgataataaacaactatgttactggtttatgtacttactgtacagtattttttattgttattttagagtgggctacttctacttattaaaaaaaattaactgtaaaacagcgttaggcaggtccttcaggaggtattccagaaaaaggcattgatgtcataggagatgacaggtccatagatgttaattgctcccaaagaccttccagtgccataagctatgaaggtagaagacagtgatattgatgatccttgctctctgtgggcctaggctaatgtaatgtgtgtgttcatgtgttggttttcaacaaagatgtttaaataatatatataatatatattttttaaataggaaacaacttataaagatgtaaggaaaaatatttttgtactgctgtacaatatgtttgtgttttgagctaaatgttattacaaaagagtcaaaaagtttttaaaaactaaaaaaatttataaagtgaaaaagtcacagtaagctaagtttattactaaagagacaaaagtatgttttaataaatttagtctagcctaagtgcacagagtttattggccatcttaaccattataaagtctatagtagtgtacaataatgtcctagaccttcacgtttattgaccactcattcagtaactcacccagagcaacttgcaatcctgcaacctccattcatggttaagtgccctatataggtgtaccattttttatctttttgtctttttttttgagacaaggtcttctgttgcctgggctggagtgcagtggtgagatctcggcttacttcagcctccacattccaggctgaaatgatcctcctgctgcagtctcccgagtagctgggactacaggcatgtgccaccatgcctggctaatttaagtattttttgtagagatggggtttcaccatgttgcccaggctggtcttgaactcctggactcaagggatctgcccacctcagcctcccaaagccaccacacccagccaccacttttattttattttattttattttattttatgttatgttatgttatgttatgttatgttatgttatgttatgttatgttatgttatgttatgttattttgagacagagtttcactcttgttgcccatgctggagtgcaatggcgtgatctcggctcactgcaacctctgcctcctgagttcaagcgattctcctgcctcaaccttctgagtagctgggattacaggcatgcgccaccatgcctggctaattttgtatttttagtagagacagggtttcatcatgttggccaggctggtctgggactcctgacctcaggcgatctgcccgcctcagcctcccaaagtgctgggattacaggcatgagccactgcgcctggcccttttaatcttttatactgtatttttactgtactttttctgtttagatacacaaatactttccactatattgcagttgcctacagtattcggtacagtaacatgctgtccctgcttgtagcacaggagcaatatgctctacctatagtctaggcgtgtggtagtaccttctagatttgtgtaagtacactgtgatcacacagccgagaaatcacctagtgatgcatttctcagaatgtatcccctttgttaagtgtcacatgactgtatttgtctttttgtgactggcttatttcactcagcataatgtcctcaaggttcatccatgttgcagcatgtgtcagattttccatcctttattaggctgaataatattccattgtatgcatatactagattttagttatctacccatctgttgatggccatttgaatctgtctactttattgtttgccttttcccctggtttttgtttgttttttaatttggccatttgatccctttgctttgaatgcttcgtaattattcattgagagctagatattttttaatgaaaatgttagagactctgaaatcattcttcacagggtgttgaatattcttttcacagacatatccctttggttcagttgaggcatctctgtttttggtgcccttcattgttctggttcatgtgactcttccatggtgtcaattgaaagcctgagttgttgttgttgttattgttgttgttgttttttaccagggtaccttgtcctatatgcaccctatactccagtctttggctccacagcatcatgagactgctgaaatacacttcagacttagtttttcagcatcttactctctgcgtgtaaaatttaggagtcaggaaatgccgtaggggaaaaattatacccagaatatcaggttaaccgtaatgcatttcccttctgcctaggatctttgcccctaaagttttggctgtattagttgttctctctctcatggcttccattttctatattttatttagcttctataattttctgcatgaaatttagtctgataataattactacattatgaccaaaagcaaaatcccagtatgtatttttattaatttatattccatgttttatttttaaacattctcaaactacagaagagttgtaagtaaaatgcaaattgtttttttttcataaaccacttgagaataaggttctgacatgatgtcccatcacctctgaattctctgtgtatttcctgcaaaccagaacattctcccatataacccaataacaaccatcagaattaaggaaattattattggcatattattttgtcatctaatccacagatcccattcaagtttctctagtaatctcagtcaatgtcctttatataatagaataaatatctagttcaggatcacatgatacatttagtagtcatacctctttagtctcgtttactctggaacagttcttcagtctttccttggctttcataacattgacatttttgaggattacacgccagtatcttgcagaacatttttcaaattgggtttttctgatgtattctcatgattagatccaaattaggtatcttcgacaggaatatcacagaggtgatgttgtgtttttattgaatagtatcaggtgacacataatgtgaatttcttccaatattagtgatattaatgttgattacttgattaagatatcagggtttttttcccactatagaattaactttatatttttccaattaaaacgaagtagtattttgtggggaggtattttgagactatttaagtatcctcctccttatcaaacttacagtttatattttgtttcattttattttatttcattttagagatagggtcttgttctttcactcagggtggagtgcagtggcgtgatcctcattgtaactcctgggctcaagtgatcttcctgctcagtctcccaagtagctggaactacagatgcgtgtcaccatggcttctttttttcctgttaattctttttgtagaggcaggatctcaaaatgttgctctgactggtctctaattcttggcctcaggcaatctgctgggttacaggtgtgacccaccacacttgtccccagtttattttttatgtcattaatggagtcatagatttcaactttattcagtggcttattttattagttatctattattacataacaaattacctcaaattgagtggcttataataacacatacatttaggctgggcacagtggctcacaccagtaatcccagcactttgagaggccgaggcaggtgggtcatttgaggccaggagttcaagaccagcctggccaatatggtgaaactccatctctactaaaaatacaaaaaattagctgggtgtggtggcgggtgcctgtagtcccagctactcaggaggctgaggcaggagaatcgcttgaacctgagaggcggaggttgcagtgagccaatattgtgccactgcactccagcctgggtgacagagcaagactctgtctcaaaaaaaaacaaaaacacagacatttatatttttttgggggggtgatttacaagtgagttgtatttaaactttaaatggcgaatagttattacaatattaaatttttcaaaaatatatagaaaaatgaatacttaatacttattttcaataaatttttatgagctccagtatttcagagtgccacctcccaaaatgacagcatgatataccttggcaatagtttagacctcttctagaattttctcacatctgctttttttttgccaaacatatatatgtttatattttttctccctggctgtattgctgtataattggcaaacaaaaattattattattattatttttttattctggggtacatgtgcaggatgtgcaggtttggtacgtaggtaaacatgccatggtgttttgttgcacctatcaacccatcacctaggtatcaagcccagcatgcatcagctcttttccctaatgctctcccctgacccgccctcctggcaaacaaaaattacatttaaggtgtacaacatgttgttttcatatacatattcattgtaaaatgcttgtctcaatcaagctaattaacatatctgtaacctagcatacatgtaacatctcacagtttcttttctttctttctttcttttttttttttttgatacagagtctcgctctgtcacccaggctggagtgcagtggcacgatcttggctcactgcaacctctgcctcccaggttctggcaattctcctgcctcagcctctggagtagctggaattataggcacacaccaccatgcctggctaatttttatatttttagtagagacagggtttcaccatgttgaccaggctggtctcgaactcctgacctcaggcgatccacccacgtcggcctcccaaagtgctgggattacaggtgtgaaccacttcgtctggccagtacctcacagtttctttcaatcaggagtctgggcacagctgacctgggccttctgctttagaatctctctcacaaggccataatcaaggtggtgtctagggctgaggtctcatttgaaggttttatttcgagaaaaagccacttccaagcttattgttgttggtggtggtggaattcttttcttcaagggctgttggactgagcctcaattcttagttgtttgttgactgggtcaccgccaggtctgtgccatggggacatctacagtatgactgcttgtttcatcaaagcgtgcaaaccaagaaggcaatagagtctgttagcaagatggaagttgcagtcttaacctaattaggaaaatggcatcacatcacctttaccaagggcatgcataccaagcggtgggaaacatcggggggcatgttagagtttgcctgctaccgttatccattattatcattatttagtttgatattctaattttctcaaatgtagcctgcctcagtctttcactctggcccctgtattattttgacatgtctctgtcattcattgagcacctcaagaagatattccaagctcctcttaaactttcctgtccaagccctcgcattgttctaaggagctctggttccttttagtggagagtgatattttgaatcattaaatgtgtttgttgctattaggttgctcctaggccctctcagttggtagtcagtctgtgtgtgtctgtgggtatatgtgtacatatatatatatatatcatgaatatattatttacctaggaatttctcggtgtaatacattgtaagatttcagcttacaacaacatcctcaattctagttcagcaatgtaatattcattctagttttctttctttctatacttgtaacttgtttttctgattatgagaaacctagctcttattatcctttgtatttgatctgccacctttatttgatcaatcttcctgtataatccatctcctgttgctgacatatctctcgctccatttctcaccccatacttcatatgcatgcctccctcacccttttgggatccgacagcttgcacttggctgccccttccaccctcctcactccactgggtctgaaactcactgctggaccactgcctctccctctcttaatgcatgccttcttctgccgacatgggcaaccctcactgccatccccccaccctccactgccctgtgtggatgtggacatcctcatcattctgctcactgctgttacagttcctacgtggtagccttccttgttccattagggctctgtcacctcatgctgggtccccctcccagcagattttttcctatcactctgcttagtccctgaaactctgtgccctgtccttttccctctcgggaatacccttttcctactacttggactccaaaagcctgttttgggccactgtagtcaactctctgccacttagcttgatgcctcctttgcctgtactcacctattgaactgttcaggtaggaaaggagaagagggagaggtatcagttaaattttatttttgaaaaactcactggtatttttacaacaaatgcttttaacttagtttgttattacttacatagaagtcagttactcccacatctctgtaatcgctacaggtttatactcatattttcatgccatatttttcttacatactagatagaggtttactatcacatcagattcatgatttctgaacttggttactccctgcaccctccaaacgagtttcagtttaccagtgtctgtcactaccactactgttcttctagtcattcaagtttgaaatgttgaagttaattcatttttccttatgatcagttatccagtcctgttgatccttcttttgatgtacgttatcttctccatggccattactttaatgaatataataacctcttgggtgcgatttctttatttagtttgtgtagtcattcctgtgcccctaaaccattttggcttcccatttcttaatgagtgaagtaactccatgtttaacttttaaagtgccattttaatgtaacactattctagatagtcagaatatctagttttgactcccatctttgttgcttactaactactcatcaacgtgtaatttatttaacctccctgggtctgtttatttttattttattatactttaagttctagggtacatgtgcacaacgtgcaggtttgttacatatgtatacatgtgccatgttggtgtgctgcacccattaactcgtcatttacattaggtatatctcctaatgctatccctcccccctcccccctccccccaccccacaacaggccctgatgtgtgatgttcctcttctgtgtccaagtgttttcattgttcaattcccaccaagagtgagaacgtgcagtgtttggttttttgtccttgtgatagtttgctgagaatgatggtttccagcttcatccatgtccctacaaagggcatgaacttatccttttttatggctggctactattccatggtgtatatgtgccacattttcttaatccagtctatcattgttggacatttgggttggttccaagtctttgctattgtgaatagtgccacagtaaacatacgtgtgcatgtgtctttagagcagcatgatttataatcctctgggtatatacccagtaatgggatggctgggtcaaatggtatttctagttctagatccctgaggaattgccacactgtcttccacaatggttgaactagtttacagtcccaccaacagtgtaaaagtgttcctcttctccacatcctctccagcacctgttgtttcctgactttttaatgatcaccattctaactggcgtgagatggtatctcattgtggttttgatttgcatttctctgatggccagtgatgatgagcattttttcatgtgtctgttggctgcataaatgtcttcttctgagaagtgtctgttcatatccttcacccacttgttgatggggttgtttgtttttttcttgtaaatttgtttgagttctttgtagattctggatattagccctttgtcagaggagtagattgcaaaaattttcttccattctgtaggttgcctgttcactctgatggtagtttcttttgctgtgcagctctttagtttaattagatcccatttgtcaattttggcttttgttgctatggcttttggtgttttagacatgaagtccttgcccatgcctatgtcctgaatggtattgcctaggttttcttctagggtttttatggttttaggtctaacatttaagtctttactccaccttgaattaatttttgtgtaaggtgtaaggaagagatccagtttcagctttctatatatggctagccagttttcccagcaccatttattaaatagggaatcctttccccatttcttgtttttgtcaggtttgtcaaagatcagatagttgtagatgtgtgttattatttctgagggctctgttctgttccattggtctatatctctgttttggtaccagtaccatgccgttttggttactgttgccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtattgatattgattcttcctatccatgagttttttttaattaagttaaattttttttattttccagtttttcataaaaatagagatggggtctagttatgttgaccaggctggtcttgaactcctggtctcaagcagtcctcccaccttggcctcccaaagtggtgggattatacacatgagccaccttgcctgaccctctctgggtcttatttaccttactagtttattatacaggtgaatgaattggggaagagcttgttccgcaattcattgccaaacaatgaattgttagactgacaaagctaactaacaaagcttgttagtttgttatacagagaatgttatacagatgcagcttgttagtttgttatacatatagtaacaagtgctacaataaaattaaagtctgtgactgagcttttctaaatatttgaaaatttacctaaacttatagtagctgttgtctaatgcaatttagtacattgttaaattttttcttgtagttactatttgttagtagtttatctccttgaaatagagtgtaaactacttgagtctgtggatttgtggagacaaacacatttgagtattatttctgccattgtcatttaggcactataacttcactgaacttgagtgtactctcttgttaaggcaaaagtactaataattctttgacaagaaggtaatgcttaaatgaaataatgtacttaagggatctagtacaatgcctggcagacagtttattcccggtaaactttacttatcctctttttgtactccacctgtgcccactttggtaatgaaaaaataaatggcttcccagaacagtttgaaatgcaagtggcattcacagaagcctattcctggtgatgatgccatttatatttttttcttttgcactttgcagcttttagaatccttattttagccgggtgaggtggctcgtgcctgtaatcccagcactttgggaggccaaggcaggtggatcacctgagttcaggagttcgagaccagcctggctaacatggagaaaccctgcctgtctctaccaaaaatacaaaaattagtcaggcgtggtggtgcatgccggcagtcccagctactcaggaggcttagtcaggaaaatcacttgaacctgggaggcggaggttgcagtgagccgagatcatggcattgcactccaacctgggcaacaaaagtaaaactctgtctcaaagaaaaaaaaagaatccttgttttagttttaccacaaccttgtgcaataaggctgggcagatatgattatcctatctgacaggtgggagttttgtttttggagtgaactaaattgggattcttaagaggcaatcattggatttgtaggtaaagtctgaatgtattacatgattatggtatactgcatttctctgaatttcttagttgatatagtagtgaaaagggaattcttctattccatggcttaaggatacgtaaactctcagtacagcaatctttttattgttgattattatagcttctgttactcctagaagttgaccaacagggaccttaatttaggagattttgtcattcagctttcgtatagtaaatgctgaggctagccctttgcctgcagggctatcagtgaagaggatctgtgacattactccagacagccaagtgtagggggaagagttgagattttcagtgttctctgtgtaaatgaattgtgccattgaacctgatgggcactagatactatattcttcttgaagcactggaggcccttcattgcaatcttgttttttcaacttttattttaaaattggggtatatgtgcaggtttgttacagagatatactgcacgatgctgaggtttggagtctgagtgaatctcacccaggtagagagtgcaaagtacccataggtagttttttcaagctttaccccctttgtcctcccaccttttgtattcctcagtgtctgttcccttctttatgtccatgtgtactcaaggttttgttcctatgtataagtgagaaaatgtggcatttggttttctgtttctgcattagttcgcttaggataatggcttctagctgcatccatgttctgcagaggacatgatttcattattttttatggctacttagtattccatggtatatgtgtactgcattttctttatccagtcttccgttgatgggtacctgggttgattctgtgtctttactatcgcattgcagcatttcaattttttttctgattcaggtagtagaaaacatgttcagtcttatttttttctgtgctgtgtatgctttttaaaggctagtgaagtcattcagttggataacaacaattataatacattgttatactcttcaactttctttgattttgcaaaggagagtcaattggggtgacgttaggtgggaactgagctgaagaaactaatatgtgctgtgcagggctggatttgtgtaggatgcagtcattatctgttaactttgtcatagcttttgagactgcatgtaaggagtaggtgatttgcaagttatttaacagttaacagaaggtaaatatttaaacaggagaatgcgtagttgctgcttagtttaaaacctgcttttttttttttttttaattaaaaaaaatgttttttagccaggcgtggtggtgcacgcctgtagtcccagctactgggcaggctgaggcagaaggattgcttaagtccaggaggtcaagggtgcagtgagctgtgatcgtgccactgcactccagcctgggcaagagagtgagactctgtctcaataaaaggaaagaaagggaaaaaaaattaagtatagaaagaaaattttaggaatttaaatataatttgcaaggaaaaacaacaaaaacagtccaaactttaagtagaaaactatgtgcttttcaggtattttaaaggtaaattttaaagggcattatttattaaatgttgaaggacagaaaacatcttacatatttgtcagaaactgaccaatcagaatggccctgaaatgtatagacttaataaggatagtaaccaaaatgacagtcctttccactttgttcctcattgcccaaatttgctattttctccttcttttacgaaatgcttctaaatgtgaagatagaagggaaacaggtagagtaaaagttatagcccactccatttattttgtaataatattttttctcagtgttaagtggcatttaccagtatagataagattaattgttacaaaacaaaccaatttgaagattagtttttaaattgagccataatatataaaatcttatggtaatgtgcagatctgactatattcaagtatagttttcatacccataccaattgtcttgtaataatcgggaatgcatcctctgtgtggtgtttgcaaattaatgctattttggaaatcacaccggtatatctagtggctttcctgggtgtatgtggctcattactgattataattttctttgggaattttagtttaaggggatggggtaagcactttcaaattctttgttgttagtagttttgatggaggatagggataaatgaatgaggaagtgtgttagaacgagtaagtaaactcagataatttatcaagtacatactacaaaaataacgcagatttttatgtaaaacggaggagacaaatcattcacaagaggaaagccttaaaaacttaccaaggagcattcacaaaaataaatatgtatattttaattttaaaaagagccccaagtctgtgaatgaaagggttctggttggtttctagacccagctgtgcttgctgtatgccatgcaggtggctttagtatggttaaaagtgtcgcctgccctcttgtgaagggaagcaggagaagcgacaagctaccttccagtgcctcctcgattttcttccactatttcctttgtccttttcctgtgttttcatgctctatttatttacacccacttctgacttctcttttttctcagattcaatctttccttccgaatgactgtgagatttttttctacccagcacacacagaaacttaaccaattgcgtatgtacagcatttccatttcttttttctttctttttttttttttttttttttttgagacggagtcttgttctgtcgccaggctggagtgcagtggcacaatctcagctcactgcaacctccgccttccgggttcaagcgattctcctgcctcagcctcctgagtagctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagcatttcttataacaatgagttacttttatgttaaggatttttttttttttttttgagacgggtcccttccttccttccttcttctctttcttctcttactttcttttctttcttctttctttccacagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctcccacattactgaggctggtcttgaacttctaggctcaagggatccacctgcctcgccctcccaaagtgctgggattataggattgagccaccacatctggctccaggacagtgtctactaccagaacagcatttaataagtatttattgaataaatgattaaaatattagccttaagaaaattttagtatcatttacttaaaaaattagcaaagcattcttaatacgtataaagaagtaatatgagtagaatgtgattctcaacagcaaggaagctttttttaccctattttctccattctctttctgttgccttctccttccaatgtgagaatctctgctattaagaaccgctggcagagactgaaattagtatacataattctaaggagatattgatgtaaatggtcgatatggattggcaggatgacagggagaaggaaattataagtttaaagacaggggtaagatgagtatttgaacaaaatatcaaggtaggtagttagctagagtgccagggccaattagaagattagagaaggtgagttgatgttggcagtgggggaaatgtcagattgacagagtgcttggatttcatacagtagatatctcatcatgaattattgatgagagtgacatgataacaaagtgaagacaattatttttctatttagctgctgtttataaaatggatcgtagcttgaggtgaggaaacgttgaaaacagtgaacaaagttcagagattgttggagtaattcaaagcagtttagctgttttgcttggtatgttatctggtgatgcctttagcagatacccttcttttgaagcccagtgtccactttatgactgagggatggatggaggcaggaggaagaattctgcactagaaagcaacaggccaagattctagtccctacttccctactttgtaaattcataatcatggataaatacttaatttttcctgggcatcagtcaccttacctataaaatgaggataatgtattaagcgtagtcctatgggtggtaaataaaatgaggataataatctaaaatcaggggatatacatagatctcctttggatttatttgcagcccattatctatctatctttatttagataagagacgggatcttgctgtgctgcccaggctggatttgaactcctgggctcaagcgatccacccatctcagtcttctgagtagcttggaccacaggcacaaacctcttgcatggctctcattgtccatttatcaattttagatggtgtaaacagtgaataccatattttgtttcccaatattactttctacaactatattgttttaaggagaaaaaagtctatgacaatataaaatatttcaaagtctgtaattttaaggtttaatgttacctatattgactactatattttaaaatatgtatccctgtttttatatgtgccatgattaggtatttagttttttagttattattagactgtaatagcactcaagttgatggataaaatttcatcctgggatacttttagagaaacatgaagaatataaaaatagttttgaaaagtatggtttctttcttacaaagctgtagctgcaataatactaatgtcagttacttagagctactagaaatgtgtaatttctaccttttttgactactgaatataccatatgtattatatatatgtacattcttaggtatttttgtttgtttgtttagaaggttttaataccaacagctttctaggtgtcgtcttcttcctcttcctctcccctccccccctcccctccctcccttcctcctcctcctcctcctcctttttcttcttcttctctctctctcctttctctctcttttctctctcctttttctctgtctctcctttctctctctctgtgtccctgtctctctttgttgttgttttcccttctgtttgggttgtttcttcccctcgccttataccccccaccccccacagaccccaatccatctggaaagatgaagaggcagctgctatggtaactgtgcattttggttaatgaatagcagactaacaagatacataaaacatacgcaaactgtgcagagtttgttgctgtcaaagccgtagggatacaatactttttcttttccttctaaaaaaaaaaaaaactctcttaactgtggtgttttgttttctaatttaccattcctaatattgtaatgtttctgtgaactcctcctctttctgcttagtctgcacagtattacaccctgtggtgagtttatgggagctgagttgaggtgcatagaggaaaataattgatcaactggattaagaagtagatttcctttagactgatacatagaagaatagggacaaaatgtttttgactaaatgtttggttttttgaacgataacttctttttttacctcctttccttttggccactactgccccttttgggattctctctggggttaaagccagtaagtagtgtgtttcttaaagatgtttctatcataaaggtcagctgcaactggaatattgcgttcagccaagccttaaaaattcctgtaatctgtgccatcctgtctcatactgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgcgggcattagtgtatgtgtctaattcattagtatgtgcctcctcctttcccatactttacttatattcatcttttctccttcatattgcctgtatctcacatcactcagtactcctttaatgattagtttataatgtagacccagactgatccactcttaagacaatgtcatcatgattggttacaaaaattgacatagtacagcttgactgttggctttcagatcaagtagaagtatgatagtagattttaaagtaatctcaataaatagcagttcaatacgtaatatttgctctggacctacataaagccaattagtataatcaatcaattaattacaatcagtttcctgaacattttcttattttttttaaatgattactcaaagtataaagtgccctcttcagagtatctcctggtaattatactactaagtatatattttttataactgttttatttatatcttgattaacatttctaatttctaggtggaaaaacctttgagacctttaggtacagtattcaccttgagacactctagctagtgtttcatgaattaacagattccagttcccctcagcctttcttttttttttttttttttttttttgagacggagtcttgcttcatggcgcaagctggagtgcagtggcgtgatctcagctcactgcatcctgcgcctcctgggttcaagcaattctcctgcctcagcctcctgagtagttgggattacagttacgcgccaccacgcctggctaatttttgtatttttagtagagactgggtttcaccatgttggccaggctggtctcgaactcctgacctcaggtaatccacccatctcggcttcccaaagtgctggaattacaggcaagaaccaccgcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtcttatctgcgtacctcaggtatttggaatttgtgtttagcattttatagtaatacacaacaaattagtttttatattaatatttgcctgcttttaacctgttgttcatatctatttagaagaatttcaaagataggctgtaagtgtcagaaggcttgtgactaaattttagctaaaagaggggaacttaggttttccacattcctaacctatgctaagagttgttaatttttaatgatactatttagtgatcataaagctggatattttcatttttcctttacaaaatttaatatcttaagattttcagttttcctttacaaaatttaatattaaacttccttggcttatactatgagatacaatatagtaaagcatgcaggttctaaaattagctaaatcaagtcttgaatattgtctttgtcactagtggtatgatcctgaacttatttccttatctgtaaatggatactatagtaagggcatgcagtgatggtagctgcttttatcatgatcgttataaacattattgctattattggagagtaattgatatcctgagactgcttatttatttcaaagtgaaatatcttttttttcctttttttttttttgagacagtcttgctctgttgtccaggctagagtgcagtggcacaatctcgactcacagcaacctctgcctactgggctctagttgccctcctacctcaaacttccgggtagctgagactacaggcacacgaccacacttggctcatttttctattttttttgtggagatagggtttcaccatgttgtccaggctggtatcgaactccccagctcaagtgatctgcctgcctcagcctcccaaagtgctgggattacagatgtgagccactgcacttggctatatcctatatttttaactacatatcatactgacaaggttctgccattgaagaatccatagtctagtttgttggtttttttgttttgttttgttttttaaccttttcggggttgcagttagtttaggcgatctgcaaagtctgagggaattgtagtgcctaaaaggctgctcctacttcagaaactagtttcatgtttagaggcccccacaaccactcttaggtttgataacttgctagaaaggacttagaattcactgaaaacaattatactcacagtttattacaggaaaaggacacaggttaaaattagccaaaagaagagacacatagggcagaatctcggaaggatccaattgtagaacttcctgtcatcctctccccatggagtcatggatggcattactgcctcccagccgcagtgtgtgacaatactcacagagtattaccaaccatgaaattgacctgagcctttggtgtccaggtattcactggggctctatcacatactgctcacatggctgacttctagtctcttatttcctcctggtgttgaaacttataggtatggtttagtgcccccaacatgaatcacatttgtccagtcgctaaatctctcaggcaagcagagatactctcaccagacaagaagttccaggggcccagagaccgctttccagtagccaagaggaaaggccattcctttctttggtgaagagtaattcttcactacacaggggtcatggatctctttgggaatctgatgagaactattgatcttgggtatttggcaacattgtgttgaatactttacatacatatatagatgtttattatatttctattttgtgaaatgattgagagctattaaatcacataattctgaaagtgtaatctcccaagctgataaattctaggaagggaatgttcaaggagctgtaagaatatataaaagggggacccaatctaacctgaagtttgaggtaaagaagatcaggtaatcaatgtttaagagctgaaggatgaataggaattaactcgataacagggaggaatggaggagaaggaggacatttcaggcctaaggaagagtcagtgcaaaggccccaagagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaataggaattaagaaaaaaaaattaaatattctttaattcacctaaagactataataaacctgtggcatataatgcaaataacatttttatgaaaaatatatttttcaaaaaaaattaagactagtgtattacatttttatgaatctctttaatgtctggattaagaaaagacagctggattctcatgtctgcttctgcactcaatctattgtggtttgttattttggttgacatatgtgagtaatatctgacctggcataggtatatagtttgaaagggaaagatattttaataccattttcaggtagttgcagtttcttgaagattagttgcagtatggtatctgaagccttatcaatgaacttcctctgttattgtattaaaatccattggtctcagtttttttcaataaattatgctggaacaattggatatccttgtgcaaaacaatgaacctcaacggttatactgcactatatacataaattaatttgaaatggatcatagacctaaatcggagttaacatgtataaaactaatagaaaatgtggcaaaaataatcattgtgactttgggttaggcagagatttcttagctaagatacaaaaaatatgaaccataaaagaaataactgataaattggacttcatcactgtttaaaaattctgcttttcaaaagacactttaaaaaaatgagcaggaaccaggtacagcagtgcatgcctgtagtcccagctactcaggaagctgaggcgggaggattgcttaagcccaggagttcagggctatagtgcctgtgaaaaaccactgcttaagaacagcctgaccaacatggctgaaaccccgtctctactaaaaacgcaaatttagtagagacggggtttcagccatgttggccaggctgttcttaaactcctgtcttcaggtgatctgcccacctcggcctcctaaagtcctgggattactggcatgagccactgcacctggcctcaacaagattattattatgtcttatgtagcaaaaatgggcttatgtactggttttaccctatcaattcaataatttgttctatgtcaggttcagcacacacaggtgcttgataatactggttgactaataggcagaaactggatttgaatctagtatcttctctgcccacctactggaattacagcagtcttagtgcatttgcatccttctggtttaggttttattttatttacctagatttttatttaggtaaattatttacttagatttttatttaggtaaaatttacatacagtgagatacatggatcataagtgtactcttaggtgagttttgacaaatgcatacttttgtgtaaccttcaatttcaagatacacaacagtttcataatctgagtttcctcatactcctttccagtctgtacccatcccccatatgcaattactgttctgatttgtcaccaagaatttgtgttgcctattcttgaacttacttcatataaatgccatcatatagtgtacattctttgtgtctgttttctttcaatcagtatgatgtttttaagatttatccatgttacgtatatcagtagttctcttttattgttaaatatatttcattatattagtacaccacaatttgtttatccattcatttattgataggtatttggattgtttccaattttggcctattattaataaagctactataaacagttttgtataagtcttttttttggcatgtatttttatttctcttaggtacatgtctaagaatggaatttgttgggtcatagagtaagtgtatttttaactttaaaagagacagtgaagcaattcttcaaagtggttgtcacaggaatacccatttttactaatattgacaaatatgttaatgaaatgtctcatttaatgtaatggcttcatgactttttttttttgatcattggattcttttagtaagtttgaagcatcttaagtcaaaattcttatggcaataaagaaggagaagctatggagtcattgctgaatttgttggattattcccagtagctcaaattgaaaccacagcattgagatggtttgaaaactagtgacagggaagatgctgaaaaaagttgttagaataaattctatggggatatgtttagtttgaggatatttttattttcatcattccattgatttatcctggaaagtgtatgagtgattagaagatttctgttgattaccagtagatatatttgatggaatcatttgctcattcccagcaaatggtgatcctataatctataatattaaatgagaatgagcaatagagttaaagtaattaaaaatagctgagtaattaagattctttattttgctttagatattgaaagagaagagaaatgaaattctgactgtaagaatataagtaaggggccgggcacggtgatgcacgcttataatctcagcactttggaaggccagggctggcggatcacatgagcccaggagttcgagaccagcctgggcaacatagtgagaccctgtctctacaaaaaattagctgggtgtggtggtactcacctgtcccagctatctggaaggccaaggtgggaggtcaaggctgcagtgagccatgattgcgacactgcattctagcctgggtgacagagtgagaccctgtttcaattaaaaaaaatagatagatagatagatagatagatagatagatagatagatagatttatatggccctagaatactttagctatcaagtgtaaccagtaattttaggaaaatcttgagctaagtgaaacgtgatattttaacattagctagggttccatgtcaaaggttgaaattgtattgaattcaggagagatgttgtattttattccttaagaatgcttacaagtctactgaattttaccatgtacaaagtgaaatgttaaaatggaacaatacaggaaaattaggcattattcattatatatatggaaaacttaattttacatttgagattttagaggaatatggattatcgaattgaatatacattaacattcaaattctattacaaaacaataccataaggaaaattatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgtttattatggaatatgtacattatttggtaaatatataaacaagagtatcacccatatgccttccactttaagataattattgctagattaacatgttagtgtcctttgatctgaaatgacttatccatccatgtgtgcctgtgcgtgcacacacacacacgcccaaataatggtttcatttttaagtattttattacatttaattaaattatgagatatacagttaaaacatttaatattcattgtagaaaatagaagtagaaagaaggaaggattttaaatgtcctcccagagattaccgtttcagtgatactagtaatttctgaatttcacctatatcatattgctcaaattctacattcatcatctggtaatactgattttggtcactgtttatctcatagatagctgctcacatgtttttgaattgaacaaagtttgaatttggcttatatctgaccaccacctccctctcatgtaattgttagtcatttcaaattttgcagttccccaaaggtgcagtgtgttcttttatatatctgtgtctttgcatataccgttctgcttacctgaaaaaacccctccacaaacacctattgtcccttacccactctctgcctttgtctacctaatcttcaagattcagctcaagctgagctagaattaaagtcttccctgatctttatctttgctctcttaaactagtcagaggatctgtacccagagcatgcatggaattctgtgccctgtaaaattgacatgaagaaaaggagtattcattttcgtacttgattctttaacaaaaaattcctgattgggtctaactttttacgtgtgttggattagatggtcatatacagaagggaaagaatagcaatataagtcttctcacgtctgtaatcccagcactttgggaggccaaggagggcagatcacaaagtcaggagattgagaccatcctggctaatgcggtgaaaccccgtctttactaaaaatacaaaaattagccgggcgtggtggtgggcgcctgtagtcccagctcctcgggaggctgaggcaggagaatggcatgaacccgggaggcagagcttgcagtgagccgagatcgcgccactacactccagcctgggcgacagagcgagactgcctcaaaaaaaaaaaaaaaaaaaaaaaaaaaagtcttctcattagcaatataagtaatctaattttatgtttttatgtctcacacatacacatacatatatactacattgtgtcaaattagtaagtacaaaacttttgtgtatgaatttcagttttctatttaaaagaaagtacataattagttttaccaaaatatagttgctactgttcattgtagtttctaccctttatatgagccattgtttgggggagtacttgttttgttactggtaataaactacaagggaaatttgtaatataatattagtatatttcccctagatttttaaaaagcaggtcattatttttttaagcacttcaactgcagcacagtgcaatcttttggggagaattggtaaaatgaggataaaattagtacaggattccagcagcttgaaaataacacaatatttgaccaaaatctcttttgtattccctactctggttcaattccagtagtcctggaaatgtgcctatggactatttacagtgagattataaaactgaatcatgattttggtgaatagaagccagagcatgtggctacagcaccccagctggcagtaagctctccctaggtttatgaatgtagttagatggtccccaactgtttacaagacagcagaggtgagatatttgattgacaagtcagaaatgcattagatcattctctctgccagtctctggttcatgctgttaaaaatgtcagcctccaagtttgaatggcagcctgagggccttagaagctttttgttttctgagatggaaacacaaattggatgtgtgcctgagcgcttcatcctgggctgtaatttcatcttttagctaagaaccacaaggtacacgagcaaagcaccctgtaaacaataatactgtggaaaaaaaataaacaaggtcgtgtttctggtacgttgatccgatggtgtcctgacctctatcacgttgaacatctccactctgattgctgttccctttggcattacaatgagagaaagagagactgacatactatgaagaaaagatttaaagttgcagtatcgttgcacattccttgtattggctatgaaatattgaactgtcagaatgtgacacttggttttttaagcaacctttcttgtttgaggtgtttgcagttcattcctttctcccccatttgtctgctttcattgatagggttggaagtagttgccttaaatgcatgaaaagggacagtgttaaagagaagtggtgctgatggagccaaacaaacttaacactagaaaataaatgcaggctgtggggcaaaggagataaagttgggttagtgtattattaatagtggaatttatggaacaccctattgtaaggaagaatcaggttaggtcccatttctgtttttgtggaggcaggaagttgggaaggtggtattgggtaaagagatgcagtgacatagtttgttaaactgatagcctactatatggcagtattgccaggccaatcagaattcacccagctattttatttattgctcttattatccagtgtctttaacaagtggtgaaattatagaagactttaaaatttggggaagaaaaatatttttttaatgtggaaaatgtgtatttatagtaagaaagctcattaggtaatatggaagaaacattatgcttatattagtccagcttatgccaaatgaatagaaaatcttccttataaaaccaccatatatttcttggaaaatattttgtagtaataaaatgagttttctattatgttttaaattacatcttttttttcaagctatgagtaggagtttataaattacaatacatcttaaaacaacatatatattttttcttctaaggaagcactattgatgtatgctttcattttcatcccttttggggcattgaatttacaagtaaagttttaactgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcgcttaagccttggaggtggtggttgcagtgagccgaaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgtgctcagaaagtaataccaaaaggagggatattaagaactagttattgttgtttttaagtattgctctgaatttttaaagcataaacattgatgtagatttgcatttaagctatgagaacccactgtcttgactcagtgggggagttttcaaaaatcattcttgtagaaattgatttctcattggctgatttctacaggatgaatgaaaacaaaccattttttgcagtcttagaagaataagaggaatgcaagtgtttaagaaatgagactgaaatatgctttatggagttttctaaatctggtacaaagaaactacaaaatttcttcttatgtattatgcatcaatacagtgaaaatgcctcacagcttatgggctttttacaaccacaccttcacaattaatgattagctttattatttaaactccaggcttgcctcatgagcaaacatcagtgtattcatagaaccatagaatttcagcattggaccagacatcagaggccatctagtcacatacgtctcataatgtagaaatcctttatgaaatgtgtttggaagggagtcatctaatctctccctgatcactaccattattggtgaatcaaacttcttgaagcatcttgcttttactttgttggttctactagaaagttttttcttggccgggcgtggtggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtcagccgagatcacacccactgcactgcagcctgggtgacagagtgagactgtctcaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccagggaagagaaaatacagcgtgacctcagtctaaccccatccagtttagttcagaaggtcccaggatgtaattttgtaattctaaattgaaaaggaaagaatgtgataaatttctgtattaaaaattaagatatattttattaggcataaagtttttaagtactaagttacaaatattcaactgaattaaaaatttcctttaactggtgaaaaaaaatcgagttggtgggtcatcttttttctcattttgtccttcagtgacataaacgtaaaaaggaattaacgtttttgaaatgtcttagcatcatagaaaggataaatgatacagggcttgttcatatttttaaatacaatttttttcctggttgttagaaataaggtgttaccagattttgcttgtatgtgattatgcttatattaattatagcagtatcaaagtaagttgtacagatctcacttgctcttttttttttttttttttttgagacggagtctcgctctgtcacccagggtggtgccatctcggctcactgcaagctctgcctctcgggttcacaccattcccctgcctcagcctctcgagtagctgggactacaggcacccgccaccatgcccggctaatttttttgtatttttagtagagacggggtttcaccatgttagccaggatggtctggatctcctgacctcgtgatccgcctgcctcggcctcccaaagtgctgggattacgagcatgagccaccgtgcctggcctctgttgttctacttaatagtttaaaaattaagtttaccacaaatttgggcaagttttaaaccctcctaagtgaagtcagttattttgttcctttaaaagaaaaaaagaatcttagtcacaatttactgatttttgtaaaacatgcaaatgtagtcctgcgcaacattaaaagcaaataaatacactgaggacaactcaacatgaaatatattttgattcagtttaactctaggcattctaacttgtaaaaatggcccttaacagaaaaatacatatgtataatcacttgatttatagaatgtgtatgtgtgcatacaaaaccacttcagtaaaagtgctgttggttaccattctgagcatttaaaacgatcactttccatttgatcatattaaagatatagaaacaagtatatagcatagaaaagttttaatttcttctatgtaatcttcattattaaaatatgtttgaatatgccattattttgtaggctaatttgttcttcattgtgagattgaggtacttagatttcttgtatgaatagctctcactaaaatgactataatttgtactttttatattgtccttagggacattttactgatttagaaaatccttttgacatcaagtagatgtaaggctttacaaataacatggccattcacaactagccacaactccgattcgattcacagagtaccttttatttgccaattactgtacaaagtcttaggcataaattaagattcagaacctatcctcaaggagcttatagttatttgttatacatgtattaagtacttatataccagtcactgtgcatataattactagtgttaaccattagtcatatgtatttttttctgatttattgagctagaggtctggcttagtagcagtcctaaggaaatggtatacttatgttcatatcagatatatctcatctcagcaaaaaagtgataatgtatatttcagactagtctgtgtcttaaatggttttctcttgcctttacataccttctaagggaacagtgatgtttgtgatagctgtacatgtagcttaaaaagagatgataatatttgttacaatgcctcctactggttgatcatagattttcaatccttgttgtcttcagaactggtagttcccactggtgatttgatagtttggggcttctactgaggctataactgagaaagagtctattgcatacaaggtataaagtgcttctttaaacagtctgtttctagaacctaaattgtcctgggaccagctcttgatataaaaattcatagaaacctgtttttcacagagtgtggtaactccttgccatagtgctgtagtgttaaaattcacattggccaggttgttctgtaaattaaacactgacagctaccctcaggggaacagccaatgtatttatgatgatgtgctgattacacaaaatacactgcaagcagaaaacagctgcagagaataaacctcttaaaaagaatacaattacaaatagcaccctcagtatttctagtggtgagtgtagaatacagcatgctaatgcaagtttcttactagtccgcctgaaaacaaaaaatctgaaggagataaattatggttgaatgcacatgcggtgccagcatagcagtgaacaaatttcctttctcaagagcatggctgtaagtgcacagatttcaggtgtggagtagtctaaccaccctccctcattttgttaggttttattagtggttttctcatatatagtagggcatggccttgaggttataggggctctagacatttgaaagatattacacaatgaatggggcaggagggtaactaaattgtggttacaaatttctggtagaaactcgatatgttagggtttagttatcgacatttcatttgaagatacgactatatattttcagtgttattaatggcattgaagatggtgcccttggaattaataaaaggagtcatgactctctggtaagatctttctgatttcttagattctgtttttcaagaataatggtgttttaggacattggaatagctgattgtatatttgtaggagtatcagctctcaaatatgtcccttttcattcctgcatcttactggtcacatgcatacaggtaagaagattagaaaaaaaattttgttttccctatttgagattctctctgttagagcttagggtcagtatctataaaatatatttcaactgctgagcatgctagcttctgtttaaatcagtagaaaatatgttgatctttcaagacataaatttactcaagccaactgtaaggtatagcgcagggacatagtgattggagacagttcacttcacccgcctgaaactaagaatcaactcttcagtgtatggatcactggtatgtaataatcgactattatcggtctgtctattggtctctttttaaatcagtttggaacctcctggagttattttcttgctctactgacatcaatcccatgtggcagaggagttgtgtataatcgctttggtttaatcaatagaataattgataaaccagataagatttaaactgattatagccccagcagaattccccagaggccttggactctcttaattttgacatgtgtgttgtgtaccctgaggatgaagtgcagtttgaattatctgcttttatttgcttaatgacggggagggtgttaaagtcaaatgtttaattaacccagcaatgggctgcgttgtcacttacacacagctgattgagatatctcatggagaatactgaataggaatgataatgtggcactgggacggaagattgctttttcaatccatttgctgggtcactgctttgaatgtcttattggatgaaaggcattcagcctggagaaaaaattcagcatttaagtacattttgttctcttccccccccacccccccaaccccctccgtgctcagaagttaactaaaacagatatgttctaggtttattaagccatccatgtactagtaagagatcaggatagccagtagcctcaagctacataatttcctgtggaaacggaaaaatcctactagcctctaaggtattctaaatgtgagctcttttgtccctcacatcctgtgtcccttgccattattgtgaggttgtctttggttacttgtctcttgcctttttctgtagtgtttgctagatgtgcagctacctctagggccaaaggcagaccttttcctcccaaagaagcaaattatccagtacattttttgctatttgatatacctggcttctatttggttgtaattgtgactaagaattataatgagactgttgaactattcagagagatgaaaatttgaggcattacaaattcttgcttttttggctactgctattgtaaaaacagttgatgctgtgtatatttcattttgttgagaggcactttgctttctatatggactaaaaaattaggccaggaaagattgcaatattcaacaccatcaaaaatgaagtctaggcaactggagttttaatgacttgctgcccacaaaatatccctgactagctttataatggaatgtaaaaactcattgaaggcatatgagcaaaactttaaaaaaaattaaccatgactttccttctctgtagttcttatgtttcttccctctatcccccaaagatctaaaccaggaatttactaatttttttctttgctttagtcatttgtattccagagagcacaatagggagaaggatacaagattgatttttttatgtgtgtcctcttgaaagcagagtctggggcatgaatactgtggggggtggtgggggggccggttacaaagcaatagaagcatgcagctagtgttcgcgtgcaggttggactttttgcgggtcaaggcagaccagacgagtagcttatcttgagggacgcaagtaatagaccaaatatagagcagctatttcaggaatcatgtaggtcatttaattatccattatgattgagtggctaatgctcttttggcaattacatgacctctgttattcttgaaacctatccaggccctcgtgggtcaagtgacccacaagtcagtgctctcagacttgattccactcagaaagaaaggagatgttgggaaccactggcatttagaaatggccatgttttctttactgaccactacccagaatgtcctttgtacagcagtgataggcaactggttttgaagtcaactattccttcattgtatataggagcaaaagatgcattatacattggtttccacaagagggtattttggcaggagatactttaataccacaattagctattatggtattcactaattctgtactgtaagaacaactactatgatattaaaattaatgtttgatatctgtcaaaccaattatctattaccaaactctgtagtggtattttccattccataacgcaacaagtgctattgatgatagctaataacagatattagtatattattaattactaatagtaattatagtaacagattagtaataataacaaaatgccattgatgatagctaataacagattttaaaatatcattcattaaaattagcctaatttgaatttcagtgctacaacgattattaaattaaaaggccactttaaaattaggttctggtcaaagacagaataagttggaaacatcttgattgtttatcactttttttctttaatcaaccaagtattattaatatttccaaaaaaaaccaatttctgctaaatgatagtaaaattttctataattcagtgacttgtggggtaattttgagaacagaaaatgtacatttcttgtgattctttaaatcgaagatagttacggtgtggaaagcaatggcagcataatcaaattaattgtaggatttgtcagaaatgcacaaaattctgcatagttagcaaagtggtagattagaggtatacagccattctctagcattccagtaacttaagaccttaggcttaagagaaataattttggtattctttaagtagaaactatttgcattgctatagaaaaaggcagttccttctattggagaaaaaacatcttttaaaaatttgttacttacacatcaaagagcattgctttaaaacaacaacaacaacaaaaactcaacaaggttgtttatccctggagcagtaaaattagccatccttcccaataaatttattaaattacccctggtagaactccaagctaatctgttttggttttattttcattttgttgtttggtgatgttaacaaatgaaaaattgaagacatgaattggtgtgtataacctttgacccttcagaaatagaagacttctcactcaaattttaaatccttaagccaatactaccttagggtctggctacttagagacccatgagaatgcagttaatctgagttatatttgctgttttctgtttaaaaacatattttctctcattctagttttttcatttctgtggtggagatgaacagaaaatggaaagcaggatttacagcagaagttacagattaaactcaagtatcccaaataaggagtataattagtctgcttaccattttaagaggaaagcaagggatataatgtatggtgtataattttttttttctccctatatattacttttctttaaggcatacccttcaatatctatgctgagacatgtttttcagccttgggaaccaaaaatttatagaaataagtgagaggaatggtatttgtaattttaaagacccgaagagacattaaggcagtatcattagttgggaaggacacagtataataataagcctatataataatttcttaattaggaaaaaaaataatgattaaacaagaccagtccatattagagacatacacctaaacacagatcttaatctagcccagtctagctttcagaaatgtagtttatttacttgggatggttttacgtctcgggatattagcttttatcaagtttaaaggaatcttaaatttctttcaagatattgttgaattgtaataaaatggtaataccaaagcaaggaagatatccaaggggatgaaagtcatttagcaaaaagaaacaaaaaaccaggaaacaaggatgacagaaaaaaaaaattcatcagagagaaagaattttgtcatacgtcctaagggttctatagttctcagtcctattttgataaaaaaactacttaagaaaatctacagaggtcgagttacaaaaataaccagatgtccttattagtggaagcaaatgtttgcctcttaatttacacaaaactatatgcagaggatctctggatgaaatatttttgtaaatatggcagcaaagaaaatcatggcacaaaaaaatctgtccaaaacacataatcgtgaaggtaatgtcttaaagaggaaagcagttttttaaaagattcctatagatttaaaggtaaaaggtaagttaagctagttatattttggtttacatgatacgtattcttggctttttattatgtatgtctttctatctgaaatccccctggtgaattttaattcattttgccttgcgtatttctctactttgtacattgttgttgcattttgaacagtgtaaacgtatgtgtggattgcttttttttttccctgaaagaatggttgtccttttagttccatcacgaaaaacacaacctacagtggtataagatgcctgctttgcaagcctgtttgggattttaaaatattaacccacattttaataagtagatgtagttttgtaattgcattcgtacattaagcaggataaaaatgtaaaaaaaaaaaactacttgaaagggtaaggtaggaagtgtttttttttgtttgtttttaaattaaggctttagagccaaaaaaaaaaacctgtaaagtttaaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgatattttcggtgacttgaaagttaagagaaagcagcactgctcattcatgcccttgccttgtcactccctggtgcagttcatctcttctatccttcttatcagagtatctcagtgcttagttgagcttgtttatcttaaaagagcaggaggcaggcttttagggaataagctacatgttccagtataacaggcaccaatgctgtttgacttgaaaaacatttgatctcttacattaacagcccatgtcactgtaataggtagtacagccgagttgttcagttttctattattttagctttgaaataactgttagtgctgccccaaaatcttcgtgtataaaattgtatattggctgccccccaggactcgtaagtaaacaaggtgatatgtgtggccagaggggagggtatttgttggctttgttttagataataactgatcctatctaaagatgttttctgtctgatccctgatagtgggtgctgcatgacgttgtgtaaattcgcagacctagcaatattttaaggcagatttctgtttgttattaatatatgtgctcagtaactattaattatgaactttcatttttttctctgataatgaaacatttagtttttatgaagcttaatgtcaaagatcctgcacaatttgcctaagtatagcagtttgcacagcagtttttgaaaatgggcaagcaagaatttaaagggaatgtttgttagacttaaaatattactttatttaaaaataattcagttgtgggtataatttctgtgccaggaatagtttgacagttgtaatcaggtagcagtattaaaagaacagaaaacaaaattcgtataatcaggttgatgttttcttcctctttaagagcacttctccttttaatagtggtagaatggcagcaaataattttaatccttcctttcttccttcctctattttcaagaatctgatttttctcattcttatttttttctgttacagcattaccaggccacccagttactttcttagaatttaacctaaattagatacatcagccagaacaagcataattggttgaaaggcagccatctatctagggagttcttctaaatactgaatgtgtcatgcgctttgacataacatatctgtaatctctgaatacagaaagcactttctgtgttagctgtaggtgttaaagcagtagtgtgttttaagaatgtgtgctgtgcaaattctggcttgtgaggtaatgacaagtgtttgcctgcatagacaatatattttttcccccctgaggtccccacacacctagtttccctcaagctcatcatctctgtcaggttaatcaataggcaccgtatggcagagggtcagtaatcagtgtcatcgtgcctttaaatcgtgttgaaaatttgcttaaagcctgggccaattaacatcgagatgatgaatggatgggaagatgggaagagcctgccgctcaggggctttgtgaggaggagatgctcagctgttgagcagcagacaccagcgaataaaatcagccattcatgtgagctcagtccacccactcttaatgataatgtcaatctagcaaaatatatacacattggagttgtcacgagttcataaatcaaaggagtttgtcaaaggcattcagattaacgaggcagcagcaataacaagtcaaatttgcatagagaattgctcgaatctcagtaaattatgatcctgtttttcatttgattatttgctaatgtctcaagagggagaatgattatattagcatgcaaaatctactccagaagtagaaatctgaggtgtagaagaccagtgcactatgacaattaatcagtttctgcatactagcataaatgcacaaggcccagaaatgaacttcttttttattattatttctctttgctactgatccaaatggttcagcttgacagagactttatattgctttaacagtgttctgaattgtgcctgcaggcaagacatagttatgcagctataaccaacctatccatctgccaaccagattggaattctcctatccaaggcttccattaacccccactgacagctccaaacaggattaagaatttggaagcataaaaaatagttgttctttgcaaatatacacaatccctctgcattttgagaaaggatgcatctgtagtgttatatgattagtgtcggacagtgtggcggggagaaagcctgcttggcagttttttgacttctgtcacagggagtaaggcagtgctaatggaagtcctctttggttgtcccagagaatgttgtccattctatctagttgttagcactgtgcttggaattggtatattactagaaaagagcactccttgaaagccttaactggtgaatctgttgagtttagcagtatagggaggccttgatgtggttgtggtttaatagagtatgtcaaatgataaacatgctggagaagcaatgtgcatgaaaacatgccagagaatatcttaggaggacactttaggtcctccctaaaatgagtccttgaataggattttccgaacagcttctgaacttaaatgacctaagttttccccattgtatcctaaaaggattaattaaaatttgtttaaacacacacacagtgtttttttttaatgtcacctttcatacaagagtttgagtgattttgtccatgtagctaaaatatctgttaaccttgtaaaataataatttctgtttttgtaaattgtaaatttatatttggaagctaaattagctccaagtcacataataagttaatgggaaaaagtattaatccaattactaatttaccattgaagttcactatactgtgtttgcaattagttactagaaatcggtctcaggattttttccttcaggtgggttgtcattctatacgatgatgagcagatgatttcatttttaaaatgtgttcaaaatcagttataatccaccacaatttacctgctttgctaaaatgatagaattatcccagttacagagtccttcaaatcctccaatggtaaattagtgaagtatgtggcattggtgtgaaatgttcgcttgtagctttggagctggttattttatttataacagatgtctcttcaaacaggttcaggctctgttgcaccatccaaccttgagcaagatgcttactcaaagattattgtaagtcattatgagtggcttgacttttcatcactgtgtaaattagtttaattttttatttgattatataatcaactcttaattatccattttatcaggagttgtgtgttcaaatagataactgaaaatagtaaataagccacttactaggtcatggggaatattgccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatcaagattaaaatttagttagggaatttccagtagagtaaggtggagtagttttatggtttcttggagaagatgacagttaaacctcattttaagaatgtgtaagacttgaatagatgagataatcttgtgtttataattgttgagtgaactagactggagttaagaatccttccaggccagactctgtggctcatgcctgtaatcccagcactttgggaaacggaggtgggaggattgcttgaggctgtgagtttgagaccagctgggtaatatagtgagaacccctgtatctacaaaaaaacagaaaaattagcctggtgtagtggcgtatacctgtagtcttagctagtagggagcctgaggcaggaggattacttgagcccaggagttggaggttacaaggagctatgatcatgtcattacactccagcctgatgtgatagagcaagaccctgtctttaaaaaacaatcctttcaaccccgaaatttcaagatcatatcacctgttggtgagactatgaagaaacttgcttaactggggcagaaaagatgtgttgtgggaaataacttggtgtaatatagtagggaattctggatggtcctgaaaaccaggcctagaacttcatatttgatttcatagaaataaagagccactaaaaatattttagggaaagaccattacgacagtagcagtgttaagaaagattaacctggcaataatattcaatccaagaaactttttttttttttttctttgagacagggtctcactctgtcgcccaggctagagcacaatggcatgattacaccccaaactcctgggcttaagcgatcctcccgccttagcctcctgagtagctaggacgacaagcatgtgccactatgcccagctaattttttttttttttttttatgtagaggtagggtcttgctatgttacccaggctggtcttgaactcctggccccaagcaatcctcctgtctctacctcccgacaagaaaacattttaaaattcacattatattctctagctttgtgctgaacctctgaaatataagatgaaacagaaactggccctgccttgaaggaatttacagtagtgtggggtgggaagcatgttcatgtagagatataaagagatataaagaattaagtgccaattggaagtgaagtttttcttcggagtaattaattctaactgcaggttaggcgtaaggggataaaggcttctcagagaaggtatcattttagctgactcttgaatcaggatttttagtagataaagagattgggaaagaagcctgttacatgttaagggactagaattaacaaaaacacagagatgaaagagtggtttccttattttggtgaatgataaataatgtcatgtaaatggtacagagactttgatgaagtgttaagttggctgtcttatggatgctgtactaagaagtttgggtttatcctgttattgccaaaaagctataaaaggcttttgaacaggaaagtaacctttttagaatgatgattctaatggccgggcatggtggcttacgcctgtaatcccaggactttgggaggccgaggtgggtggatcacttgaggttaggagttcgaggctagcctggccaacatggtgaaactctgtctctactaaaaacacacacacacacacacacacacacacacacacaaaattagctgggcatggtggcgcatgcctgtaatcccagctactcgggaggctgaggcaggagaatcacttgaacccaggaggcagaagttgtaatgagccgaggtcgccactgtcctccagcctgggtgacagaacgagactctgtttcaaaaaaaaaaaaagaatgatgattgccactctagtgtatagaatatatcatttggatttaggcaaggatgtcaatgtcagaaggctgtctcaatagtaatagcactggtaagaggtgttgtgggtctggactagagtagaagcagtggaaatgcaaaagtagggtcagatgtattaaaatagatgattcaaagaaaaagtttatagactgaaaattagctagatatgttcaaagaaaaaaaaggaatgagtaaaaactgactctgaggatttaagtctaggataaaaagaaaagttgggaggaaaagagctgacctagaaatgagtggagatggtaaaagagtgctttaaatttagatgtgttgattttgagacagtttaagcttatcacctgaatacttttttaatataattactttcttttttattcgcccagtttggttgtggaaacattttatccaaaatgcatccctgaggtctaatgcaggagctttagcagtatttcctttattgaccttttcctacccaaatctctgttactgtatctgcaggtgttacagcccaaatgcatctagtttggagttaaattcaaagttgacagggagactttcattctgccctttcaattctaagctagtaagcactgagctaagaaataaatatttgagttaatataaaaggtaacaagttgtgcactgggctaagaaataaatatttgagttaatataaaaggtaacaagttgtgtagaatcttttacaaaaatattttaatatactatagtccccacttattcatagggggtatgttccccagtggatgcctaaaccacagatagttctgaactccatgtatactatgttttttcctatggacacatacctatgataaagtttaatttataaattagtcatagtaagagattaacaacaataagaataaaatagaacagttataactatactgtaataaaagttacatgaatatgctctctcaaaatatcttactgtactgtactcacccttcttatgatgatgtgagacagtaaaatgtctatgtgatgagatgaagtgaggtaaatgacctaggcattgtgacacagcattaggttactactgaccctttgacagcatgctacctgctttaggtgatcctggattattgagccatgaagatgttggtggtgggatgtcaggagcagacaatgtcaatgactcatggtcaagtagcatgtacagtgtggatacactggaccaagggataattcacatcctgggcaggacagagctaccagaaaggtgcacaattgaaaactatttctaaaaatttccattcaatattttaggacctcagttgactgtagtaactgaaattgcgtgagtgaaactgtggataagggaggactactgtaatgctattcatagactattattactcaaggactacaaacacattctgcaatttatttactataatgaaactttccatctgagtattgggaatctgttgttctgagcagtcaagtttgcttagggttggtttaaagttaagcagtagaatataacgttaattacatttgatggaattttccccctaaaatttatttttcacttaacttttctcccatttcttaacattttattatggatttaattaattaattttttattttgacataacttcagatttatagacaagtgaaaagaatagcacaaagaatctccttacaccctttcacatagatttacctaatgttaacatgttaccatatttgtattatatctgcttataaatacatatacacacgcacatacatccatttatgtattattttttctgaacaatttgaaagttacagacgtaatgttccatcccccctaaatgtttcagtgcgtgtttccagaaaaacaaagacattttaataaaaataatcacagtacaaattatcaaaaccaggaaattgaatggataaacaaaactgtggcacatccatacagtagataatactacttggcaataaaaggaaaagaaatactagtatttacaacaacatgagtagatctcagatattttatgctaagtgataaaagccagattcaaaggttacgtacgatataattccatttatatgacattctgaaaatggcacaaattattgagccaacaaatcagtgattttcagtggggagagggttgactattaaggagaatttcaagagaattttgggagtggtggaatttttcattttttaatggcggtgttatacaactgtatgtttttgtcaaaacttacagagctgtataccaaaaagggtaaatttttctgtatgtaaattttaatggtggggaaacaatcaggaaattaatattgatacagtgttattagttcacctacagaacttactaaaaagtttccaattgcctcaacagtgtgtgctatacctctttagtttcctttaatctgaaacaattccttagtctatttcatggccttgacatttcttaggtacaaactagtaactttatggaatgaaatactcatttttgggttagcctgatgttttcttataagtagatttaagttttgtggttttgacaaggatacctcacaagtgatgtgctgttttcagtacatcatattaaaaggcacataatcttaaggtggcatctgctggatttctccactatgaggttactcttttttcattgtaactatcaagtatcttatagaaaaaatattttgagattatgtgaccatcctgttaacttgtcaaactttcactcacttattgtagttttaaattttacttaggtttttgagatggtgtcttgctgtgatgcccagactgctctcaaactcctggactcaggcagtccctctgcctccacctcctgagcagctgggattacacgcatatgccaaagtactaggctcacttgctaattttagcacccaatgatgattcttccttatattaatcacttatccttaaatagaatttattggatataatttagcctgatgatctaggaaaattatgcacatagcttattgggaatcctcatagataaagatgcaaggaataactgtgttgctgagctttcctgggtgatgttggacaggctttgagaactgttgaggtgactacttaggtatacatggctatttcatcattaccccttaccctcaagactgtagacctagtaatctcattcactggcattctgcttctactctttagtattaggagggttcctaatccttgttcctgatatcatgactgtttaatgtccctacctctatttttttgtaacaacattataagttggattttttgtttgatttgatttctcatgatggatggcccagagtaaaagtgttgggttaatctgtattaaaagaacataccaatgtttatgggtttcccccattttttgtttaagagttatttttaacaataccatttaaatattctttgccctagtgggatagaaaggggaaaggaactcctaagaagctctgtgttctatgttaggttagtaacaccctttaagctccctttgtgttttcattctttagacattttcataatacccacccagtggttatccatctaaatctgataaaatagagggtcagtaaaaagaaaattgtgagtatgggctagtcaatactcaggctgttaaggttgagatgactatttttcactttataattcagtatagaggagtttgccagcaattgtgtatcagcccaagtacctgtataataaaaatgtgatttatagtatctttggtatgacaaacttccagcaaaaagtaattaggctccaagttatatgataacatttcaaaaaacataattaattttgaaatacaggatcttacactgaattaaacaggtttagtttatctgatctttttatttatttatttaaaggaggaatttcatgacctgaaagagagttacttgcaaattctaagtttataattggatactggcttaagcttctattatataaggcatttaattttggtatttaaaacattgatctttacatttaaaaaaaaaaagttaaacatacaacttgatgttatggggtaaataaatgttgacctttccctttctttgtttgatactcttacatagcatgtattgccagtcgcctcatttgtcaagctttgtagtcattaattcaattatatccttcctccattttttggtagatgatctccattcctttttttccaaacagggaggaaaagaagttagaactctgaagttcttgagtctctgtccctttctttgtaatatagcatgctttttctttaattttagggacttttacaagggatcatcacaaatgtaaaatatcaagttaaacctcataagatatttctgcccaaaagaaacacattagggtactggcctgtcaggcttactaaaggtgacacacaggtgtcagccacagaggtgaaagggcctcagaatgacacagtacgttttttatctctcagtatctttcaaaatgtaatatctaatagaaaccaaaaaagtgaaatttacatgtaggtttagaacacagtaatgattgtatattaataatttcatgcttgtatgaaaattttcagataaactctcatgttaaaaataatttctgaacctacaaataaactaaccctcctgttagaacgttatgactatatgtaatgtaaggaatatattaactgtaagttttttgttgttgttgttttgagacggaaccttgctctgtcactcaggctggagtgcagtggtgtgatctcggctcactgcaacctcggcctcctgggttcaggcgattctcctgcctcagactctcgagtagctgggattacaggcacccaccaccacacttggctaattttgtatttttagtagagacacagtttcagcatgttggccaggctggtctcaaactcctgacctcagatgatctgcccgccttggcctcccaaagtgctgggattacaagtgtgagccaccgcacctagcacaactgcagggttttaaatattaatgttattaatgttactaatgttgttgctgaaaatggaactcaaataatatgtaatttggattttctgtattttgccttgtagatagtgatttacatatattgactagcagatttttagtacttatgaactcattttcagttggattgttgtttttttccccctcctaagtatataaaaaccccactgacattttagggcctctagctgctgtttgaggtgacagtgccaaggaatggactctaatcctaaactactgagtaaatgtttttttaagtcctatgctacttttatcaaagaaaataaaatcaaatctgagaagagggggaagagaaataactatttttaggacccagacttggagatctgtgccaaccaaacatctactataatcgagagaaggtaataatcatggttttagttgtcatcagctaagtgtgggctggaactttcttgtatccagtgtcaacctgtgtcaaagtgcaagctagagatctaatgaatatgatctcctacacaatgcttaaagatacatgaaatacttcccatctaaatccttacataatttatttatatacatgggcatatgttttcttttacatatgtgtatatctgtatgtatacaaatcttcaagtgaataattgtataaatatatgtatgttctaacttacagaattagaaatgtaattcagtttactcccaaaggataagattgaagataatgagaactgaattaaagcttactttctttcacagaattcctcagagagagaagactgtaataatggcgaaccccctaggaagataataccagagaagaattcacttagacaggtatgaaattcagccttacttaaaataaaaagctaccaacagcaaaacaaaagacaggaggaaacccttgatttgccattctttaagcactggagcttatattaagagtactcggacgttggcctggccatagccatcactttcaatcaggtgacatggttttcccagttatttaaaaaacattctaggtatacatgtacaggacagctggttggcatttttaaaaaagtataaaaacagatctgcctgtaataaagttagcccttttagtatgagcaatattttgtttgctttttctagaagaaaaggccattgttaataataacttaaaaaaacagcagccgggcaaggtggctaacgcctataatcccaccactttgggaggctgaggcaggcgaatacctgaagtcgggagttcgagaccagcctgaccaacatggagaaacccagtctctactaaaaatacaaaaatttgctgggcatgctggcgcatgcctgtaatcccagctactcaggaggctgaggcaggagaatcacttgaaccccagaggcagaggttgcggtgagctgagattgcgccattgcactccagcctgggcaacaagagcaaaactccgtctcaaaaaaaaaaaaaaaaaatagctcaccactgtgccccaatagaaggtaacacattttacttgtgaaagttcaataccattgtgttcttgtaaaaattagaatgtccttggcaaaaacaagaaacgcaagttcttatgatgttgccagagaataagtgtgccacctattcatttttatttttattattttattttatttttatttttgagacaaagcctcactctgtcgcccaggctggagtgcagtggcgtgatctcggctcactgcaacctctgccttctgggttcaagcgattctcctgcctcagcctcctgagtagctggaattacaggtgcctgccaccatgcctggctaatttttgtattttggggtttttttttttttgagacacagtcttgctctatcgcccaggctggagtgcagtggtgtgatcttggctcaccacaacctccacctccagggttcaagcgactcttctgcctcagcctcctgcgtaactgggactacaggtgcccactaccacaccgggctaatttttgtatttttagtagaaacggggtttcaccatgttggccaggctggtcgcaaactcttgaccttgtgatctgcccacctaagcctcccaaagtgctgggattacaggcatgagccactgttcccgacctaatttttgtatttttagtagagacagggtttcaccatgttggccaggctgttctcagacccctgacctcaggtgatctgcccagcttggcctcccaaagtgctgggattacagacatgagccaccacacctggccctgtattcatttttaatataaaattggatacaatgagcctgagcagcagtaaaaataattctaatttacttggatttatagcattgttctaggaaataggagatctaatatttgttgagcacccaccgtgaacatgatgcttatttgatttaaccctcacaataaccctgtaaagtttttagatatgatgtgacttccaatttatagatgaagaaaatggagggttagagaggttagatgacttgtctagctaattagtgatttgatactcagatctcagtgtttccaaagcgtttctacttgtgccttctgacttcagtttatatatagtgtttagagggaaagtacttgaaactgtgacacattcattttttaatttactatatgttaaatgttttttggatgaacacttcttttttttataaaaataattgtttagtaaatagaattgaatcatccaggaagctttaaaaaaaaaaacaaacaaaaatccacaaatgatcagtaattgatgttgagacagttacaattttaactgtttggagaatcaacacctgatctgttcatctaaaccaataggacaatactgaataagataaattgggaagtaggaacactctgcccactatacagaaacaactgtcggaaaacaatgacacaacaaaagttttggcaactttatttaagctaacaaacgaattttctctctgcaaagttataaattaattttaataggctgatccagatggtccatttggaaaatggataggctgatctgttgaaaattaaactaaatttatctctctcatacttcaaactgaagcaagagagagaatcatgcctattaagtccagcacatacagatggaccagcaggtcacacatgggactaatctgattcattttaaaaataaatgcatacattattgaatcattttctacttgcaagatctgttgtgtgcaatattcgaaagagatttaatgttgtttttttcattgccgttttagcaggttctcttccccactccccctgcccactttaatttaacaaccttcccccccaccccccccatggtgctttgaaatgatttttctaatatctgtcattcagtgttgagatccaagctctggagattaattaggtcatgaggctttttctcctcccttctttgtaaagggttttatctccattctctttgtgaagagcatgaactcaatgttcttggaaagagaaatggcctttagaaacagggaagtaggagatcctcctggggccctcagagtcttttagcttctgggtgttttagcagccccatgaatgcagatttgtaaatttattgcagtgccatctggttttttgctcgaaccagattactgttggcttgtgtctgtctattgtggtggtcactccctaggagcttgccctctctatcttagggaagagtgatgaatagcaggggtcaatagaagcgggtcacagggcagctgtccaggactgccctgaacttgattaccccattgctgattttttttaaggtaggacatagtatataagctgtttaaactccctcttttctctattgcatatgacaataatgaagtgccatttgctattttgtttttttgtttttgttttgttttgtttttcctgtagtcaacttctgtagacaaaaagatgtcaaggccgccttatacctagtattgatacaagtaggatttgcatctcattaacttgagattcttttgcagatatttctaatgggatttcagaaactcactattgattataaaaagttcagttatcttctagcaatttaacattgtttttaactaatattatagttgacatatattattcaaaaatagcgttttgccattgttgataggacataactactgcatgttaatttggagagctatttaaatattggaggagcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagatattaccagaacaagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaaaatgtgaagtcaaggaaaggatagccactgttttcctaccttttattcctatctgcaatcaagggcaaaggcctgggaggatacatgaaagtactcattactttttgaaaattgtggcattacaacgttcaactctttgcttctcattggtgctaataggatctgtcagccctgcctttctctgtaattgagtaaattgtgaccgttgtctaatccctctcccatcccccatttcctttgtgtatgtgtccacttaccatcctgagaacgtgggcagtgataaataaagcattgagtagagctctctcaactctctgaaagcagcatgatgccagccctctagttatatttctttaagtgtttaggtttttctgtattctttctcttgtgtagctggaaccctggggatgcaaagccatgagagaggccaagaagctaacaaagtagctgtctcccttgttagcttgttcctttattctttaaaaacaagataaaaaccatctggctcagggcattacattttcctcccccatgcacctctatagatggagacttcacctgcagtgagggtttacattgattagggagggagcagtaattcaagcttccatcctcttcaaggatactttgcagtctttaaaggtgctgacccactgagttagactgtcaagggaggataaaaaagtatcttcatcccaggaggtaacagctgccaggttttcaacaccttgcacgctgctggaaaaatgtcacaattgtcagctgaaagaaaaatgactgtgttgtcatcttctgttaatgactgggccttataaaaggaactacataagtcttttagaaggaataagtagctgttttccttttctaccatattcccctcccctgaaaaaattcctgcgttctaaacattgccttggagtagatccacaaaaaacagcagtgaagaacttaaatcagccagtataagcatggaagtctgatgggcatagctcctttatacagttggatgagtaggaggaaaaagcacatcactgacacagaaaatgacattatagtgtgtattaacaaaacaaccacaacaacaaaaagtcattcataagccagtgaactgagagaaaacatactgtatttctgttctttggaggacaatttattttcaagcagcatccagatgggtaaataccaagacatttcttttttcaagagagctccttttcttcctttaaaaaaaaaaaaaacacagaatttgcttcctttaatagctctgtaatgttcatatatgatggcattcccttctttctgatttgattgatgagggaaaaaggtttaatgaagtccctgatatcaggcaggcagggttttttttttttttttctctctatttgttttaggttagtcactttaattgtattgagtaattagaaggtacacacagccaagggagctttgttctgataattgctcgagaaaacccattccctatctgccgttgctttgtgttaagacacttctccctctagtggcaatagtaagcactttggcttggcagtaggcaaggtgtaattgcaatatgacaaactatgcttaagggactgtcttgtaaatactttcgtttggggtttgcattatttcattatatatgtgtggttggttgttgttggttttttttactctataaaacttgctacctctttttgccctcctaaagtgctttgggctttgggtaaaaaaaaaattgcctgagatgtttattaataaaaaaaatcacaatgcattctgggtaatgttttgcagcttgacttaattttagtcatctgttttaattacctatttataaaaatgcctttgcatttgtagacattatttaatactttggaagaagcacctcatttgaaataaataaataaattgtacttattttaaatagtccatgtaaaagatcttaaaggtaattaatgtaggtctcttaagtaagacaaaagtgatctttccaaatctgacgaagtgatttgtttatataacttcccacttctgttgaatcctttagagtctaataacttttttaagaaaacacggtttggcaatttgtgcctagctacaaaaacccttcttcaaaaaggagcaatttaataaccggctttcttaaaattactttgaggaaggaagaccgtatggggggttggtgctttgttttatttgtattttaatgtaatcattctttgataaattgtgtaatcactgacttagtaggaaaaatattattgaactcctgggttgcaatgaccataaagagtgtattttcatatagagagttgtgatactgggaataaattataaaggaaacagtttatatgctggtcaaagtccatatgggcccaattcattttgttttcagtgcttactctggatgtaccattaaaaaaggcggggggtggggtgggaggaagcctgttgtgctcatctgcatgagccctaaaaaaaaaatctgccctaaaaacaacacggaatgatagcagatgcagctttgcatctattgaacaagattcagtagcatctgtgtggcatttttaaaacccacttccagcttccttagatattgctttttggtttgctttttctataccatattcttgtgtgggacatgatttgatgttaccatgtatctggaagtccctgtcttcctatacccccactcccagtcactaacgattttcattatactatatcttgttatgctatagggctgctgaacagatttctaagcagctttttgcaaggttaaaacaatgcagcccagtaacaagtttgtgtaattttaaatatataccttctagtaaataagggcaagtctggcaatcaatcccttttagtgtgttatatgtttcacctgacaactaaaccttctattgattagccattactttgttagataatcctatgtcattgaatccattgtaaaaaattaaactctttaaaatgttttaccctagcagcagtgtgaaaattgaaaacttgttcagaattacagcctgctttcacaaagaaggtagttttcagcaaggcatcttactagtttatgcttatgtgctttatatgcgatataaaaacgtattaaagtactccaacgcaaaactctctgcctctggttcagcaatgaagctaccttttcaagtgttgcatggggacagaacctatcttgcctgtggctattatattcactagttggatttcaaactggagagagtcttacaggaaaatattgaatggaaaatattgaatgttttagccttttaattgcagagtggtaaaggaactatgacaaattttagtttattgatctgtgttacttccttgggagatcagcaaagtcatttacccattttacagatggaatgtctagaaaataaagtcctatatatagccctactctggaaactccctcaggcctggcacagagtttctgaatctatctaatggtcccctaaatatgttattacatattcattcatgaagggaaaagagggtaattttgaaggaaaataaattttctttttataacttagtattttcagaaaaatagcatgatacatttattgatgactggacaaacctctgtaaaaaatttactcctaagatacttctattggaagttttcatacagtgaattttacagatattaattgtataagtctgaatttttgataaatctaaccacctgtgtaaccaccaccctaattaaactatagaatattttcataacctaggaatgtctcttgttctcctttctacttattttctgcaccaccaatggatcaaatactgatcagcttactgtcactgtaattttgccttttctagaattttgtgtaatggaatgctatatttttggggtctgacattcactttgcataatgtttgtgagattcctctatgttgctgtgtatatcagtagtttattctctttcattgagttgaataaatatatcgcagtttgttttctgtctccttttggtggatatctgagccatttccatcattataagtgaagttactatgaacgttcttctataaaggtttttggtgagcatatgttaagtactttttcatgtgcttattggttattcagacattttctttgtgaagtatcttttaagtttttagccatttttaaaaattgcattgtttgcctttttattattgagttgtagactcaactgtattgaattctggataccattcatttgtcagatatatgtactctgattatatctcacagtctatggtttgcctgtttatggtatgttttgatgagaagtttctaatagttggatgaaatccagtttaccaatttttctttctttttttttttttttttttttgagacggagtctcgctgtgtcgcccaggctggagtgcagtgacacaatctcggctcactgcaacctctgcctcccaggttcaagcaattcttgtgcctcagcctcctgagtagatgggattacaggcatgcgccaccacatgctaatttttgtatttttagtagagacggggtttcaccatgttggctaggctggtctcgaactccagacctcaggtgatccgaccgcctcagcctcccaaagtgctgggattacaggcgcgagccaccgcgcctagccggttttttcttttagaagggatacttcctttggtcctacctaagaaatctttgtctaccccatgattgtgaagatattcttctaagttttcttctgggagctttataagtttactatttatacttaattctatgatccatctcaaattaattcttatacgtgccatgaagtagagtttgggcttcattatttttgccgtaatttcattcagttgtttcagcaccattgttgaaaagactttcttttcccccattgaattacatgaattcatttgtccaaaccatttagttatataagagttatattctcaaacctcctgaagaaaacgttgctgctggacccagagcagtgggtgacagtgcctaaggtactgacccatccctattttatgtccctgtagacaaggcggacaagaaaaatgataggtgtctatccttgcaccaaataccatagtgtcttgattattgtcattttatataatgggccatgaaatcaggtagtgtgagttctctagatttgttgttttattttttgttattccagatagttcacatttctatataaattttagaatcaaccttgcactttctattaaaaagcagtctgtgaggggctgggtgtggtggctccctcctgtaatcccaacactttgggaggccgaagtgggaggatcgctggagcccactgagttggaggctacagtgagttatgatcacaccactgcactccagcctgggcaacagaaagagaaactatctccaaaaatagacagacagatagataactactttttttttcatctgagatatataggattttgcccccgttattctgttaatacgacaaattaccttgatttttgttaagagtttttgtgtctgtttcatgtgaggtactggtttgcagttttcttttttaagtgtttgccaggttttggtatcagagttatgctggtcttataaaatgaattgggaaatcttcctcccatcctcctctgttttctaaaagcacttgtgtataatcctggtggtgtttcttccttcagatttcatagaattcacaaaccacttgggcctgtagttttctttgtgaaagattttttaaacttattatttaaatttatgtggcaagatgttttagagcaatttgaatttcttttagaggtatagagctgttcagattttctgtttcatgtgtcaattttggtaatttgtgtttttgaagaaatgtttcctgtttattcaacagattataatatgttaatatcttttattttaatactgtgattgtttcatattgggctactgaaagcctctttcggcaggcttccatgccccctttgacgtatcttcatcgttctgagtatttccatcttatagtttccctggtcagtcctggagtcaaccatatttccatgaatgtatgattccctttagtgcagaatggtatttaaaaaccaagattcaaacactgacttttcttttacatctatatttatatactttgaaaccattagttcacattgataactccaattctaattcaaccccacagggtttgttctagatttctttctttccatatttcatttttctcccttccttccttccttccccttccttcctttttcttttcttttcttttcctctcttctcttctcttctcttctcttctcttctcttctcttctcttctctctcttctttctttcttgtttttggtagagatggggtctctccctatgttgtccaggctggtcttgaattccagagctcaagcaatcctcctgcattggcttcccaaaatgttgggattataggcatgagccaccccacccctttcctaacataggaaacctggtttaagatttttttcctttcagcactttaaaaatattgttcccagctgggcgtggtggctcatgcctataatcccagcactttgggaggccaaggttgggtggatcacctgaggtcaggagttcgagaccagcctggccaatatggtgaaaccctgtctctactaaaaatacaaaaattatctgggcatggtggcgcacacctgtagtcccagctacttgggaggctgaggcaggagaattgcttgaacccgggagacggaggttgcggtgaaataaaaatattattcgcttgtctcctagccttcatttttttatgaaaagcctgacattatttatatcgttactcctagatacctaacatcccctttttccttggctccgttcaaggttttatctttatcactcgttttcagcagttctgactgtgatgggcctatatgtgttgttttctttgtatttttaacatgactggggtttgctgatctgaaatcagaaagccgctagttttcacaaaatttggggaagtatttgatcactatttttataacttctttgctgtaccgttctcttctcccttccttggactccagccacgcatatattctagataatccagaattgtcccacacagtgactaagaccgatcttttttttttcttttcttaatctcctttttttctctctgttcttcagtttatatgatttcagtttatctatctttttttttttcggtttatctgtcttcattgaccttttcttctgtcacttccagtctgctttttaagcctctccagtaaattttttgatttttttgagatagggtctcactctgttgctcaggctgaagtgcagtggcatgaacatggctcactgcagccttgaccttctgggctcaagcaaccgcccaccccagcctcctgagtagctgggactacaggtgtgcaccactatacccaactaatttttcttttttctctttttttttttttttttttttttgagacagaatctcaatctgttgcccaggctggagaacagtggtgcaatctcagcttactgcaacctccgtctcccgggttcaagcgattctcctccctctgcctcccaagtagctgggattacaggcacttgccaccatgcccagctaatttttgtatttttggtagagatggggtttcaccatgtttgctaggctggtctcaaactcctgacctcaggtgatctgcccgcctcggcctccaaagtgctaggtgtaagtcactgggcctggccaattttttctattttttgtagagacaggatctcactacgttgcccaggctggtcctgaactcctgagctcaagctatcctcctgcctcggcttcccaaagtgctgggattacaggcatgagccaccatgcgcagcctgaatttttcatttcagataatgcacttttcagttctagaatttctatttagtttatttttggtttttcattttctggtagaatttttcatctgtttattcattgtgatcatatcttttattgctatgttcaagtttgaacatatctattatagcttctttagagctataatatgtgctaatttctacaactaggtcttctcagggttggtttttggttcatttttctcttgacaatggatcccatttatctcctttttctcatttttagtaatttttgatcatataaccaacattataaatggtacattgcagaaactctgaattcattttttcttcctctgattaaattactggctgatcactatgaccttgtggaggcttggttttgtatttgttaaggtcaggtgtattttggttttgcccttagtcctaagacatactcttgaatctaaactcatggtctctttgaatttttaatggaaagcctaagatgttattacatccctctaacttgatagaagtcaaactctaaactctttctccccccatgagcagcagctggaatatctgcacaggcctttcaaccctccagctgttgctctccattgaaatccttggaatctccccttcatgtacgtagtttgggtgttagccatagatttgaggggaatttatatgtaattttttagtcttcctccttcccctgtggttctctttcatttctgggatttctgttctctattgccagccactatggcagttttgaactcttatcacttgatatctcaagccaatagactgtggctttcagattgaattctagtcaccctgcaccaagtggactcgtgagtgccttcaggggaaaagcacataaacacacatctcacccagtgtggttctcttctttcaagatcaggccactccttccccattttccgtcttttttaagtcgatctccagtgcctttatgtagctttaaaatgtttttcctatctgcaagagggtttatctgatacaaacatttctgccattactggaagcggaactctttgagtcaagttatatttttttcagcaaatactgattacttcataaatttatctttaaaacatagtgaattttattttaaaaatatttatgtttgtgtgtgtatgaatagtaaatgtttgtggaattagacaacgcaaaagaaataacaaatctagagcccagaatttacatgcaccaatatttaaatctgtacactaatttctaatgctctattttttcatatatattttgaaataatttttacttaaattataagaataaaacaagttggtaaattttttaaggtttagcctgtttaaaagaaaaacagctgggcgtggtggctcacgcctgcaatcccagcactttgggaggccaaggcaggtggatcaattaaggtcaggagttcaagaccagcctggccaacatggtaaaaccctgtctctactaaaaatacaaaaattagccggccgtggtggcacatgtctgtaatcccagctacttggtaggctgaggcaggagaatcactcgaacctgggaggtgcaggttacagtgagccgagattgcaccactgtactccagcctgggagacagagtgagactccgtctcaaaacaaaaacaaaaacaaaaacagaactgactttataatatcgatggggagttatatatctctactattttccccattttttcttaaattttatctattttctttccaaagaatgatagttgaccaaaatcagattctttaaaatatctcttcatgctgatataaacaaatgagtaaataaataaatgaggggtgaaatcacatcttttccttacagaagaattccagttaatgtggaaggaaagacaaaaataataaattcactattagaatacacagtaaaaattaccataggcatgattagcacccaatggatgctaaaattagcaagctgagatgcaagtagaaacagaatatttgcatagtctccaagtattttgccatatatatatatatatatatatatatatatattcagtaattcctaaggggaaaataatgtttatactggagaatcttggcagacatgtccttagctgtataatcaaggctaacatcaccagaaataccagcataccttctgatttgatgcagtgagaggggcacatcacctctaaagtatctttccccaaaataacctcaatctgatcatgagaaaatatcagacaaacccaacttgaggcacagtctgtagattaactgatcagtgctgtttagcagtgtcagtcatgaaagacaaggaaagactgagggattgttgaaaataagaggagccctaagagacatgacaaataaatgccatgtgggatcctagattagatgctgaacagaaaaaggacattagtggaaaaactggtgaaacctgagtaagttctgtactttatatagtaccaagttaatttcttagtttcgataaatgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtagccctcctgcctctacctcccaaagtgctgggattataggcatgagccactgtgcttgaactttactatttttgtacttgttctataaatctaaaattatctcaaaatgttaaaaaattgaattctttgttactgttggttttgagtgtcttaagatttttcttcttaaatccaacacaagtatttatagcaatggttctcgaagagtgttcctggatcagcagcactaacgtcaactggggccttgttaaaaatgcaaatgttcagaagctctggggatggaaacctagcaatctgtgtttgttttgttttgagacagagtcttgctctgtcacccacgctggagtgccgtggcacgatctaggcttactgcagcctctgcctcccgggttcaagcgattcttctgcctcagcctcccgagtagctgggattacaggcatgcaccaccacgcctggctaaatttttttatttttttattttctttttttgtatttttagtagagacggggtttcaccatgttggtcaggctggtctcaaacttctgatctcaagtgatcctcctgccttcgccccccaaagtgctgggattacaggtgttagccaccaggccccaccgtgatctgtgttttaacaagccctccttccagatgattctgatgcgcactaaagtttgataaacataatttataccatcagtaaaaacttaagactaaaaggaaacatttctattaatatattgtccagtaattaataagtttgcttttcataaagtataactatagtattaccaatgttttgttttgtttttggtagagacagggcctcgctgtgctgcccaggctgatctcaaactcctaggctcaagtgattcccctgcctcggcctcccaaagtgctgggatcacaggcatgagccactgtgcccagctatcaccagtttttaaaatccatttcctatgatttttttctttcttttttatttggagacaatgtcttgctctgttgcccaggctggagtgcagtggcgtgatctcagctcactacaacctccatctcctgggctcaagcgattctcgtccctcagcctcctgagtagctggaactacaggcacccaccaccatgcctggctaatattttgtattttagtagagacagggtttcaccatgttgcccagggtggcctcaaactcctgagctcaggcgatcttcccacctcggcttcccaaagtgttaggattacaggtatgagccaccgcacctggcctgatttttctattttatctcttcaacattaccagatgtacttaagggataacttctaaggtctagataggcccagtgaggctgctcttgcctgtaatcccagcactttgggaggccgaggcgggtgggtcacctgaggtcagtagttcaagaccagcctggccaacatgatgaaaccccatctctactaaaaatacaaaaaattagctgggcatggtggcaggcgcctgtaagcccagctactcgggagactcaggtgggagaatcacttgaacctgggaggcggaggttgtagtgagccgagattgtgccactgcactccagcctgggcagcagagcaagactccatctcaaaaaaaaaaaaaataggtaagtgttggtttatcttttttcaatgttctttcaattttggtttatttctcttttctttttaaagccaaaagtcaaagcttgtattgagattcttttataaaaatatttcatgattagttttaaaataattttttttttctggatggtttaaaattttttcatttattgttctgaataagaaacatgtcagctgagcacaatggctcgtccctgtaatcccagcacattagaaggctgaggcaggaggatcacttgagctcaggagttcaagaccagtttaggcaacatggcaaaaccccatctctacaaaaaatacaaaaaattagctgggcgtggtagcgtgcccctgtagtcccccacctactctggaggatcacttgagtcccagaggcatagattgcagagagccaagatctcaccactgtacttccagctggggtgacagagtaagaccctatctcaaaaaaaaaaaaaaagaaaagaaaaaaagagaaagaaacatgtcctctgtgggaggctgaggcaggagaatcgcttgaaccccggaggcggaggttgcagtgagccgagatcacgccactgcaccccagcctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatacttgttcatgggcacatcagtggcttttgtagcctctatctttgccctcctccttttctaacttacctctcagttcccataagtcttaacttatagataaaatctatttgtgttttgacttgagaaatagagcagaatttgaaaacaggatatggcagtatttcaatattttaaaaacctgtttccaacaaattctctttacagacatacaacagctgtgccagactctgcttaaaccaagaaacagtatgtttagcaagcactgctatgaagactgagaattgtgtggccaaagtaagtaatattgctcatcaatgtatattacaccacaccataacagtgccatatctgtaggcatctttactcagtattgcttaaggattattacaggattatatagttaagaaaaaaatacaaacaggcatcattttatctagaacagattgcaagttagattctccacctcttaattgcaacagaatgttttgcttatgaattctggtcactctttagactgattcacatttgtttcttgacactagttgtagattatcacatatcagtaggatttgtataagataatgtacaattgttttgataagtttatggtttttaaatacagttacgtatagagtacatcacatcattgcaaggactgtgaaatatgctatagacaacccaattattatatcactattattatttattgagtggctaatgttggaaatactgcttttgttgatcttgatccacatggacaagtatgtttagtcatgtgtatgggctacctctttttcatgtatatatgtcatctctatagcctagatgtaaaattaatcttaaatattagagatctgatgctttttatatctatcataactcacattttccaaatatctgtaattactgaggaattttgactaaaattcaagtgtcagacattttaggaataagtactattaagtatgggctttgtttcttttacttgaattatctgcaaaaatattgcctttatatctattcatagatttgctactgttacaacattcccaacttgaactattttagtttaacctattttattatagatccaggccctcagtttcttactgttattattagagcttaggactggtgtcatgtcattgctatctttgctacaaaaatctaatgacagttgtcttagtccatgtgagctgctataacaaaaatactgtaagctgggtggcttataaacaaaactaatttttttcttataggggctgagaagtccaagatgagagcactagcagattcagtgtctggtgagggcttgctctctgcctcatagatggtgccttctcactgcatcctcacatgatagaagagactagctagatatccgaggtctcttttttttaagggcactaatcccacttacaaggggtctgccttcatgaattttggagaacacaaacgttcagaccatagcaaaagcagagtttttgtttatttttccttaaaacatgcagtagtctctgggcctgctctatcaactggaaatgtatcacacaaaatataaccatcgaaatcatacatataagaaatatcagaatttatttaaaattacagtttaaaaaggtagagttcatcagttaaatgtctcaaatccaaatatgttaatattttgctataaaatgtaattataaattacatatttttcagtcatttagtcacaactaacaagtgctaattgaccctattttattttgttttgttttattttatttttagagacagagtcttgctctgttgcccagggtagagtgcaatggcactaatcctagctcaatgcagcctttacctccagggctcaagccctgatcttcctgcctcagcctcccgagtagctgaaaacatgagtgcatgccaccacacccagctaatttttggttttcggttttttagagttgttttgttttgtagagatgaggtgtcgctgtattgcctaggctggtctcgaactcctggcctcgagtaatcctccccactaggcctgccaaagagttgggattacaagcgtgagccactgcacccagcccaagtctactttatatcctgcttttgtgcatggaaacagggatacacagttatttgggcctttaaaaatattctttctttctttttttcttttttttgtttttggccatgctgctcttagtttcatcacaagtgggtgacttctggctaaataaggtaaaattttagcatgagcaccaatccaaggacagggtgatgattttaatgagtttcactgagagctggccaagtgagcatctgttccttttgttttctccatactttgtaagccaggatctctaatctaaataggttggtgtgtgtctatatgatgtggagttttttttttttaattgtttttttctcccaccctctgctttattggtacatggttaaaaatcttctgccatctagcacaattatttaatttcttccatgcttttggatcttgagtgagaaagtaagtttgctcattgctgctcatcagtgtgtttcacttgctcccaggtggtgaccttctcattgcattgttgcttattttaacattattctgacacctatatcctttcgtcatcctcttaaataatctaatttaatgatgatgtctatcatttcctattggaacccagttaaatcactggttccttttattggcccacatcctgtcttctggttcattgcttcagatttgagccaaataatcagttggtcaatgtcaaataaaaacacatagctgaaaaattttctttcttgcaacagtctccagtgaggtacccatagcatgagaatactgaaaaaggttttccttttttttgtgagatggagtctcactttgtcacccaggctggagtgcggtggtgccatcttggcttactacaacctccacctcctgggttcaagccattatcctgcctcagcctcccgagtggctgggattacagaagtgtgtcaccacacccagctaatttttatatttttaagtagagacagggtttcgccatgttggccaggctggtctcgagcttctgacctcaggtgatctctctgcctcagcctcccaaagtgctgggattacaggtgtgagccactgtgcctggccaagttttttcttttttatttacatgtgttttgtgtgtctcatgatccctgtttcttttttgtttgtttgtttcttttttttttttttttttttgagacggagtcttgctctgtcacccaggttggagtgcagtggcatgatctcggctcactgcaagctccgcctcccggtttcacgccattttcctgcctcagcctcctgagtagctgggactataggcgcccgccaccacgcccggctaattttttgtatttttagtagagacggggtttcaccgcgttggccgggatggtcttgatctcctgacgtcgtgatccgcttgcctcagcctcccaaagcaatgggattacagtcgtgagctgccgcatccggccaactgtttctattggcctctattgcttgacctttgaatggaatgacttgtcattatttttgttggtctgcaagcttgtccctatttcctgttcttcacctttagcccttaactgaatagtttcatctgctgcattgatatggctgcagtgttttctcaacttggtacaagtgtctgttgttgattcagattgtactccattgtggcctgaatctgtaaccatttccatgtgagaacaactgtaatattgtgatatcaaccatttttgtcctttagttcaaagagtgactttggcttggctagagatactaattataggccaaaaccttattatttattgaatatggttcatgtaagttttagagaagacattaatactatttatttccctaaaagcagcaatggtattatgtttggacccctataataccttgattgtaactctttgccagaaatatcatagtcttatgatagctctatacgaagggtaccaattagtcctctgtagaatacaagaaacaaagctgtaaaacaaattacaaccaccctaagttggcaataatcttgttagtctttaacttgaagaaagaggcctaagaaaaaatttaaaactaaaaatggccgggcacggtggctcacacctgtaatcccagtactttgggaggccgagacgggtggatcacgaggtcaggagttcaagaccagcccaaccaacatggtgaaaccctgtctatactaaaagtataaaaattagctgggcgtggtggcacatgcctataatcccagctactcaggaggctgaggcaggagaatcacttgaacctgggaggcagaggttgcagtaagctgagatcgtgccacagcactccagcctgggcgacagagtgagactcagtctcaaaaaaaaaactgaaaatgtaggagggtctattttatccctataacttaatccaagtaatatttggaggcattgagatacctttttgttttttttcagaattctttctcctggttatggccctgtgtttcatgagatttgtgtttggagcatgatgagctctgtgtttattgtagctttaaatggacagtcattattaactgtcaacttagtctttaaaatccataatcacattgtgcttattacttgtcaaccttcatgattttttttaattggtaaagaaaactcactggaaggctgaaaagcattacttttttatgttatcttgctattggctttattaaactattactgcaaattttggtcttaggtttttttccctaatttacccttacccacacccacagatacacaaatacatgcagttaaaattgaattgtttgaatacatctatccagattcctggcccagataagagaagtttttcctctttatgtttgggaaataaaccccttcagtagccctttgtggatgttctgtattttagttgttattggttgttgtcactgtttttttatttgagactaataatctgtttgaaactgactgagacagaaaaatgtgatgttcctttccactcactccagattttgatagaagacttgttttatttatttccaaaattatatccgcaggaaacaagctgtttaaattcagattatgctgaagcaaaatggtcctggtatgagaagcaacgtgctgttttacgagcacagagtcccttttctcataactgattgatagtaaatattttcctgaagaattattgccaaccatgaacagtgcaactgtttcactttttttccatgctacttgctgtaccagccattgtcggtaattaagatctacaattcacaatgcagacgtttgcacttcctctgggtctgtgctatttataaggcatttcagctgttcagagtttcttttgagttttaaactacatgttaacaggcttctttaagatactgttccacaagtagcatgtcatatggtccgttcttcacacaggcgcctctgtcaggtctaaacattagctttacagagaacatactaagatataaccacgtcattgaggctgatgtggttggaaaaactgtggagtataatgtgttacacattgggcttattgctctttcaaaaagataggaaggaacttcagatgtaatattctttttgaaaatcttaatattcatatgagcttaatgtgttaattgggttacagagatatacacagttaaatgacttttccaagttcactttgcattaataagagaagccaggacccctcttatagacaagagtttgtgtgtttgtcagattaaggatgtaagaatacattttcttctagatgtgcgtgccgtttaagaaaaatacagacatggggcaccaaaacggatcagcagattgactgcacatttgttgtgtaatcagcttcaggaaccctaagtagcatatgccattggttgaggaaagtgtaaacaggaatcttggtctgtgttaaagttggtaaaatttaaaccattttcaaccaaaaagagacttaaaaaaaaaagtccagaccccagcccagaatctttatgaattatgccctaaaataagagtaattgcttgtgcagtcttcttgctaccggcactcattgttaaacatacaagaaaaagaaacaagaaactgaaagctgtcaacaaaatgtgtttaaaactttgccctgagtgggcatcagactggctgtttttaagcctgaagtccagccgcattgattaggcacgttggccatcagcatcttccagcagagcagatctgcagagaaaggcaggacccaggttttagtgctgattctggatggcccttgaatatagacagaatatagacagcttataacaaagccattccaaggcagttttattttacaaatctaaaactttcggtagttcttttgaactaccgtgtttctgtaaatttcttcagtgaactctatgaaccgttttttttgtttttgtttttgtttttaaatagcagcggttcagctgttgggaaccactgatatatctgactgaggcacttcaagatgctagaatttattcatatttctatctagccagggagctaataggctcgagcttgtctttgtggattgatctagattagcatgaaatgagcccagtcagtgtcttcctcagtgaaaagggagaggttaggggaaagagggatgaaagaagaaagttcttcatcaagaattgactgcagtattgcctgctgatgcatgtcggatcacccgcacagagagatcacatggcttctccaaaagtcaaacgatcaattcgcctcgttttggctctgtacttaatgcacaaacagtgcgatctgcggggctgtaattgcattgttagggccaaggaacaaggctgtgccttttcagcagacagctggcagggagagaggcatgttgttaggaaagagagaggcaaggcaaataaaattactgctaacgctcagagatcggcaggagtcctacttgcctaatcttaccggtgggagcaagcggctgttgtaatccaattatagcagcataagcaatttgttagacactccgcataatgtaacaatttcccaataaactctgacttgtaataacgtcggcaagagtccgcataaatctgcccgaatggtgggggctggagcattcggctgggggcttgtaattggcgccatcagcacgttttgcggagtgcagtatggtgcagtcttttagtgcaggaattttaaggagaaaagcgtggcacatttctcagggaaaaaaaaaaaagtggccattaaaaggggaacagcaagaagggcatactcttgccgtcacattacctaggaatcttagtgtagaaagaaaacaggaggaagccatgtttcctcctaatactaaagaggggaggtggggaaaagagtgtgtgaattagttaaatttctttatttaaaaggcatcggtttctattatttataccttcatctccagccccctaaaatgctgttcaggcagggtttagctaacatttttataaaatggtcatactcaagacaagcctagaaatgccaagttaaaatctgttttcttctggagttagcattttctttacaacatgaaatatatattctttatgaccaggacaaatcttttgaagatattatctcactgaatatcagacctttctgtggtgttctgacttctgctttaagaaactgtcacttactgaagggtttaaatctcagcttgtttgcttagctgcactgcttcttttctcattctgaaacatattgtgaatatctatgatactaggattagtaatcaatcttattgaaacattacattttataagaacatatcatttaaatttatacttgtgtgatcattatagaaataattttgattcctaagtaataaaatttctgttttggaaaaaatatttgttgttatatgggacaaaataaaatcacccttattaattgattagcatttgtagtcacagaatagggtttcttgttatataaggtataggaggtgaagcgtgcttatggatttgagttaatagattttcatgctactcaatgtttattaaatgttacctactttcttatgccaacccatttcttcattgctatataatttgtgtcaaaaccaactatatgaagaacaggatttttcagaatatcctgttgctgtgggtattaccacaataaatacttacttgcagacttaaacatttccttttgctgaaacaaatgcagccttctttgactggagctacatcaataaactgcagtgcctctaataaagccactcagtgtctgggtttaactaatggctgattttcatggctttgacagtgagctgtgtgcgttattttctcctgatattgtaaaaataatgagagcaaattagaacaatcagtttacacagatagctcctgattggaggcgatgggcaatatggcagcaggtaatccatctttggactcctgtcacattaacttcaacagtgtgaaaagatcaggtggggtaagcagggatcctacccagtcggaacactgaaattaatgagaagaacagtgttctgtgatcaaccttttaattagcaagagtggaaacagagggaatgatgaagggagcaccacagctgcacaatgccaggctcagtttctgaaaaggaaagcaaaaaaatctgtgttttatgttactttttttcttgctgtgtacaggcattatctttccattctagagctggttgcaggcttaagaaatactgcctactttccaaagtaatgccacaaatatggttgatatattaataatctatagactgtaattctatcaggagtcatttgattttgattaccagcatactttctttggcattgtactctgggttttaagcttgatttttctaaaaatcaggtaaccagaggaattacattttttaaagttctgccttgtcagcctcctctctcctcatcactccaatttagagttttccttgcaagtaacatgagagttttctggtttggagcatttctgtcactttgagttatttaaaagaggagcaaaatccaggcagccagctatgtcatatttaaattatattcctttcctgattctgtttattagaaatttgctgttttgtttttctattacctgtgctattgacttctcagtgttgggctgtgttatttcaatttatgtaattgagaactgaatatcaatcaagtaaggtgtttataggaggaagaaggagaaaatctaggcattaactgagactaaaggttgattcatccattcaaagctcagatatactaaaattgtaaccttgttaatcaaatggtattaggctatagaagacataaatgagcaaaattttctgagccaaatcagcttctgtttcctagaccttttttggaaggctttaattttgggaaagtatatgaagccatcatgatttgcagcgtgttagtctttacatattagacttagtggcttactgtaaaagcaagtaatatgttataggctatgtaaatgaattcaaatatcttctaaagatacacaaaatatttttttcttgatactaataattaggcatttatttgaagtactaatatgcaaaagctggttaccaggtacccacctgggtacagaattggtaggaaagagcctaaagttagtgtgaaatatttaggttaggtatgaggtgatcttttctcataggactttttttcacaatatttataactaatgtagattatatgtatcataataggtataactctctaggctttcagtgctaagatactgcatttacagaaacttaagtctctaatattatgcctctacttaaaactcattgtacaaaagtacctcacttccccctagtaccatctccctaccctcttccctgaaaaaacttaggattctgttagaacagaaatctgattttttgtcatgttttattttgactgatagtgagcttttcctgaaaacattcatttagacttgtatgtaccaatattttagaatcagtgatgtaataccaaatagtatctaggactccccccagacaactctttttttttctttcccagaatcaagaataaaagcaacccagacaactctttaatagtctgatgctactgtgcatattaatatttaaagtccacttgttattattttgcagatccttttctgcattccttaatctgaaagagagatttttattcttaatacttgtatggatttttgtggctttttatgggtgtaaatattctcctctctcgtttgacagtttcaaaagcctaggttcataagctctccatgaataaatatgttcttagtcatgtgatgtaaaaagatcgcttacaaagcttgtgaaacctgagccttccttttgaaccttttactacccatgagctcaggaaccatacatgcaaaattttattcttgcgtcatgacttcagcttatgagggaaatgagctatgaatttaaatgactcttctactctataccaagtttctatgaaaataaaattgtattttttcctttttcctaaaaggaaagtttcatctgactagtgtttctgccggtatttgttcccattgttaaaagatttgtttcttaagattagcattaaaatagacatcctgtttttgaaggcatctttttttgtttatactgtaatcccaaaaatgtccaactggctgaatggccaagaaactcccttgtaatttcctaatagagctaaagttaacaagtcaccttaaagtctactaattccaattaagttcaccttggagaaattttcattagtctagtcctttggcacttacccaatacacccttaattaaagttcttatgcatgggaccagttgtatctattataaagattatcataattctaagttttctctcccacccccatttttttttcagggtgtgtttccatataaagatcgaaaaagtccattttcttttcatgtatcttcaagatggaagatcttttccttcccttccttcctcccttcttccctccctcactccctccttccctccctcactccctgcctccctcccttccttcctttcttcttccttccttccttttcagttttatactactcagaagtttgaggaggagagagaatacattaaaatgtattcagccccagtgttcaggcactatatagtgctagctatgtgttacttatttggattctcatgtgaacctggtgagatggactggatcccactttacaaacgaggaacgagaagcttagataagttaaaccttttccaaattttcacatctttaaatgatagagtcaagttttgaactaagatctgacttcagagttcttgctcactagattgcctttcaggtagtatttggaggcctctgcacctctcctaccaggatacttcccccatcgcattgtgtagcttttctccatttcatttctatagcactttgacatctagcaaatgttattttctcatcttcctcctcttcctacctcttgctgcttgtataaatatcttgttcaggctgaactgagagaagtagtgtattcagaaaacttactatctcttttcggctgggtgtggtgcctcacacctgtaatcccagcactttgggaggcctaggtgggcggatcacttgaggtcaggagttcaaggccagcctggccaacaggatgaaactttgtctctactaaaaatacaaaaattaggtggatgtggtggctgcacctgttgtcccagctactcaggaagctgaggtggggagactcacttgaacctgggaggcagaggttgcagtaggccaagattgcgccactgtactccagcctgggtgaaggagcaagactctgtctcaaaaaaaaaaaaaaactctcttttctgggttacctagtcagtaattccatgtaacttaaatagtcacctgccttattaacatagtatacagatctttcaaggatctaagttgacttcttggctccatattacattgttctgtatataaaatgactgagataatattagacaactggttcagggtggtgacttactttagtaattgttttagaagttgttttggaatacagattttatcctgttgtctgtgtcacaatttgtagtgtaagcatgcactggcagtcctttcataccaacacatttgtttttcccacttaaacttggttattaattttgtcaattaaaaatgtgtcccttggcctggttcggctcacacttgtaatcccagtactttgggaggctgaggtgggaggaacacctgaggtcaggagttcaagaccagcctggccaatgtgctgaaacccagtttctactaaaactacaaaaaaattagctgggtgtggtggcaggcgcctataagcccagctgctcaggaggctgaggcaggagaattgcttgaacccaggaggcggaggttgcagtgagccaagatcgcgcctctgcactccagcctgggtgacagagtaagactccatctcaaaaaaaaaaaaagtctcttaaggcttcaggtctgtctgattacacttcagtaaatatttttatattttgattcatgcttctagatggttcggtgattgtgaagacatgatgaggtcatgagaatgtagctggaccttgaaatcctctgtctcggagaaaaggcttgggacagggatgagtgattagaagaaataggttttttttaaagcaaatgaaaacaaagcagacaaacaccaatattactattttgtgtgtatgtgtagttgttgttgttttttttttaactccctggatattctctaatggaaaggttagaaatgcttgacagttaagggtggcataaatttttcacacagactcataaagtatgtaagaaacacttgctcaacatggagcactaagaccatgacaaacaggaacagcaaaatatttctagaagaatgaacataaatttatgttttatacctcaaacatcacttctctaatttaatccacattttctaggagtatctaagagcataagaaatttaattatacagttttgggtttgtttgtttgttttcaatgtgggagcaagccaaaagggaaatatagagagaaaaccatgtttaaaaagaaatggttcctacagtgttaactatggagtctgtagcgtgactctgtaatggaatatcatggcagggggtataatactgtaaataagatgaatatgccacttgtggattaatgggcaacctaaagagtgcttttatttacatctatgtgtgacgttcattttcagtttgtatatttttctcttattcttgtgattatagtatttacaaatctgacattttaattacggaactttctactgattttttaaaaaatctgtttccatgaatcttgctccatatttatttttgtagtattaatatagtgtcattttggactttaaaattgatagattgaaggcgttttctttaaccctttctttagataataaggagacaaggtagtttctgaaatgtattgaattcataaaatacagctatttttaattgtttttcttacgaaagatggagtatagataccacgagtgtccagattatagcagattccatttgcagtgatagttttgtggatatggtatgcttttcaaaggtttaggtactaattaatataaacttgaatacatctagcctgggacactagaggagctactgtctcaacattataacattataacatgcaataaaggtaagtactaagtgagattttataaaactgattttttagtcagcagtttaggttgctgttgattgcaaattactagtattatttagtgcccttgaaacttctgaagttggaggtttcaattgttagttactccctgctttccttcaatagaaaatgtgtagtaaaggttatttataaaagactaattgtatccaaagctaaatggtcttattatagagtttgtataggatttattttcacttgcacgggtaggttctcaaaatgtatttgaatgtgaatgacttcaaacaaaaaaaagtgaaaaatttttaaaaagtactaaaatccaaagattttgtcatcaaatttgacagcctttttgcaccattacaggtatttattgaatgtttatgatgtactaggcatatacattttcactgaaatcatcacaatagtctcattgtgtttacacacaaatgaagtagaattcagattaagtaatttgcccaaggtcatactgtatgttgcagaactggaatttgaacccagaccatctggccccatggccttgtgctttcaaaccactgtgtttgtgaattttaatacatagaaattagggtagatgtagcaaatggggggattatctaaaacattctctgtggtgtctattgaatgttaacaatttactaacaactagccaggatttggaaatcgcagaagtatgcaaattggttatataaaattatgatagagtaatacatcttaggtttgtttttcttctcttgcacttatagtattttcctttctagcattccatatgagatgataaaaattaaaaacgcctcaattagcagccacaaaaaagtaaaactgttaattgaaccttgtaatctcttactgtctgttaggcttttcttttcaagctttgattgtgtgtaataaaactgtggcttaattaatgccagggttctgaagcctttggatgccacaaaagagagtgaagtggagaaaccaaggggcagcatcaaatagcttttctgtcatgttaatttagccctgtcggtcttgttctagttcatgatgtacagctcccaccagatactcacttggtgaattgaaagaggagctgtagtgaaaatactgtcttaggaaaaacacagctcttgattgaggctatcagcaggttaatgaataactgttttcagacaacatttcacccctagtttgagctgctcttagaatgaatgtggccaggttaatgtgaccagcagacataatgcaaaaccaaactaaggtggtaaattggcatcttggctttgttgcacatgcaggaaagatccaggactggtgtcagaggtatactgtctttggcagaagagtgcttgtccataaccagagtacaagagaggaagtcatactgatttatattaatcttcatttcatatgctaaaaaacaaaatggcaaccatttctctaggaaattgctaaagctgactttatagacatactttttgagggatccatatgctttaaataagttgataggaaatgtttgctatatcataactcaaaaaatattttcttaattttgagaatgcggaatattgagcaagacataattatcttccctaaaatgaatttacttttaaggtgactctgcattttcttctttttctttctctcattttccctccctgattcaaggaacttattaattagctggttttatacacgtattgattttaacaagaatatggaaaagccatgtttctttcaggatgagaaagatttgaaatccaaccatgaaaaatgaagccccttgtatttctggctgcattcccagaatagttgtgtgtagtataattattgaacttttaatacctgctcaaattctgtctggattgcagaggattacagcatcacatctaaattatactttctgataatattcaaatgtgaaatagacattgttgtgtggaggcagtgacatcatcataattttcaatgttttaaagtgtcagtggtaaagggagtttacaagcataggaagagaacacaggctttacgttgaaaaaggtctctgtcatccagggggttatttaatgctaataaatacttgttttggaatggatggaactaggttaagtgtttacagccaaaactttctattttcctctaccaaagagcagggttctcctaatactgacctactttgctcttagacaatactacaggtacagtggttatacatccatgaagagaaaaataaatgagaccagaaagattttttggtaggaagtgtttggtaacatgttgctttgttggtggaacataatgttgccacaaaccatgaataaatattctgaattatctaatattatagcagttataaccatttttaagcctcctttctaagtagatatttctctcctggcttcctgtgctgtgaactttgcaaaactggcataggcagcctattaattattcatatcatagcaacaattaaagcaaattaaaaataaaaatcaccgtattgcatttaaccgtgggcagcaccaaactgtgtcagctctgtaagggcctgtggtgtttccttagttaaaagtgctagagggagctctaaccttgttcagagtggtggcatatgggaacaattgtctgtatgtggccataggtttgcaagtgaagatatagtctcaggctcttctgtggcaaaaatttaaatcttttttattagaagtccctgtttcctttatatctgaaaataagggctaggacagtctatctatagccaaacagaactgtgttcatccttattgccctttctgtgaatacaatcatagtgaattttcacgaagtgaacatacctgtgtgattaccatcagattttatttttatttttaaaaaattccagattaagttcacatccacccagattttaataggaaaagagaaatgaaaagaccattaccggagcccactactaccctctttaagtcactaccctttcaagggtaaacattatcctcacttctaacaccatacattagttctgcctggttttgagcctcatataaatggaatcatatagtatttttttttttttactgtctgaattatttcactgtttttgagagtcatttatattgttatgtatgtatagttataatttgttattgatatgtaatatttcattatacatatatgccataatttatccattttactataagtgaacattgggtttctttcagattttcataactacaaaaaattattttacatatattttcctgaatatatacaatgagtgtatttgaatgggtatattaaccagcagaggaattggaatttccaaactagcaccaatttttatacagcagtgaataaaagttccatcattcctttttctcaccaaccaacacttggtgttgtctacctttttcattgtagcattctggtgatacgtagtagtattatgtatgacattttggattttgttttaagtttttattttagaggcatggcttcactctgtcacccagtctggagtgcatcagcgcaatcatagctcactgtaacctcgagctcctggcctcaggcagtcctcttgcctcagcctcccaaagtgctggaattactgactttttttaaaattgcaatttaaaaaataataataatataaaatttaccatcttactatttttaagtatacagtttattagctttaagtgtattcacattgttgtcacattgtttttcattcacatttctctgaacactattaaaattgagcattttttttatgttgattggccatttggatgtgaagttcttgttcaacgcatttgccctttttttaattgggttttatgtatttttcttaaagatttataagagttctttataaattctggatacaggttatttgtctgatgtatgtattgcatatatttctcctaaactgtgacttgccttttcactttttaaatgatgtctgtgatgaacagaggttcttaatttaagagtccaatttatggatctttgccttatacaattagtgtttttacattctacttaagaaatctgcctgtcccaatgtcttaaagacattgttttatctagtttttatggttttacatttcatgtttaattcgtttgatttttgtatatgatgcgtggtagaggtgagaattctttgttttccagtgtgatacccagttgacctagcaccatttattgaaatgtgtagttcccattataccggattgttttctttgaccatatgcttataggtctttatcaaaatcttgaactctgatagtaagtgccctagctttgttgttactcttcaagattatcttggttattcttggttattttcatttccatataaattttagaatcgccaatatttaccagctgtgtgatccacgccttgtgtactacagcacttgaacgtggaacagtcttcatatatttgtttaaatatgaatatattaaagctgggcatggtagtttatgcctgtaatcctggcactttggaatgcccaggtggaaggattgagcctaggagtttgagaccagcctggtcaacaaagtgagacccctgtctctacaaataaaaaatataaaaaaaatttatccaggcatggtggtgcgcacctgtagtcccagctattcaggaggctgaggtgagaagatcacttgagcttgggaggttgaggctgcagtgaaccgtgatcatgccactgcactccaggctgggtgatagagtgagaccctgtctatcagtcaatcaacccataataaataaacgaagttggctgggcgtgatgactcatgcctgtaatcccagcactttgggaggccaacgcgggcatgtcacaaggtcaagagatcaagaacatcttggccaacatggtgaaaccccatctctacgaaaaacacaaaaattaactgggcatggtggcacgtgcctgtagtccaagctactcaggaggctgaggcaggagaattgcttgaacctgggaggcagagcctgcagtgagccgtgatcgttccactgcactccagcctggtgacagagcgagactccgtctcttaattaattaattaattaaagttgagatatatattgacatatacagagagagtgattttgtgtgacatatacacacaaaaattccctaagttgtagtttcttctgattttgcccagagccttttaacctggctttcttaagctgctttttttgagatggagtctcatcctgtcgcccaggctggagtgcggtggcgtgatctcagctcactgcaacctctgcttcctggattcaagcaattcccctgcctcagcctccctagtagctgggaccacagacatgtgccaccacgcacagctaatttttgtatttttagtagagatgggggtttcactattttggccaggctggtctcgaactcctgaactcaggtgatctgccccccttggcctcccaaagtgctgtgattacaggtgtgagccaccacacccggcctccgaagctgctgttacgatctaaatcacatcataactcttttttcttttcttcacaattctatcctcagtcccataagctaatggtggccacacaggttagcacatttttaaagtattttagtcataattcccctcctggggaatttggcattaagtttctattaaaactacagttttaaagtttagtgggcacgtcctaatacagcctgaattgttgagatggtttcttggtgctagaaaataataatagcaggccagccgtggtggttcacgcctgtattcccagcactttgggaagccaaggcaggcagatgaccgaaggtcaggagttcgagaccagcctgaccaacatggtgaaaccccgtctctactaaaaatacaaaaaaagtagctgggtgtagtggtgcgcgcctgtaatcccagctactcaggaggctgaggcaggagaatcacttaaacccaggaggcggaggttgcagtgagctgagatcatgccattgcactccagcctgggcaacaagagcgagactctgtctcaaaaaaaaaacagaaaaaaataataataatagccacctttagtaaccatgtacatgctagatcctgttccaagtatttcatatacataatctgttatttcatatgacaattgtaggaagtaggtggtattagttttgtttacagggggaaaaagtgaagcttaaagaaggcaactaacttgttcaggtctatatagcttgtacatggcagacacttggcctgtacctgggcttgtctgacactatgcagtactaccttttttttgagacaggagtctcgttctgtcgggctggagtgcagtggtgcgatctgggctcactgcaacctccgccttctgggctcaagcaattctcgtgagtagccgggattataggcatgcaccaccatgcccagctaaatttttttgtatttttagtagaggtggggtttcaccatgttgcccaggctgctgtcaaactcctggcctcaaagtgatctgcccacctcggcctcccaaagtgctaggattacaggtatgagccaccatgcttggccactatgcagtactaccttttaaataattatgtatcttaccacctccataaataaagccctgggtccttcatattatatttaagaatataccctccaaaatgtcttgattctgtctttgtcacacccctaacccccattctcactgctgctctcctagttcatgtctattctgatatcagcccactcttccatccttactatgtaggcctacgagattgctcactatcaaaaaatgctatcaccacagaaagatgaggttacaaattctgcttctaccttccattgaaacttaattctttcaaatggaaatcaagcctcagtgcttgtccatattcatttagttattacaatagctagtatgccaccttggtcttgagggcacttgatggactttcgaatctgaaagaaaaagctctctgcaatacagcaggctatggactataatgctgaaaatacaactggcaaagaacagtggccatctgatcatgagctcttaataaagttttgagaggattccaatgggttttttatatctagttgcagacttttcttgtggccctactgtggttgtgcactgcttaatgatggggatatgtatgaaaatgtgtcattaggcaattttgttgtattgcaaacattatagagtgtacttccgcaaatctaaatggtacagcctcctatacacctaggctatatggtatacctattactcctaggcaacaaacctgtacaccatgtcagcatactgaatactgtacgcaatcataacatgatggtgtttgtgtatctaaacatttctaaacatagaaaaggtatagtaagaatacaatactataatcttagggaccgtagttgtatatgcagttattgactaaaatatcatcacatggtgcatgactgtactttgatttggccctaatggagaccagttggtgtatataactttttgccttcttatgaagcaaagggattattaataaagagatagattcatgtatagacagttttctgaaagcctttattaaatactggaaactgtggggagggatagttggggtaattatcagaagagttgatgtgaaagaaatgaggcatattgaaacagaaaacttcaagaaggcattactagggcttcagatcctagtgtcagccatgaagaaggctaaaaccttaaagcttttaagattttaaattattaattttaaagtcagcatgtagaaaagtcagagaataataatattacctgtgtacctgtcactcagaatgatagcatttctttgcattaaaaattcaattgtttaagaaaagtttgacctattcttggggttatagaatatcttgcttgcccaaataatattgtgaaaaatgttttttaaaattcgagggccaggcacagtggctcaagtctgtaatcccagcactttgggaggccaaggcaggtggatcacctgaggtcaaggagttcaagaccagcctggccaacatggcaaaaccccgcctccactaaaaatacaaaaaattagccaggcatggtggcacacgcctgtagtcccagctactcaggaggctgaggcagaattgcctgaacctgcggggcagaggttgcagtgagtggagtacactgcactccagcctgggcaacagagtgagactgcgtctcaaaaaaaaaaaaagaggtgtatgcttaaacgccaatatgatgggttttaagtaagaacatgtgaagaatgaatctctatttttaaatttatgtacgcaattttattttaacttacagtagaactggattatagactcaaagtttaagagccagactgagcttcagataatcccatccactcactcatgttacacatgaactcccatgccagcagatacttcccccaggttgtatggctaattagtgatttagactgggcctaaatctctttagcatcgtgttgcctcacttttgctttcaggctacattaaaacatttatgtcaactataagaaaactttttgatgaatggtttgtttccagagcatcaaagttcagtatgtattccttaaatggaaaatagaaataaactacagtgtttgatacatagaaaaattccatgggaaagagttattagtactcttgagcctcgtatttatagtgctccatatgaacttaaaccactcccaggtaaaataaaaaggttaggtagtaaaccagaaaatgtctttatagaaactatttcatgctctaagaaaagccaagttcttcaaagaaaggatacaagtcctaattttaaatcagatgcataaattttatggaggtgactgtcttcctgattttcattttcttattacaacccctcttcccagaaaacacctacacaaaacccctggtggaagtttgtcccattctaggttaaacaaacaaacaaaccatttttagtgaccctcaaaattctatgtcttttctcagaaagaccaaaaatctgcaatctctggtctatgaaaccccattaaaaatggtgcccatgtaggggacatataaataacctccaaagttacagggtagtagagtttttctgcctatttctgagagaaaggaaagtggatgctgacaacagccagaattttagtctggtttctgccctggctcttgtctttgctgattctaaaacaatgccacaaatcagaaggaagcaaaatatactctgtgccctacaggatgttagctctttggtagaaattgttcaagtggattttaaaaattagagtaatgcactgagagtcttgttaccattctgataatttccttactgttcttccttccctgaagttgggtgttatgggaaaacattgtagcaatagctctgaaagattgaaaatgaaaaaaaaaaatcaatggcaaatgtcttttattccatattgtagaagatctttgagggcttccttttgctcttttctgtcttcaattattaagtttcatgaaacattaacctactgttagtcttcattccttttgggagttcagttttactttggttcttaaatttttgcataccaatcttagaaaatggattagattgccaaatttgagtgcctatggacaaagcatcaatatagtgatagtagcatccttcttggtgagagaaggggactccaaatatgtttacaccacaagacattttaccactgtactcacaaaaagcaatacccacctcctcgttcatttagattaacagttcagtttatcaaatatttttgagctgctgttatatagatactgaaaacttatgtgataatctattttaaagtgaaagtttctggacataatattattgtaaaagcaaagaagagtatatttaaatatagtgaagcattaagctaattataataagtaactatgtagattacaatcctttttagttaaaactcatcacaacttatgcccttactatgtgccaggtactctttctgaatacctttatatgtattattttaatcttaacattagcccttctagctaagtattgtaactatcaccattttatagatgaggaatttgaagcccagagaagttaattaatttactgaagatcacactccaggtaaatagtagagctgggatagaatcagtgtcaaattatgattttttaatgatattctattacataaactccttcagaaagacatttaagcttgcttcagtgtggcactttgagtctcagtgcatatgtaaacctcttttggttatagaaatgcatttatccatctatgcaaagcagtcctggtcttctacatttagtcatagtcattgacttggagcttcattgtcattgaaaagaggaagaggaccagaatttcattttagaaaaactgttcagcttatataataactgcattttgaaatctgaactttactaacttgtgtgaatctgagcaagttattttgatcacctgtgctgaaaaaacagatgctgcatctaaactaagcttttcctggataaattaagaaaacaattaccaaagtattccagagagaaatgtcttcagtcccttgatgttcccagggttattaaagttttacctgaagataaccaagacttccagaaattacaagtcatttacttcattcactgcagctaagagaagcttgtgctgctgcctcatagaattatttcttgctgcatttaacatgcattaacaagcatttgaaaagagttgaatttcttctagaaagttgagttggcttcttgagatcctatccaaaaaactttgtattttcctaatcccagttttagataaagccttctcaaaggcttttttcaggagcaagttttaccaagttgttgaggcctttttatagaacacagaaattgaaggattagagcacaaagaagagcagggtagttttttccttctttatttaaacccgactgtatttttcccatacactttttaactgttttacatgtgcctctgtgttttgctctgacatctgatgcattccctgctaatgttagaactgaattttctgatgctaactgaagggagaagggtgttgggggtaagttgggcagaagactctcagtttcaactttcagcatcacagaaattttattctggtaatcttaacataatttgacatctaggtgaacaacctccacctgaggaagttacacagaaagaacaaccagattccagacaattaaactttattactccgcctgaaacattaagtagtggttttaaaaaatagttttttatctcctctccctcttgatgtttattgtgtgggagaggatgtttgtccaacaagcatattgctcctcttagagcaggtgagcttggtaatgctgggtcccttttgcatttggttatattcattctcccccttcccacctatttctcacttcatctctcctgtagccatctccctccatctcttccccagctcatcatctctccccatccctatctttcccctagacctgcttatccctcttccttcatccttatcccatctctcaccaaccccactgcctagtatccactgtcctttccccaatcctcggtcacttttgtcattcctcttcctcttctaccctcttctctagccctagcccttcctctccttgcgttcctccttctgctttcccattttcccccttccatttcccttttctttctctcctcactttctctccctttgactctctttcttttctcctctttcctcccctcctttcagctcccctcatcacaataacctataattctctgtcctccaggatcagatcttgacttctctaacagcaaagattaattttgcttgctctgatcaatttgatattatgaacaaagaattctctagatggcacagatacactccccctcccccatattcttcaaatatttgactaataaattttaaaaaaattttgttttctttttgagatgaagtcttactctgtcacccaggctggagtgcagtggtacaatctcagctcactgcaacttctgcctcccgtgttcaagcaatcctcctgcctcagcctcccaagtagctgggattacaggcgtgcaccactgcacctgagtatatatttatatatatatatgtgtatatatatgtatatatatatgtatatgtatatatatatatatatatattttttagtagacacgaggtttcaccatgttggccaggctggtctaagactcttgaccttaagtgatccgcctgcctcagcctcccaaagtgctgggattacaggcatgagccaccatgcctggccgttgactaatacatttttaaataaacagaaagatggccgggcgcggtggcttacgcctgtaatcccagcactctgggaggccgaggcgggcggatcatgaggtcaggagatcaagaccatcctggttaacacggtgaaaccccgtctctactaaaaattcaaaaaaattagccgggcgtggtggcaggcgcctgtagtcccagctgctcaggaagctgaggcaggagaatggcgtgaacctaggaggtggagcttgcagtgagcagagattgtgccactgcactccaacctgggcgacagagcgagactccgtctcaaaaaaataaaaaaaaaaaaataataataaaaaaacaaatatacccaccaaaatgtgaacattatgtctttgttgatagttgaaattatgggcaatttccatgttttttgtgtatctgaatttttcatatttactaaaatgtgtctactgtaaatgctatttttagaaaatgaattaaacattctttgcttgaccccccccatagatctttatttaatcaaagtgaaaacaaaatgactcagatttgatcctttttgaagatgaatttggtttgctattttgatgttcagttttccaatttttttttttttttgagacggagtctcgctgtgtcgcccaggctggagtgcagtggcacaatctcagctcactgcaacctccgcctccaggattcaagcaattctcctgcctcagcctcccattagctgggactaccggtgccggccaccatgcactgctaatttttctatttttagtagagacggggtttcaccatgttggtcaggctgatctcgaactcccaacctcaggtgatccgccgcctcagcctcccaaagtgctggggttacaggcgtgagccacctgtagttttcgcgcctggctagttttccaaatttttttacctttcaaaatgggtggccctttgaactgaagcatgaagccatcagctcattggcactattgtagcacatggtgaatgttaaatacagttgctcaagttaggcttcaactctaagtcctataagacctttcctgcctttctctgtcctcccaaaatttagctcatgtttttttgtaatatttcaatattagagtgttcagtctgatagacttggcaatttttatacagatttgttttcagccctgttatcagtcttgggggtggggaggacaggcattgatgagcagcagttctattatataccttgtttattgtccttggtagtgttggttataaaaagtgtaacagtcatgctgtaccaagccaagatgccaactctgccatagttaaatgttaaaattccaagctcagattcaaaattgactgaaaggaaatctttcagcagactatttcaatctcagttgactaaccctaggtatgcaaggtggatggcaaggctagatgaagtgctctaaacaactgaagtttacttatttcctagctatagtgtactcattgtttcacaaagggttaaattatgtagttagtgaatgcttttctagctgcaggggtttttgaaaagagatctaggaattctgcagttaattgaattcttcaggcatggactcagggtctctgaaaaaatttgagtgagcaaaattctcttgctttgctcctagatatagttcataccatgtcttaggaatccagaattattttttgaaggattttatgcctatatatgctgactgaacatttaataagataaccacgacattttaaaagattttatacaatgtacttgtttccttgcattgcccttctccctgttttttcttctcttacttccccaagtctgtatcactggggcttttttcccattttttcccatcttgtgagcaaagttttaacagtacgtagaaagttaactgcctggagtcttttaaatataagtaacacgcaaccagtaataagctgtcggttgattttttgctgcctgcaaagaaacataaacacagcgctcatttctggcaggtttttactgtcagagtttctcctattatatttatcttacaatttgccagggggtgaagttattaagttttagcagcagccatcgatcaagttcacaagttaacacgataaaggctctgtgccgctccgatccggggaaatgatgatcctcactcggtaattaactaaatgagaaagttaaatcttacttgagagctgggagagatgaaagagaggtgtttgtcagcttctcagtggaaattagaagcagttttctgcaattccctaagctgctgctctgtcatattttacataagcactgggaaaatgtcttgtaattagtgctgtcatggaagatttttttttgctgaaggatgttggaataattcattagattatcaagaaaggctgtgtcctgaaatgattagcacagtgaaatttaaaccattaacgataacaagtttagagcttgctgcagtgcagaggcaccccgggtatgtctgtgcctatttcaatcatttcttataattaaacattatgtcctttttttttccctcaccactaggacccatccaaaaatccttttaaggtggcactatctacatcagtgggtttaccagccttggaggtgtgtgtagttagtagctataataatgcaacagtaaattaaactgctgtgaatttcttggtttagaacaaaagaacctatcaccctggaagctataaagttgcatgagggggccaataaagaagcttgagtttcagttttgaaacctaaaaatgttaaatgactatcctgtccctttaactatgtcagaaatcagaaaataatgaaaaactgctttgttctgaatttgatgaattttatatatgacttttcctatagttagtaaataggaaaaaaagattggcaagtgtccagtcattaaataatcatatatactgggcaatgtcagttcatttcctactgggctttatttaaaggaattggaatgactgcaagctttttcttgttggttattagaaatcattcagattcataatgtgaactttccctctactgacaaatctgccccttcctgtcttccatgttcactaatcagatttgacatgtttatgagttcacctaatatgtaatcatatttagtagaggctgttaaaatattaatataataatcccactgagaaatatgatgtttacttctgttgaaatgtgtgccccattctatatgtaccattttcttttcatttgcactcccacttcccaccctactccaaaaaaaggaatggactactcctttgatcactgagagttataaagtttaagaactaaaagtaggctgggcgtggtggctcacgcctgtaatcccagcactttgggaggccgaggcgggcagatcacgaggtcaggagatcaagaccaccctggctaacacggtgataccccgtctctactaaaaatacaaaaaaatagccaggtgtggtggcaggcgcctgtagtcccagctactggggaggctgaggcaggagaatggcgtgaacccaggaggcggagcttgcagtgagccaagattgtgccactgcactccagtctgggcaacaatgcaagactccatcttaaaaaaaaaaaaaaaaaaaaaaactaaaagtagaatgttaaaagttattatcccacttttgaacattaatttccttttttctgcatgttcaatttgtagctaaattctttcagtttatcttgaaatctccttgtaaaaggatgctcaggtgccaatgggcgctagcccttcggggttccttttcttttccattctagctctttagaaatctaggtctccctgctatcaccatcttcatcactaggtgtgcttacttatctctttccattctaatcaaagtgtaaacaatcctatttcctctcaattcaagcatgacagtggcaatgtggatttttttttttttttttttttttttttttgagacagagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcctttttttttttttttttgagacaaggtctctctctgttgtttaggctgaagtgcagtggcatgaccacggctcactgcaggctcaacctcccaggctcaagtaatcctcccacctcagcctcccaagtaactgagactacaggcatgcaccaccacacacagctaattttttttttttttttttttttggtagagatggagtctcactatgctgccaaagctggtctcagactcctgggttcaagcagtccttctgccctggcgtcccaaaattctgggattacaggcatgagccaccatgcctgactggctttttttttaaagatgcttttggccgggtgcgatggctcatgcctgtaatccaagcactttgggaggccaagacaggtggatcacgagatcaggagtttgagaccaacctggccagcatggtaaaaccctgtctctactaaaaacacaaaaattagctgcgcgtggtgttacatgtctgtaatcccagctacctgggaggcggaggttgcagtgagccgagattgcaccattgcactccagcctaggtgacaggcaagactctgtctcaaaaaaagaaaaaaagaaaagaaaaagaaagatgcttttacaaagaaatcaaaggaaaataatcggaaaaagatcttttaaagtcattatttttggccgggtgcagtggctcacgcctgtaatcccagcactttaggaggcagaggtgggtggatcacgaggtcaggagatcgagaccatcctggctaacatggtgaaaccccgtctctactaaaaatacaaaaaaatttagccgagcgtggtggtgggtgcctgtagtcccagctactccggaggctgaggcaggagaatggcgtgaacccaggagttggagcttgcagtgagccgagatcgcgccactgcactccaacctgagcgacagattgagactccatcttaaaaaaaaacaaaaaaaaaagtcgttgttagatgtttatttaattaaaacctgacaacagcctctagagagtataatatagacttttaaaaaatctcttcctttccccctcaaaatccttgtaagttttgccttgtttctcctggccgcaggagcaagaacactgttgtatccccatccagattaatgtaccagactaaatatctaaaggatcagccttaatgaggtagtaaagtattatactaaaataaatgtatattatgacccagacttacaattctcaacaggggatttctcctcctttggtttctcctccttcatcctctgtcatgagagttaaaatacctttcttttaaacatttcctaatctgcctaatctaatcctagccatagtcacattttgcctggattattttatcagccttctaattgatctttcttcctctgcttttgcaacttgctcttattatcccctccccacctttccagcccctgctccattctctgtgtggcagctagtataaatatttgtaaggcacaaatcagacaatgccatatgtgactatttcaaaacctccaggggctctcctttacacttcagatgaaatctaaactctgtaggatggcctagaaggccttatgtgatcttagccccagccaccttaattcccaccatttttccttaattcccaccattttcttattcattctgcccagccacattggccttctgtctttcacttgaacataccattgcactagctcttccttctatctagaaggatcttccccaagatcttcacaagactgacatgtcattcaaatctcagctcaggtgtcacttcctttagaggcatttcttgaccactccagttaaagtaggctgcactctttacttcttttctttttcttttctttttaaacatgatctcactctgttgcccaggcgttcaagcagttctcgtgcctcagactcccaagtagctggaaccacatgtgcgcaccaccatgcccagctaatttttgtattttgggttttttgttttgttttgttttgttttgttttgcgacagagtctcactctgttgcccagactggagtgcagtgggcaatctcaggtcactgtaacctctgcctcccgggttcaagcgagggttcacacaccatcaagcccagctaatttttgtatttttaatagagacaggatttcgctatgtatgcctggccaggctggccttgaactcctgacctcaagtgatccacccaccttggccttccaaagtgctgggattacaggcgtgagccaccgtgctggctgtattaatagagacgaagtttcactatgttgaccaggctggtctcgaactcctaacctcaagtgatctgtccgcctcagcctcccaaagtgctgggattacaggcatgagctgctaccatgcctgcctttactccttattttatctttctttgttttcttcacaatccttactggtttgtgaaattaacatatttatatatgttctttctccactcctcttcagagaaggcaaagacactttgtatgcctgttcacagcagtttccctattacctggtaaagtgcccagcatagagtagtcactcaataaactgttgttggttgattgataccactaaagttccaggtttagtcaaaattgttgtcctgcccctcctaggctacagccttatcccctgcaaaacccttgcctattttattcttaaattaattcagcatttaatcattatatcccctttccccccatagttctcaatgccagagcctttccttaaagcctttctcaaagccaaatggaatccttagatatcttttatcatttgcatctttcttgtcataaatactttgttcatctagtccttgcaaccccagtactaaagagtgtcctatgtctggaatgtctttctctacttactatacccttccttttggttaaagcagatttggatgcaaactagaaatacttgtcatttcaccataaagttcagtcagtccactatgtatttcccaacctatacataatacagttagtaaagtcagcatacttagtattacaatgatagttgatgatcaagccagttggtgtctgcaagtgtctatttttccctcctggcccaggctgcagcttcagagaaattcatggtaattttgaaagtggtacgtgaaatatgttttcggagaggaaactagtccctagcctttgagaactaagctgaaggacagttccagaaatacttaactcctttcattttgtgtgcttgtcacctgacagcttctttctttcttgtggagacaactgttcactataaacaaaaaagaagagggagatgtgcaggggtggcagaaatttagtgttaccattaagctgaggctgtttgtcagctttccaagacacttgaacagtagtggttgagtcatcaggcttttgttgggaaagccaaatcaattctactgcaaccagtaaccattatatctctcatacactctaatatacaaccttttgattttttaataattgaactttttcattgtgtccttgtagattttcagaagttctcaaattggaattttgctgaatttactttagataattgtagaaaaatctgtattggagaatggtagaagaaaggggcatgacaacaaagacctttagatttctctacaaacataataccttagttacaaataaaattcatattacagtggatttatcagtaggaatactgtactcttagaagtttttttaaaataactttattaaaatataatttacatacaataaaatacacccattttaagtatatagttcaatgaatgttggcaactggcgtaacaatcaagttagagaacattttcattgtcccaaaaacatcccttgtacccttccccagtcagtcccatctctacatccagcctcaggcaaccactgatctgtttttctaacaattagaattactgttcctagagtttcatacgagtagaatcataatggactcatttgtacctggcttctttgattcagcatgtttttgaggttcatctttaccattttgtgtgtctgtggtttattctttttgttgctgagtactattccattctacagcagcatcacagtttgtttaccagttaatcttttgatggacatttggattattaccattttggatttttattaatatggaagcaaaaaacattaaagtaccagtctttgtgttgaactgtgtttcgttttaaggaggtaagtacctaaagtggaattgctgggttgtttggtaagtatatgtttaactttacaaaaaactgtcaacttgttttccaaagtagttgtaccattaaacgtgactgccaacaatgtgtgagagacccagttgttcctcattcttgtccacacttagtattgtcagtcttttaaattttagccattctaataagtgtgtcataatgtcttgatattttaatttgcatttccctaatgactaataatgttgaacatcttttcatatgcttattggcatctgtggatctttttttgtgaagtatctgttcaaatcttttgcctatttaataaaacaggattttttaaaaattattattgagttctaagagttctttatagatgctggatacaagtcctttgtgaaatacatttattgcaaatgttaataaaaatgacaaatcatttttggaaatcatgttttgaacatgccaatttactgacttttttttccttttataatgtttgcctattccaagaacgtcaaggttttctcctgtgttttcttttagaagttttatagttttagctcctatatataaatctagaattaagttaatttttgtatatgatgtgaagttaggaacagacttcatttcctctatggatatccaattgttgaaagacaatcctttccctatttaattttttttttttttgagaaagctctgtcacccaatctagagtgcagtagcacaatctaggctcactataacctccacctcccaggttcaagtgattcttgtgtctcagctgccctagtagctaggattataggcgtgtgccatgatgtccagctaatttttgtatttttagtagagatggggtttcaccatgttggccaggctggtctcgatttcctgacctcaggtgatctgcctgcctcagcctcccaaagtgctgggattacaggcatgagccaccgtgcctggcctccccattgaattatcttggcatctttcttgaaagtcagttggctgtatgtatttctggactcactattcctttccattgatctacacttgtgtccttacaccaaagccacactatcttgattactattacatatcttgaaatttactagtctgagtcttccatcttttttcaaagggttttgtggttttttagggttttgtttgttttgttttgttttgtttgagacagttttactctgtaatccaggctggagtgcagtggcacgatctcggctcactgcagcctccacctcccgggttcaagcaatgctcctgcctcagccttcagggtagctgggattacaggcatgcaccaccacacccggcaaatttttgtatttttagtagagacagggttttaccctgtcagccaggctggtctcaaactcctgacttcaagtgatccactcacctcagactcccaaagtgctgggattacaggtgtgagccaccacacctaaccgttttttttattttcaggaatattttggttaagtttaggtcctttgcttttctttacaaattttagaatcagcgagttaatttgcctgctgagactttgatattgcactaactctataggttgatttggaaagaataaacatcttaatagatccaatttctgaatacagtgtatctctccatttatttaagtctttttaaaatttccctcagcaatgttttatagttttcaatttataagtattacacaaattttatccattttttttttttttgagatggagtctagctctgtatcccaggctagagtgcagtggcgtgatctcagctcactgcaatctccacctcccgggttcaagtgattctcctgcctcagcctccagagtagctagggctacaggcatgtaccaccacgcccggctaattttttgtacttttagtagagacgaggtttcaccttgttagccaggatggtcttgatctcctgacctcgtgatccgcccatctctgcctcccaaagtgcttggattataggcgtgagccactgctcccaggctaaactttatcaaatttatttctgagaattttatgtttttatggtactacaaattgtataggtggatggttttcaaaaaatgtattcttttttaataggtgtaggagtcactctcagggtgactagtgacctgaaaagggacacaaagggggctagtgagtctcgtgatgatctgtttcttgatctgggtgttggttatgtgagtatgttcaccttgtgaaaattagttgagtacatttaagattaagcatttctatttatgttatactttaatgaaaattaaaatagaaaaaatatatagtgaaaaagaagaatgtactttcaaaaagagagggaaggctcagctccaacagtgttataagctcattaagagtgttgattgacggaacacttgactgtatgctaggtggtgtgctaagcatgcttttcatgagggttttttaatttgttccttacaaaaacccaatgaaatagaacctattatattattttcccagttttatagatgagagaattagactcagaaggatcaagttatttattccatgtcacacagctgctaaattgaagagctagaatttgaaaccaggtctttttactccagggccaaagcttttaaaacaatacagtatggggtagtggttgagagtaacccatttgttaatggatctcaggtatgtgtctttctgcctcatcaaaaaaatactcgttttgaggggtggtgactaaaatgtataccagctagaatagcccagaacagttgataaatacgtgaaatctcagtttatactttatgtctaataaccaaatgtgtaattcccacttatgacttgatcattgaaagtatcacaaagtcttatctttagcttctgcagtaggatacccagactttttaaatccttaggcagttttacctaacagtctgatagccactgatcaaagcatgactccttatgattatagcaatatctcgtttatttaatgtataagtggaataatttcattaagctgctgattgttcttctctgttactggcattctggtctttatccagaaaacagtactccagtagcacccaactcatgtccatttccaccttttaaaagacaaagggtgcattttaaaaggcaaatatataaaaaatgatagagtttgggaggttttcattattgggattagaagtggcatttagtcaagcttataagcctgcctgtgtgttagttctctaaatcttcacatttcatgagttttcatttctgagatacaaactaataacttacacaaaaagcagccctaaactcccccaaggcctgtgtccaacaaggttcttagtaatcatttttagtctgtatcataggcaacagtggcatttatgctagaaaacatccacctcaacacaccaggattacaggtgtcagctccttctgtgtatataaaatggcctaatgccattcttgaaaatatgctttcagctgtgtatctttactttgtaaagagccctgtgtataggatttaacatctagaaaataagcaagcctcaagagttcagggctgcagtgagctatgatcacaccactgcactctagcctgagtgacagaacaagaccctgtttctaaaaataaaagtaaataaataaaagaaaataaggcaagcctgagccttgaaatgaattatctaaatgtggtacagttttatagcatgttccacattgagtatgtctgagcagggatgaactctatggtaacatgggtctttctgccacatttgggttgccttaagtaaatatgccaaagatccatcaaattactttgaaaagtacccagttgtacccatttgtgattatcctttaaagaaatactttcttcagagtagcaaaagtttctattgatttctgaatcttttcccagtgtcccccagcttcaaacttgggtgtgattttgtctccttttttctcatactcatatccagtcgatcagcaaattcagtaggatctgtcttcagaatatacactgaatcccaattatttctcaccacctccatagctaccactgtggtccaagagattgttctgtcttccatggactgttgaagtagtgtctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaagtagtgtcttaattggcctccttctatttatgtcccatatagttttaaaggaccacatagcagtggtccttttaaacggtgtcagattgtgtcgctattatgcttctgggtgtttgcccatgtggcccctctgtatggcttctcatcctccatacctgtctctttctcagattagcctgagtttcttacatggtagctcagcgctctaaggagtaagcagaagttgcctgggcttagaagtcccagaatggaatgcaactttctccccattctcttagtcaaagcccagattcacagaataggacataatctccgccttttgatgggaggagtagcattcatgtagagggagggctggagttgctggggccaatctgtggagattagttaccaccaccggaatgaccaggatgatttgaccctggctacttctccagccttaacttttccttgctcactctgttccagccacaccaggccctcttgttccttgaacatcccaggccgactgccacccaggacctagggtctcaaaatttccattgcctagaccattcttcctcgctgtctagtcctcatttccttcatgtctgagttaaaatgtcacctttttcaggaaatgatctctaaccacttaaataatcctattagttttttgttaattgctgcctaatcaccacaaacttagcaagttaaaacaatacgtatttattaattctgtgtgtagttctgagggtcagaagtgtggcacatagtggctgggttctctgctgagagcatctcaaggcttaaatcaatcaaggtgttgggctggactgagttctcatctggaagctcagagggaaaatcctcttctcagctttttttttttttttttttttgagatggagtttcgctctcgttgcccaggctggagtgcaatggcgtgatctctcctcactgcaatctccacctcctgggttcaagtgattctcctgcctcagcctcccaagtagctgggattacaggcacccgccaccacacctggctaattttttgtatttttagtagagatagggtttcacgatgttggccaggctgttgtcaaactcctgaccttaggtgatccacccacctcatcctcccaaagtgctgggattacagacatgagccaccacacccggccctcagctcattcttgtagtaggcagaattcagttccttgctgttgtaggactgaggcccccattttcttactggctgtcagctgggggctcctttcagcagctagagactgaccacattccttgccagctgtcccccttcctcttctgtaacccgttgaagcaaactctgtgcttgtaaagcctcatacgattaggtcagatccacctgagtaatctccttatcttaaggtcagctgatttggatccctcttttaatgacagcaatacctacattactgtttgaataactcagagaaggtatgtgtacaccaggggccaagagtcttggggaccagccaggtgcagtggctcacgcctgtgatcccagcactttgggaggccaaggcgggcagctcacctgaggttgggagttcgagaacagcctgaccaacatggagaaaccccgtctttactaaaaatacagaattagctgggcatggggttgtgcacctgtaatcccagctactcaggaggctgaagcaggagaatcacttgaacccgggaggcagaggttgcagtgagccgagatcacgctattgcactccagtgtgggcaacaagactgaaactctgtctcaaaacaaacaaacaaaaaagaatcttggggaccatcttagaattttgcctaccacaataacatacttttttcctgtccccttatcctgctttttcttcatagcactacctacattatattttctaagtatttgcttgtattttgtttgtttgtttgtttgtttggggggacagagtctcgccctgttgcccaggctggagggaagtggtgcaatctcagctcactgcaacctctgcctcctgggttcaagcgattctcctgcctcagcctcctgagtagctgggattacaggtgtgttctcctcacctttgcctcccaaaatgctgggattacaggtataagctactgcacctggctgcttctgtttttaatgtgcctttcacactaagagtatatgttagtgatgttagagactgtcatttttgttcactgttatattcctagtaccaaggacagtgtttggcacattatagaggttcagtaaatacttattgaatgaatcaattaataaaaaagacttcatgggaaatacggaatattttatgttatggaaaaaggtaaattgagcatatgagtgttattttagctttatgtccaaaaaggtaccacagagtctcagaatattcattggtttcttttcatgaggaacttcttatttgacaattaaaaaccaagttgttggccgggcacggtggctcatgcctgtaatcccagtactttgggaggctgaagtgggcagatcatttgatgtcaggagttcaagaccagcctgtccaacatgatgaaaccctgtctctactaaaaatataaaacttagccaggcgtggtggtgggcacctgtagtcccaatacttgggaggctgaggcaggagaatcgcttgattctccgcctgggaggtggaagttgcagtgagccaagatcatgccagtgcactccagcctgggcgacagagcaagactgtctccaaaaacaaaaaaaaagttgtgatgacggagcacaatagctcacacctgttaatcccagcactttggaaagccaaggcaggaaaattgcttgaagccaggagtttgagaccagcctgggcaacaaaagaagactccatctctacaaaaaaaaatgttaaaaattagcaggacatgatagtgtgtacctatatagtcccagctactctggaggctaaggtgggaggatcgcttgagcccaggagctggaggctgcagtgagctatgatctcaccactgcactccagcctgggtgacagagtgagaccttgtctcaaaaaaaagttgtgagcaagtaattgtataaatgtccaacaactgttgtatacaagaaaaagcaaattagatttttggcttgctagtaataacatgctttcagcttttggtttttatttgtgtatcttcaaatattaagaatgtcttctgcaaacttttggaaatggatgcttagtcttctagtattatagctgatttaccaactttctatggtatttctgtggttttccacgtaattgctaatagaataacagagtgggctcaatcatgtagacataatatagcatgccataccagaaaatcatatatatttccctcattttcaatactaatcattttatgtttcttttaacccccttctacagacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccaggtatgtctacaagtgtttgtaaaccattaatttgctatgatgataagagaactagatctccagctatatatctctctttaaaagtctttattggcttgatttttacaaattaagttccttaactgtacctttttgatataaagcttttttttttttttttttttttttttttttttttttgagatggagtcttgccctgtcgcccaggctggaatgcagtggtgtgatctcagctcactgcaacactgcaagctccacctcccggcttaacgccattctcctgcctcagccttctgagtagctgggactacaggcgcccgccaccacactgggctaattttttgtatttttagtagagatggggtttcaccatgttagccaggatggtctggatctcctgacctcgtggtccacctgcctcggcctcccaaagtgctgggattacaggcgtgagccaccacgcccagctggtataaagctttaaaaaaaaaaaaaacaaaaaaaaacaaaaaaaaaaaaactctagaaataaagactccttttttttttttttttttttttttttttgagacaaagtctcactcttgtcacccaggctggagtgcagtggcgcgatctcggctcattgcaacctctgcctcccagattcaagcaattctcctgcctcagcctcccgagtagctgggactacaggcacctaccaccatgcctggctaatttttgtatttttagtagaggcggggtttcaccatattggccaggctggtctcaaactcttgacctcaaatgattcacccgccttggcctcccaaagtgttgggattacaggtgtgagccaccgtacccagccaagactccttttacctatcttcttactcatgcccttctattcaacctatttttacccatacataggtccaaataaaatcttttctgaggtgttacctggtgtaagatgtgtcttttataataacacgtcttagttcatgtttatgtacttggatttgtatttctatgagaatatatcaacagaatatttaaattctacagatgggttgggcacggtggctcaggcctgtaattccagcactttgggaggccgaagtggatggatcacgaggtcaagagttcgagaccagcatgaccaacatagtgaaaccctgtctctactaaaaatacaaaaattagctgggtgtagtagcacacacctgttatctcagctacttgggagactggggcaggagaatcgcttgaacccaggaggcagaggttgcagtcagctgagatcacacccctgcattccagactgggcgacagggcgagactccatctcagaaaataaataaataaataaatagataaataaattctacagatgactaagaaacgtttttagttgaagtttttagaaagaaggatatctcataagccttgttgtggtgttaaataaatataaaatgatacataaaatcatttttttggaggatgctgtggtttttctgaatgcttaagggcagacaagaacactgccaaggtgtcagtatttggggggaatgctatttcaggaaaataggagtcttgtgtattcaaagtttattttaagagaaaaaaatcataccagcatgaatgaatcttatattaaatatcattaccttgttaggggaggggttttggttgttgttttccaattatagaagttataggaaacttagaaaatatttaaaaacatttcctagaaccccaccattcagaaagaactactgatttgctaagttattaatattttggcaggtagcctgttttctctacgtatgtgtatttgcctataaagctttgatcataaatgttttgtgaccattttttcttaatacattctcttaatgtatttttctaaatttgtgttctcaaaacatacttttcagttgttgcataatattcttcacaatggttgaagcacatattatttaacccctttattgaacatttaggtagtttcaaaattttttcatattataaaccatatgatgatgaatttttatacattaatcttgtaggaatcctaggggaaaaaatacagacatagaatcactatatattaaggaatgtgaacattttaaggcttttaatacatggtgccaaactatcccctaataaaaatataccagctcatagcctcccaactattaatactactttgttttatatttgccaattatacctttttaaaatttttgtttttctaaactaggaatttaagttgctgtttaaaacaaaagaagtacctatttatatcttaggaataaccactataaaaactgaattttacctatatcttttgttaaacagaatagatttttgccccctctttactcattggattttgttttagccataggcaaatagttttctttgtacaaaacagtctgtgtgtacctcattactttgttctccccagtcactgagacatgttactatctcaagcttataccactaagaattgaacaggagttgattagacctgtgtatcctttacctaatattgatccctggtttgtatccactgaccactctatgaggtattaaatcatcaatctaatgctttatggccatttaaacttataaacctatataccatctggctatgtttagtaaaccaaactacttcaaaaagtgcctgtagtccattaatgtaatgggtttgtttggagtgttaggtgaaattacttccaaagacttatttataggtacatggtgaaatgatcaggaacaatttgatggcacccattaaaaacacaggactgcattttggaaatttctgatggtgtagaaagttttaatataaattgtaccattactgtatttaacatgaagaactaattattatatctttaattggcttttgttcatgttcctttaataagaattgggtaatgcatgtctccatctgcttatgcttacatacgaacatgtgatgccagccaaacaaaatccatttaatgctttctttctcaagtctgctgaaaagtgtgactgatatccatacaatctttataattaaaatgatatgattcaggggaaaggcccaaaatgaaatgccatgttctctttcttgttaagtttgtgcctacgggagtgagagtatgaaggaatccttctgaactatttaagtctgtagaaaacctctgatatgtactttgtaaacagaaataactttgaatgtttttatctcagttgtaaatgtagaacagcaggcaaaagaagtttttttagtgagatcatcctattttataggatcttttcttctgagacctcagtacagatttgggtggtggagaactttaattgggaagcccttctggtttacactccccaagatctgttctccactgttttcctctgcacctcctacaaaatattctctgaaatgctaaccaagttatcttttggtctggaattttttttcatttttgcccaactgtcatttaggttttatagcagcagctactctcaaatatagtttttttaaatctgaaattaaacccattcttgaacttaaacatacatctctgtctttctcttgggatatttccatgccattctgtatttccttcttctctcctttctgcatgcccaaaattctataacccagcacattctgacttagtgcctctcccctagtacatttaaaggacatttcttttaccgaacagctttggaactacagcagtaatagaaacagaatgagaaatggacctaatatagagatttgggggggtctgaatcatagagtttgagatgccatccatagaacatcccctagtgctgaaatccatatagatagatgtgaattgttttctggaatcctttttatttttaatgtcttggggggtttgctggttgttagctttaacttccttatctaaaggaagatggaaaatactgttcatttctgtaaccttatggaaaaattattgacactcattttacccaagcctctgtttgaaaaagaaactggaccacactagggacaatgatgtgccttcatagcagaacaaatgctgttctgttttaaaggaccttttgtaaaaaatcattcgccaccttctgtgttctttttctttgcctcctccccctactgaaagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggtgagcctttaacttttcttactcttatacggcttcaggacctggccattcacagtcactgaaagatttttggggagccaatgagaccacttctcatttaatatggtgattttgttgatttctagcttaaaatgtaacagagaacaaatgttcatatactcagcagtttttcttcttacctgtcactcacaaaatgacatgatattgtattaatactgctttgcaaaaaataatggaaagctgatcagccctcctgtttaaaacattctgttatctgggcagaagttggtatcctgtggctgggcacagtgcgttcacgcctgcaatcccagcactttcggaggccaaggtgggcagatcactcgaggccaggagtttgagaccagcctggccaacgtggcgaaaccccaactctactaaaaatacaaaatttagccgagtatggtggcgtgcacctgtaatcccagctactgtagaggctgaggcaggagaatcgcatgaaccctaggtttctttcagaaaatttcttgcctttatcttatgcctctggtgttttgtcacctttgtaatcaaaaattatttttaagcccaagtggaataagaactctagccatcagaaaaagtgaaaatgaaattaagtataaatcattgtttcttcttaagacttctgtttttcaagattttctgacttaattccgaattccccaaagcatcatatagttagcagtctaagagacttcactaatttttttgttgttctcttaacagtactatttcattagaacttctgaaagatatctttctttaaatacttttctctcagagtatgtctctagaatgtcactataggaaagctacgtagtaatagttcacaaataaaggtgacatattaaatattctcattgacagaaaaaattataataggcatgtgtgtgcttagtgatgtccttccaaattaattttatcagttgtttatcttggatcataaagaggaaaacagttaaaagtagagaacacttttaaaagataaatattcatgggccagctttcctttgaattttcatgaaaaagtagttggctctctttctttttttctatctttgaaatttattaacacataataaatacaatgacctataaatattataccaaatgcctcagatttttatcattctggctattaggaagactgtttaaatttttctctcaaattgaattaaaggaacaaaaaaactaggcaatttttaggctgtgtaacaaagaatattgttggccgggtggggtggctcacgcctgtaatcccaacagttttggaggccaaggcaagaggatcgtttgagcccaggagtttgataccaggctgggcaacatattgagacctcatctctacaaaaaaatcaaaaaattagctgggcctggtggcgcatgcctgtaatcccagccactcaggaggctaaggtgggaggatggcttgagtctgggaagttgaggctgcagtgagctgtggtcatgccactgcactccagcctgggcaacagagcaagaccctgtctctttctctgtctctctctctctctctctctctctctctcacatacacacacacacacacacacacacaaaagaatattattactacttctcaaatatgttttttaattcttatttcgctacatagaaaaatagaaatctttcataacctacttcatactttggaaataaactctttaatagtacaacaaagcaaataaaaatggagttatatggtattcggggtccatcattttgctaagagtgctgggaccagccttggggatacagcaggcagttgcttacatgagaaaattttagggcagctgagaagatttctgtatccctcagaaaaaaagaatctcgtctccaaataactcctgaaatttcagttaaggagattcattcctttagctataaaggttctgttacctgttaaaatacattgtgttcccatttggactgtaaatgacagtaaaccttcatcataaattgggagtttactgagtccttttttgaaggcagaaagatcaagaagtaagtgggcagttcttggcagatggatgtgaaaatgccaaaggtaaaaggctccacagttttgcttgggattggcactaaatggcaagatcttttatgttagttacaaagaaaaaacaatcattgagaagatggcttttgagcctttctaaagggtaggtgaagtaatccaggatccagcactaattaccacttttttcccctatctctttatccacagaaacccattcccgctcttttgagtatccttcagagttctgactatatccccttgtctttgggcatgtttatcctcttaatcccatgataaacccatgaaattccaaatacttatacatcccgtgtcaacttcctccattattccctcgactttcttgttgctgcttctgtttttacatgttgactttattcctgtgtcagttttcttcccttttttaaaaaaaaatttactccatcagtttctcattttcttctttcaagttgtcttaccaagcctaatacgtcaataaagtctttctgtgttatacttttccccatatgctagctttgaaaggttcttccatttctactaaccaaaaatagtaagtaaatacagttttctaataaagcttttatctctaagttttaacttggtatttgatgttgtattttatatctagatggatttgacagtcttcccctgggacatgaactctgtagttttctctcttgaataatactgaatatgctgtctgctcagtaatggtaactcttaaaagtataataaaagaccacttgggaaaagtcaattttcttaatcagcagatcacattttatgataacattctgaatttaatatttaacgtttatcatgtactcacattcttgtaggtactaggcatttcacatagaagtagtccctgttttcaaagatcttccatcataaaaggttttgacttaaaacataaagacagaagccagttttcagtacctagccacctctttctgtaacactttgatttgaagaaattcagatactttaccaagacatggtaaatgcagtgaggtggaaaacaagatcagaagcttatgtgagttctctttccttagaatgtagatagtatcattgcataggaagaaagtcttggagtgctagagattaaaagaagacaggaatctcaggaatggtgggcattgagaaacaataaagtagttaagaatgtgggtgggctcaggagtcagacttaaaatcttcacattcaaaatctattatttgcctgcaaagtgtttgtagaataatattgtacagagaaatgtaccattaatctggaattctttcataacgcatcttgtttccccttttgtttatgctggtgtatcatgtttcattaatccccctttttataagtattattttcacttctctatttcagattttcttttctgtattaacacagaagttagagccatctaccttcctgataggaaattttctcaactaattttcagggtatataacagggagagggcaggggagaaacactcctggagacaccaaacaattaattatattgtaatggagctatagagggaggagtggatgactggcccagagaaaacatgatttctctggtgccaggattacactcagaggcatttctgcctctctccactttgcaaggcacggtgccagtgagaacagcagttagtacacccatagtggggtttactagcttccacaccgtgtttggtgggttcttaacttccggatgaggaattaaattttttacccagcaggaagtgattgccatttactgattttttttttgtagcaaagatctagcttgggatacgagtattccagagatgtgctgtcataaggaaggagatactaacaaatgttgctcactggaatcagggaaggcagttaagtacatgtgtatgtacacagccaggaacacacctgtgaaagtcagtttcatgccttagacttgatagcagtgctcttaggcatttcttttttttcttcttccctagctgctgctggacacacctgtgatccttttgttttctgatgaaatgaactgaattgctcctttcaaagcatagttgcactgattagcagcagcctgggtgactgagcagccaccacaccttaccctgtacaaataaagacctagcaaaagtgatctccatgccagaggcattgctgctgtctacaatgctggggaccactgacacagtaaaagggaaaaaaaaaaaaacctatagggcatgtgctagttcaaaggtaatagttaccattactaacaaaatttccaaaagatgaggccagtgaatctaagcagtagtcttaatagagcaatagatgaattctgattgtacatattccatttgtttactgatattataatattcctaaaggcttggtactccgatgttctacactggaaataatcatgttttacccaaaagcaaatcagtgttggtcagattctttagagcccagaaggttactctttgacatgggactcctgaaatcaggcttacctttgctcctccgcagacagctatggagagtatatggaatggtaaccgtgaaaacactttcaaaatatatgaagttccttataaatatataatgtcggccgggtgtgatggctcacgcctgtaatcccagcactttgggaggccaagcaggcgggtcatttgaggccaggagttcaagaccagcctgaccaacatggtgaaaccccatctctactaaaatacaaaaattagccagcatggtggcagatgactgtaatcacagctactcaggaggctgaggcaggagaatcacttgaacccaggaagcggaggttgcagtgagccaacatcacactgctgcactccagcctgggcaacagagcgagactctgtctcaaaatatatatgtatttaaatatataatgtcatgattttcactgggaaatatttgttattttttaggggacagtatttattcaaaaacaaacctcctgacgggaatgctcctcccaactctttttatagagcactttatcctaaaattatacaagacattgaggtaagaatctatgtattttggggtattgcccaagggcacagaattatcagcattcttcagtcacagtatggttacagcaagcccattaaggtttattgacatgagttgggaatcaatctcttagctggccatggtggctcacacctgtaatcccagcatttttggaggctgaggtcaggagtttgagaccagcctggctaacatggtgagacccctgtctctactaaaaatacaaaaattagccaggcatggtggcacacacctgtaattccagctactcaggaggctgagataggagaatcacttgaacctgggaggcacatgttgcagtgagccaagatcgcaccactgcactccctcctgaacgacagagcgagactccatcaaaaaaaaagaaaaggaaaagaaaatcaatctctttacaggcgagtagggtaggtaaaataaattgctaggcaaaattttaaagctttaaaaaatggtttactaataagtagatgagagagttaaagagattgatcccttcatacatagcagtgtgactggtaaacttgtactcataagctcatatttaaatatcttctgaattgaacctccttagaagttcatcagtagcaatcagtagcaatggccatcacatatgtaagagcactgagtgtataacctcacgtagttcgtagcttttcttctcttgatgagtagtctctttccaccagatttattatttaattgaacaaattataggcagggaagttctaggaaacaacctttaattaccttgcaaaaggaagaatattttataaatatagatagtagccttttaaagacattttttagttttccctaagttgtgtatatcccatagagtaaagcattgagccattgattgtcattaaagcctaaaaagagtttgattctaggtgtttcctaacactgcctctttcccattccttcttctcagacaatagaatctaattggagatgtggaagacatagtttacagagaattcactgccgaagtgaaacaagcaaaggagtttactgtttacagtatgatgatcagaaaatagtaagcggccttcgagacaacacaatcaaggtgaggtctattcagttgtagaaaggtagcagagggagcaagagtgaccacattcatagcgcagtctaaagcataaactctaagcattatttctagaaagtaagtgaagattttagattgtttccagtcccaaagccaaaatcatttccttaaaggacagacatcagcttccccactatacaaacgggtagtcctagggttaaattctcttcttgaaatgcactgaatgggctgttactcttttggccatcacataattatagactaccctgttccttaatgaaaaggataaaagtttgcattagtactgaagctatatgtgtgtgtgtgtgtgtgtgtgtgtgtgtgtgtgtgtgtgcgcgtgtgcgcgcgcgcgcgcttagctatacctatagaaaatgcattccacactactctgggctttgattattttgggggatcagacacgtaataggaccaacaagtctccacagcaccccatcatcacattgatcaaaaggatcttatttgccatcctagatctgggataaaaacacattggaatgcaagcgaattctcacaggccatacaggttcagtcctctgtctccagtatgatgagagagtgatcataacaggatcatcggattccacggtcaggtagaaaatttcaaatgcttttttgaactctgaaatatcagctctgctctgttctttgtcatagatagtaattttgtatatatcggcacagttctgaaactaaagaagaataaaccaccaggtccccatcatttctgtcagtctagaactagaaaacttgatttagaaatgcttgaggtaagtttacattttcgcacattgaagaaactacacattctattttaatttggaggatcatctattacagaaacttttcttatccttatggtaaactttgcattccttacaaaaaccacctcacgggggaatgatatgaatgcaatgaagccttcctttcaggtagtggtaactgtagtgcaggtctgtattatctcctttgaaacatgtacaggtgagctgtgctctctttgccagcccctcccctgccatccctgcagtttttaattgcaagcttcactcaggtaggggccctcaatttccagaggcattagtgatttgatgacacagccattatactgctggagtccaggatagcttgagttctgggtaccagcagcactgctgggaacctctgttaggaattttgccgtaagctaaaggatttagcaaacataatgcatcaaaagtaactttaaaaaaaaaatagacctaggaaaaaagcggttaagtgcattgttagatactctgaagttaaatgtttaccattccaagttatcctctgtgaatagaaaagacggttcctgttttttgtcttttgacttaaaggcatagcaaggcatagcaaacttggcccttgtagttactgacatttaacatttattggtgcttgtggagtgagtgccccacagaatctaaaacactgcaggtgctaacatcatttataagataaagaaaaaatgatattctataaaagggggctaaactggaaaaaaggaaataacatgttataaaaccttaagtaaatacacaaaaatagaataatcaaaatatataatcacacaaaattctcaagctatccaagggccccacactctgctgtgaagcccatatttacaatggggggtctattttaaacccctacccacttcagaacacagaaatgggggcttagaattagagtcatggttatcttggcctttgacctttatgataaaacctgagatccagggtaatcaaactcaaattcacattactaagtatgtgacagaagcatcttggcctatttcatttctggctcctgagggctatcattggaatgggcactaatgctattgttattaatcagattcctcatttaaaatgtatcttactaatggtatcaaattgaatgtgagaagttttacagtcttcaagtctgggccaaattattaggtgacagtggctgccacttcatccttgccctccacaacttgcccatatttcaagcagtatgtcttaaggacacactggcagcatcccatccccttccttctcccactctcccagtctggccctctctctaaatataaggggtggaagggcgcatgatggtcaaatataggtaacagattgtagcttgagtaccatctaaatctcatctatcacttccagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtaataaggcatttttcagtaagtttccaacttagaatgggggaattcatatgaaaatttgatcaagggcaatttcatatttaaacgttgctacagaaaaatgtaatatttaattcagagactagtctacaagtgaaaaggtgtaataagtgagacgttgtgtgacaatttatcctagatattttattcctataaatagtggtgagtgtgagaagagactaaccctagaagagtaaatcaatctgaggaattctcatgtggtaacagccaactgcaaattagcctctgttaccatgaatttaaattgtcctttgttttatttgtttgagaagacttccctctaatggttcagtcctgttttctgcttctctaagactccatttgccatagattttaccaataaaagcaccaaatcaactgctcaatgccattttctttttcaggtatggaacacaagtacttgtgaatttgtaaggaccttaaatggacacaaacgaggcattgcctgtttgcagtacagggacaggctggtagtgagtggctcatctgacaacactatcaggtgagcagcaagtgccttgtatcataagggatcaatattatgctcccattcattattaatgcacagatcatacaagtcttcaattttgttatgtttataatcaactgtttttcctttctgtagcttcttacaggtcagaagtttgccccaggcagagaagcagcacagcaaagccttttgttgcccttctttttaaatttctcctgtctaccgttgaaaagtgctaataaacagctaacagccttttctttgccattgtttttaagaaatgaaaagaaagatttgtttccttactagaaattatgtaatttttgtcttagcattacataattggccagagagttacctgtctttgaaattatgaagatttcacagttggaagtcctttttggggttttcccttcacaaagatgaatgacatagatatgattataatttggaagatttatccatcctctcccttcagtgaagtattaaaaggatgaaaaggccattaaaaaagagctactgtttgttatatctaaggaaattattcctagaaatcacttgaattgctctgaaaacgtacagtttttataattagtacacaaaagttcttgagaactgactttgcatttctattctctgagaagagctgtcctggacagtggtgaaagaagtgtctgccgtggcagagggggaggtgctttgtgagaacaggacatcactgataatctgtatctctttcagtttggtgacttcaggaaactgctttcttagcttggtcatttccttctcaggcaactgcgtgcattgaattcgtttttatgcctggaagaacctgtttacagaattatgtaaagccctgtgctttgaaaatacattttacatttgaacttaaacctacatatttctgtgtgagttatatagcagaaaggaaataaattacattgaaagcagtacatatctgtgtgggtggtgattgattttattttatgaatttttagaaggcatatgaggtgtattgttataacattccaggcttagaaaagaatacgtgaaaattcacctgacttaattttctcttccagattatgggacatagaatgtggtgcatgtttacgagtgttagaaggccatgaggaattggtgcgttgtattcgatttgataacaagaggatagtcagtggggcctatgatgggtgagtgtgctaacagagtgtaaaaaagagaaaatctacgtcttaatccttccttatgtttatggtgttaaacataaccattccttgtttctaaaagcttatagattttacacaaaatatctgataccatatttctttaatccgtgtatttacctctccttggtttagtgtcctgaaatattcttcccattcattttattatacttgtttgcacatggttgtcattcatattttggttatttggttatgtatttgactgttttgccctgtaaagcaaagaacaagaaaaacccagtgttaacaggctacccatgtaaaagggtaacctgttaacaaaacagaaacactagagggcagtatttggggacttagtgtggtaagatcttgaattttgatttcttgggttttttatctctttgagtaatttttaagagtacagttctcttgtcatcacttgtcatcctagcatttcatttatgagtttagtcatctttattttcttctaatttctagtggttatggaatccattaattttgtgaatggaccccatgtccaccaatcctaaacacagagtaaattcaaacaaaagtagtctgggcacaatggctcatgcatttaatcccagcactttgggagaccgagacaggtggatcatttgaggtcagtagttcgagaccagcctggccaacatggcaaaacccagtctctactaaaagtacaaaaattagccaggtgtggttgcgggcgcctgtaatcccagctacttaggaggctgaggcaggagaattgcttgaaccagggaggcagaggttgcagtgagccaagattgcgccaccacactccagcctgggcaacagagcgagactccgtctcaaaaaaagaaaaaaaaatagttattcacttaggaagaactcttatcatttctttttgtcaatctgcctgattttggcagctttttaaatatcagaaactaacaacattattttagttcatgagttaactacactgatacattcattagccaatgcaagcagcaggaagtgtagactgctcacttcttctgctttgggacagccatcactgttacaaccttgggaaattgttcagagtgtggtgacatgttccagcttggtcaagacaatattttcttattgtcctggctttgatctgtacccacctgtcttggaatttgtctgctatgtaccttgaggaaacatggcctattaaaagatttttggaagagctacacttatcttatttaaatcaaaagatgagggcttgcttatataaactccattgctcttacatggaccccagtccctcagtacatgtgacctgggccactcttagaagtgcccaggaagaggatgcttcacagttgtagatttctaggtctgtgtaatatcattaaaaggtctaatgtacaagatctcctcttgatcccaaagtatggtataactttactgttaactgtcttcagtttggttaaagctagcctgtttctcatttgtaggttaatcacgtacatttgaactatactcaccatccatatttattgccatgaatttctgctattcttccctgccttctcttacatttgcttttaactaacatttttgtcccctttttgatctttagaaaaattaaagtgtgggatcttgtggctgctttggacccccgtgctcctgcagggacactctgtctacggacccttgtggtaagagccttgctgtttagagagcattggagagcaggtgggggaagaaattaaacgttgatgtgctgtggaatatggatttgaatttaatagttacaacctcacaaaacctacaactaagtggtaaggcaaccagtacatgacaataaaatatgtttatataattcctttcatccaaaaatgctttagagactatatatggagagaaatgtggcagctgtttaacagctgcacagcaactctacacaacagtttagtgcagggagtgaataagaattctgtatccaccagaaacagcagggggtactaagggagagagaatataattattcaaattggaacctgtccaaaatctgaggacctgtacacctgtgccttcaaaaagtgccctgggggccgggtgcggtggctcatgcctattatcccagcactttgggaggtcaaggcagatggatcacctgagatcaggagttcaagaccagcttgaccaacacggtgaaaccccatctctgctaaaaataaaaaaaaaattagccaagcatggtggcaggtgcctgtaatcctagctactcaggaggctgaggcaggagaatcacttgaacctgagaggcggaggttgcagtgaaccaagatcatgcttgcactccagcctgggcaacaagagcgaaactctgtcttaaaaaaaaaaaaaaactgccctgggaatctgcatgaatccccctggtcaaccccttagttctgcagcctattcatgaggtagtgcctccagcaacttgagcccatcttttttgttccccatatacccccttttgacatttggggaaaaaagtgattcaaaaggaggaatgcactaaattatttatcatgttgttagccaagggcccagattgataaatgctgcttccattagaaaattagttggagcaacagggtggacagacaccactcggagaaaagatgagagcaagcatttgaagcccagtgttctaaatcctgactgtcatcatttaggcattcttggctctggagaagagaaagaggttacatttcttgtcttccttgttggatttatgtgtgtatgtataagacagggtcttcctctgtcacccaggctatagtgaagtggcactacatgttgctgatgtatatcaatatttcatttcttttgaaaatttgctgagtagtattctattgtatggttatacccattcactgattgtttctcgtttttggctattaacaaagtttctataaacatttatgtagaagtcttgggatgaatgtatgctttttgcttttatttctctgaggtaaatacctaggagcagatgactaggtcatatggtaagtgtatgtttaaaatttttagaaactgccaaactgtttttcaaagtggtttacccttttacattatagtatatagcagtgtatgagagttccagttactccacattcttgccagtactgagcacagtctgtaatttagtcattctcattgtggtttaattcgtgtatctctaatgattaataatgtcaagcatctattctttgccatctgtatatctcctttggtgaagtgtgttcaaatcttttcccattttttaattgagtggttattgagttttgagattcttttatatattataagttacaaatgcattatcagatgtaattcacaagtattttctccacgttcataaaatttgtttctttgttttcttaaaagtgtctttcaaaaagcggttcttaattttaagtctactgcattgactttttctattatggcctatgttacttgctgttgtatctcagaaaaacctttgactaatccagagtcacaaggatttttccctgtgttttcttctctaagttttataattttcagtttgtattttggtctatgatccattttgagttaatctttgcatatggtacaaggtgtagatcaaagggttgggcttttttacacatgaatatccagttgttccagcaccatttattcaaaagactgtcctttcgaaatgcttttgcagctttgtcaaaaatgaattgaccatatatgtgtgagtcttctttgggaatctgttctgttccattgatttttgtctgtcttgattccagtataattttattttgattactgcagctttttaccaactcttgaagtcaagtaatgtgagtccttcagctttgtctttttcaaagttttttggggcctttgatttttcatgttaattttaaaatcagtttgccaagttcaaccaaaaaagtctgctgggaatgttttttaattttttaataaataaataggtatggggtctcagtgtgttgcccagactggtctcaaactcctggcctcaaatagtactcctacctcagacatccaaagtgcttggattataggcctgagccactccatctgctgggttttttgttggacttgtgttgactgtagatcagtttggagaatattgacttctgaacaatattgagtctttatctctccatttgtttaggtctttttaactttctcagccacgttgtagcttttagtataaaggttttgcacatctttttgtcacagttatccctaaatattttgtatttttaatgctattggaaaaggtatttttaaaccttggtttctgattgttcattgcaaatacatagaaatatacttttacttatttcccaatctatgtatcttttatttctctctccctcttttttttttttcttaattgcactggctaagacctccagtacaatgttaaaaacaattggtaagagtgaatgtcccttttttgttcatgatcttaggcgaaaggcattcagtctttcaccgtttcacatatgtgtatatatagatgtatgtcagctatagggtttttctcttttttttttttgagacggagtctcgctctttcacccaggctggagtgcagtggcgcgatctcagcgcactgcaagctctgcctcctgggttcacgccattctcctgcctcagcttcctgagtagctgggactacaggcacgtgccaccatgcccggctgattttttgtattttttagtagagacggggtttcatcatgttagccaggatggtctcgatctcctgacctcgtgatccagccacctcagcctcccaaagtgctgggattacaggcgtgaaccaccgcgcccggcctagggtttttcatagtgacccattatcaggggattaggcagttcccttctgttcctagattgctgagagttttaatgaggaacacatgttggattttgtgaaatgctttatctacatccattgagataatcatatggtttttcacttttattctgttaattggtatattacattgaattttttttagctttaaatcctttgcattgctggtataaacaccacttgttcatgaggtataattctttttatgtgttgttggattcaccttgctaatatctttttaaggatttttgtgtgtgtgtgtatctgtgtttgtaagggatattggtttgttgctttattttctgtgtctctggttgactgtcatgataatgttggccttataaaattttgaagtgttccctcatctattttctaagagtttgcatatgtgatattatgcttctttaaatgcttgatagaattcactagtgaagcatctagacctggaattttctttgtggaaagttttaattacaacttcagtttctttaataaatacagcactcttcagatttaatatttcttttgaagtccactttaatacttttgtcttccaagcagtttggccgttttatctaaattatgaaatttattgaaataaagttatcatattcccttattatccttttaatgcctgttaggagcatagtcctgtttccttttttggtttcattgattttttttttttatttttctagcttcttaaggtagaaactaagatcattgactttgaacctttttttaaatataatcagttgaagctataaatgttattagaagtaattctaatcactactttagccacatcccaaaaaatgtcaattaagtcaagttggtttataatattcaggtcttctgtatccttagtgatttttctattcgtccttaccaattattgagagaggaatttttatgtctcccactatagttttgaatttgtctatttctccttacagttgtgacagcttttgcttcgtggtttttgtttgagacagggtatcactatgccgcccaggctggaatgcagtggcacacccatgactcactgcagcctcaacctcccaggctctgtcaatccacccacctgagcctcctgagtagctgggaccacaggcgtgcgccaccacgtccagctaatttttttgtatttttttttagagatggggttttgccacattgcccaggctggtctggaactcctgggctcaacctcgacaaagtactgggatcacaggcatgagccatggcacctggcctgcttcatggttttttttgttgttgtcgttgtttttgagacggagtttctctcttgtcacccaggctggagtgcagtggcacgatgtcggctcactgcaacctctgcctcctgggttcaagccattctcctgcctcagcctcccaagtagctggcattacaggcacctgccaccacacctggctaattttttgtattttcagtagagacaggattttgccatgttgggcaggctggtctcgaactcctgacctcaggtgatccacacacctcggcctcccaaagtgttgggattacaggcgtgagccaccgcacccagccacttcttgtatttttaagctctattattgggtacctgcgtgcttaggatttttgtcttagtgattaactgactttttaacattatgaaatgtccttctttgatgtttatagtattctttgttttgggaaattaatactttgatattatatgtaaacattctgcttttttatgattagtgtctgtgtggtgtatcttactatattcttttacttttaatatgcctgtgtctttatatttaaaatgaatttctcatattcagcatatagttgggccatgtttttttttgttttttttttttcttaatccagcctgaccatctctgcctttgtcatgtttagaccatttatgtaatttttgtatgtttggatttaaatctatcatgttgctatttattttccattttttgcttttgtttgttacctcctgttttcatgctcttttttttttcttttttatctcagtttagctcctattatgggttcttagttatatctcactaatttggtgaggagggacctagggtttacaatagttatctctaatttattgcagtctactatcagatgatattgtaccacttcatgtataatgtaggaaacttaaaacactatatgttcatttttcacccccatcctttatgctattgttgctacagattttacttctaaatatgttatcatccccacagcacttgttatttttgctttaaacaatcaaccatcttttaagatttttttgtttgtttgtttgagacggagtcttgctctgtcacccaggctggagtgcactggcgtgatcttggctcactgcaacctccgcctcccaggttcaagcaattctcctgcctcagcctccagagtagctgggactacaggcgcccgccaccacacccagctaattttttgtagttttaatagagatgggatttcaccatgttagccaagatggtctcgatctcctgacctcgtgatccgcccgcctcaggttcccaaagtgctgggattacaggcatgagccaccgcagctggccttttaaagaaattttttaatggaaaaaagagagtttatttttacccacacgtttaccttttctattgcctcccattcctttgtataaattctatttccatctgatacattttccttttgcttaaagaacttactttaacatttcatgtatgcaggtacactggtgacaaatactttcacttgttgtttacttgggaaagttttttttttttttttttaagggatggggtctcattctatatcccaggctggaatgcagtggcatgatcatagctcactgcagccttggacttctagtctcaagcagtcctcctgacagcttcccacatagctgactacaggcttgtgccaccatatctggctaattttctttatttttttagagatagggtctcattgtgttgcccagactggtcttgaactcctggcctcacataatcctcttgcctcacaacctcctgagtagctgagattattacaggtgcaagccactgcgcctggctctgaaaaagttttcgttttgccttcatttttgaaagatatttttgctggctaaataattctatataggccaggcatggtgtctcacacctgtaatcccagcactttgggagtctgaggcggtggattgcttgaactcaggagttcaagaccagcctggcaacatggcaaccccttctcttcaaaaatacaaagattagctgggcatggtggcacgtgcccagtgcaacaacttttgggtggctgaggtgtgaggatcatatgagtccaggagattgaggctgcagtaagccacagatatgccactgcactccagcttgggtgagaatgagaccctgtctcaaaaaaaaaaaaagaaaaaaagctagattgacagtgtctttcagcactttaatgatgtcattccattttcttctggcttggtttctgactagaagttggaagtcactcatctccattctgtatctttttcctctgggtgcttttaagattttctctttatcattagttttcagcaatttgcttatgatgtgtcttggtgtggttttgtttgtatttttcctacttcacattaaaaaaatagaaattgtcagagcaatttgaagaagaaggctaaacttatgttgtctacaagaaagctactttaactataaagacacatacaccttaaaagtaaatggttagcgaaagatataacacatgttataggctgaattgtgttcccctaaaatttatatgatgtcttaaccaccagtacctcagaatgtgactgtatttggagttataggagctttcaagaggtaaataaggttaaatgaagtcattggagtaggccctaatccaatatgactggtgtccttaaaacaagaggagattgggacacacagagaccatgtgaagataaagggagaagatgaccatctacaagtcaaaggaagaagcatcagaatgaaaccaaccctgccaacactttgatcttagaattctagtctccagactgtagggaaattaatttctattttttgagccccctagtgtatgccatactttgttatggcacccctagccctgatggaccattctaacactagtcagaagaaagttggggtagctgtattaattagagagagagcaaacctcagagcaaagaatattatcagggataaagagaagtgttgtataaggataaaggggccagttctccaagaagacctaacaatccttaatgtgtacacacctaacaacagagcatcaaaacatatgaggcaaaaaaccatagaactgcaaggaaaaaatagatgcatccactgttatagttggagacttcagcaccccctatcagtaatggacagatctggcaggcagccaattcagtaagaacatagttgaatttagcagtaccatcaatcaagtggatataattgacaactatagaatgcttcatccaacagcagcagaatacacattcttctcaagctcccaaggaaattacaccaaggcagaccacagtcagggccataaaaggtaccttaaaaaatttacaagagtagaaatcatacagcatatgctctcagattacagtggtattcactaatggaaagatagctgaaaaatcccaaaatatgtggagattaaacaacacacctctaaataacacgtaggtcaagaagaaattgcaagataaattgaaatgtatttttttttaatttttacttttcatttttgtgggtacatagtaggtttatatatttatggggaacatgtgatgttttgaaaagtattttgaagtaaataaaaatgaaaacacagctatcaaaatttgtgggatgcagtgaaagcagtgcttagagggaaatttatagcactgaatgcatatcttagaaaaggtctaaaatcaatagtctaagcttctactagagccaactaagaaaagagcaaattaaattcaaagtaagtagaagaaaagaaataacaaaaactagaccagaaatcagtgaaattgaaaacaggaaatcaatggattacatcaagaccaaaagctagttctttgaaaggatcaataaaatggatgagtctctagccagactatgaaaaacaaagaagacataatgtactaatatcagaaatgaaagagatcccagatcttcacagaatcaatacttaataattatctttccaaacagagaaactaagcctaggcagatccactggtgaattctaccaaacatttgaagaagttatatcaattttctgttatctcttctataagataaaaacagaatgaataacttactaactcatctatgaagcattaccctaaaaccaaaaccagacaaacacaatataggaaaagaaaaatacagactaataatggctaagctatgaagttcaataggttaggcagatcaaatgcattttcagcttaggatagtttcatttacaacaggttcatcaggatgtaacccattgtaatttgaggagcatctgtattttaaactatttgattcatgcttgaacccgggaggcggaggttgcagtgagccaagatcacaccatttctagcctgggtgacaagaacgaaactccatctcaaaataaataagtaaatatatggtttttcttttttttttttttttttttttttttgagacggagtctcactcttgttacccaggctggagtagtgcaatggcgcaatctcggctcactgcaacctccacctcctgggtgcaagctattctcctgtcacagcctcctgagtagctgggattacgggtgcctgccaccacgctcagctgatctttgtatttttagtagagactgggtttctgcttgttggccaggctggtctcaaactccggacctcatgatccacctgcctcaacctcccaaagatctgggattataggcgtgagccactgcacccggccatgtatggtcttattattgcccttatgtttagcaatttcatgatttctaaaatattttaaaatgtaataatgtgccaataaaatgtagtaactctgaaattttttaaaaaatctcgacaaaatattagcaaattaaatccaacaatgtatgaaaagaattatacactgtgaccaagtgagatttatgccaggtatgcaaggctggttcagcattcagaaatcaatcagtgtaatccatcacatcagggggctatagaagacaaatcacatgcttatatcaatggatgcagtaaaagcatttgacaaaatccaacacccattcatgataaaaactctcagcaaacaagggatagagaggcttttcctcaacttcataaagaaaaatgcaaattaaaattatagtaaaatactactacaaacctaccaaaataaatgtaaaagattggtaatatcaatttttggtgaagatgtggagtaacaaactctgataaactgttggtgtgagtataaattggcatgacttttaaaaaattgtttcatagtatcttctaaagccaaacatacacctaccccgtggcccagcaagtctactcctagttgaaatgggtgcatatattcagcaaaagacacgtacataaatgttcctagcagctttgttttataatagccataaactataatcagcccctatgtccaccaacaagagaatagatggattgtagtatattcatacagtggaatatcaaccagtaataaaaaagaatgaactactgttttacatgcagcaacatagaagaatcttataatgttgactaaaagaagccaggcatgagctgggctcagtggctcatgtctgtaatcccagcactttgggaggctgaggccggcagattgcctgagctcagcagttggagaccagcctgggcaacacggtggaatcctgtctttactaaaatacaaaaaattagccaagcatggcggggggcatctgtagtcccagctacttgggaggctgaggcaggagaatcgcttgaacctgggaggcggaagttgcagtgagccgagattgcaccactgcactccagcctgagcgacagagcaagactccatctccaaaaaagaaaaaccaggcatggctgggcacagtagctaaggcctgtaatcccaacactttgggaggccgaggtgggcagatcacgaggtcaggagatcgagaccatcctggccaacatggtgaaaccccgtctctactaaaaatacaaaaattagctgggtgtggtggcatgtgcctgtaatcccaggtactcaggagactgaggcaggagaatcgcttgaacccaggaggcggaggttgcagtgagccaagatcgcgccactgcactccaccctgggcgacagagcgagactctgtctcaaaaaaaaaaaagccagacacaaaagaatacatactatatgattatatttatatgaaattcagtaagagactaaacaaattaataacaataacagcattgggccaggcacagtggcccacacctataatctcagagctttgggaggccaaggcagaaggactgcttggtcttgagttcaagaccagcctgggcaacaaaaagacctaatctctacaaaaaaaaaaaaaaaaagccaggtgtggtggcatgagtctatagtcctcactacttgggaggcttaagcaggaaaatcacttgagcccaggagtttgaggttacagtgagctatgatcacactaccgcattctagcctaggtgacaaaacaagactctgtctctaaaaaaaatgatgatgatgacacctgtaatcccagcactttgggaggccgaggcgggtggatcacgaggtcaggagatcaagaccatcctggctaacacgatgaaaccccgtctctactaaaaatacaaaaaattagccaggtgtggtggcaggcgcctgtagtcccagctactcgggaggctgaggcaggagaacggcgtgaacccgggaggcagagcttgcggtgagctgagatggcaccactgcactccagcaggggcgaaagagcgagactctgtctcaaaaaaaaaaaaaaaaaaaaaaagatgatgatgataaaattggagtggaggtaacattgtttagtaaggggtgtgagattgttttccagtatgctgggaacattctacatcttcatcagggtggtaactgccagtggtgtgctagaacaggctcatactcacttatgagagccaactattagatattcatgaattttgccagctggttgactatgactagcttataattggccatgataggagtttttaatgccgtggaaatctaccgatggttttacaaagtagcaaagtttggttgataaacatttatcagcatactgcttcttattgctcaccaatccttgacctctgattgtagaaggaacttagaagataaaaaccagggaggtagtaaggaatgctctcatccaccctacgccaaaaagggttggccatgagaaactattaatagcatgctatttagcatgtcttggccaaagagtattgctttgtttacagctgcctagtatttgacttttccatgctgcctttagccaaagtaaattttctctatttttttaatttatttatttttattttattttttttttagacagagtctcactctgttgcccaggctggagtgcagtggagtgatctcggctcactgcaacctccacctcccaggttcaagcaattcttctgcctcagcctcccaagtagctgggactataggcacatgccaccagcccggctaactttttgtatttttatagagatggggtttcactgtgttagccaggatggtctcgatctcctgacctcgtgatccgcatgcctcaggctcccaaagtgctgggattacaggtgtgagccactgcgcctggcctctttataacagcaaaccatagcctttccgtagactccttttgacatgttgctgaatttgtgtcctattgattttgagtagttcaagttcctaccctttttgtttctacttctttaggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggtatcgaaatcgattatgtacataacactgtgggtaggagacgggatattagctgtaaggtgttgctagttcatggaactttctcctgccgtttgggtcaccaactcctgtaaagccgaggaagcagacaatgtgagacagggctgaagctgccacagtgtggacagtgcctttcaccaaggtagccagcctcagttctagatgattctagggtcctacttgtgtggtaagcctagtcattcctgccctagttatctagtagtactgttatgaaaataaaatgagatttgaatcagtttgaaaactaagtactgtaatgacccaaaggcctgtgatgtttaagttcccagatcaaacaatacctacaatagagacctttcaagccaagtaaacagtctgatgtctaatgtgtgaatggaaacatctcttggtgaaagttcacactgacatataaataaaagggcagattttaaaaggaatataaaaagtagcttttatatccctatccctattcctcaaccctccaaaaagaggacctgtcttttgacctctgacctccacatgtcctcccactcaagtctccaacctctctctcaggcaggggaagatcctaaaatacccaggtggtccatacatattgtggtatattcagatcatacctgctgttctaaccagttcgaatacactaggttgttaccagtttgagaaggctgccctagctgctgaggagcgttgctgtcaggatttgccacgtgtgcctcagttctcgtggcggaagtacatgttcgctacacgtttctgcatctctctttgcagtgttccgctgaggacagtgattcacgcccagctgggctgtcctcagcttctctttctctcacagaggacacggttcgtcgttcctcagccaggtcgcacaggctgtgtgcccttagacaagtaacttcccagaccctgaatctcttgatgagtaacgtgaggggcagcactcacctcacggaaccctgtgaaggctgtgtggagatactgcatggaaaattcctagtgcttagcacagtggcgaatacataatatgccctcaggaaaaactggtcatgagtattaatattgcaatctccatatacctaccccctcctttgcccaaaattttctcttccttagacttccgtgttactttgccatttttaatattcttcctgactctctgattatttgtgcttctttccccctcactcccaagagtctgtttctggcttttcttattatttttattttattttattttatttcattttattttattttattttatttcttgaaacagggcttcactcctgtcacccaagctggagtgcagtggcacaatgtcagctcattgcaacctccacctcctgggctcaagtgattctcctgcctcagcctcctgagtaccgcgggcacacaacaccatgaccagctaattgtttgtattttttttttttttttggagagatggagtttcaccatgttgcccaggctggtctcgaactcctgagctcaagtgatccacctcccttggcctcccaaagttactgggattacaggtgtgagccaccgcacccggcctgtctctggcttttcttccttatctgagttccttcttaggctgccttctctattcccaaggcttcagatctcatctcattgtagaagactcaaatttctgtctccagtccaagcctctgccttaatctccaggccacatttccagctgccatccacacagctgtccttgaagatagcaagagcacttctagtgctcacatcctcaactgcactgtcccctcctttacactgctggtaccctgcagccacacagccaggccagctttccttgattcccccacttctgttactggcaccgccatgctcatggccactcaaaaggcagggcccacagaccatcccccacccctgccctgccattctacagggcaagtgaaagctatgccaaccgtgggcactctcagcctcaagacatcagagtcactctgcttgaacaccacagccctgagcatgtcagcaagccctgcctttagtataacttcccccatcaggccaggtcacctttgacagaagctcctgcatggcataggcagagagcaggcattaggaaggacccctaagccttttccccattggcagctaagtgaatgttcttttgtcttcaagcaagtaagaaatatcaaaaaaggggctaatgactatttgctctgttttcacacaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaa

SEQ ID NO: 2654 - DNA, 203290 bp, Homo sapiens; identical to SEQ ID NO: 2653

SEQ ID NO: 2655 - DNA, 203290 bp, Homo sapiens; identical to SEQ ID NO: 2653

SEQ ID NO: 2656 - DNA, 515542 bp, Homo sapiens
agtgggtcatgctttgttttattcttgaacctttagtcccatgtatgaatcctgagtgttaccctcctgaatgctgtgcactacagaatgaactttagttcacagtaaatgagggatgctttttcttaagaaataaatttaattcaaggtggttagtgaatgtgaggcaatgtaatgccttcacgaaagttaaagtaatccagttacaaaagaagcactgtgtatagtctcaaatagctgaaggtacaatgggctccatattttacaaagtacaaaaaattatttcatatacaaagaaaaatacaaataatgtgcaaaaaccattttcacaggtggcaatttataaaatggaaatgatagaaaagtccttcattcttaattatccccagatttcttatatattaacacagttctatttcctagtgtgtggacaattttaaatttgaaattctgatttatttttaatctacaaagtatttttattttttaaaagggaaccatttcattattgaaatcttatgaatgcatcagttaatttatattaaattataagcaggctatctgaaaaacaaggatatagaaatcatatatacacatttttgaaatattagtttagtatttaacatattaacatttcaaaacaaatgcaatgatctagctacctatgacgccagctggtgtcagtggttgtagcgaagatgctgtttctgtttaccatgagcaaacagcatttcttgggtcttaagctaaacaatcacaagttatcaaagtaaagaaaatctaaagacagttcttacttttcatgtgtagaagtgtagtttgggtatccagtcatgccacagtgtgactgtggtcaacacagcccttgtcacaggtgcgtatggtcctaaatagctggcctctgtctttccaacatcttcacttcattgggaattcagtgcaagtgtttgttttgtgagttagtgcattcagctttttttgcatgttattttgaaaaagaagctgtcaggaagcagaagatacataagaacacaaggccctggatcctcagagcacctctggtctagagaattcagtgttttggaagtagtgttttcctgcattgggctggtcattgttgtaccattccctggataatctttttccatcagaataatgctgtgtgctccctctttgcctgctactgaacaatgacgtctcttgttgtgaaccccactggcagagcacggaccatggaagcatcttttggcagcaccagagaactgagcatctcaaaggtcaggcattacaagtagatgtctctcataggaaacctagtccaggtagaatatgagacaatcttggagggttttgatttttgcttgttaaacaggtctccgaggaaattatgacctcagagaacaaaaaaggatctatagctttcatgaagaaggacccaagtaggtggtagccattttgcctgggtgaggttcacagttggctcaggagacatcttctgatcattaaccactaagaccctgttagaaaaatttagtgcaagatacagggagtgcatggggctgttgaccagacctgtgtgaaacacctattcaggttaagtagatatagcaacccctgcaagaggggactgggcaggagaacctcaggccctgggataacttgttgtcagctcctcaaggatccatgcttctttttctatctatctggcagcatgagttcttctgtttcttctgcgtgggttgaccatgggcatcaggcatcagagatacaactctggatcttgtccatccattgctgggcactctgtccatcctgggcgcagaagttatacacacgtttgctggtcttgagctacaaaaccaaatgacagtgaaccagagatgaagggcagggctgttttatggatttgggtaagtggtaaatcagttcctgtgacctttcttttccatactgccccagaacgtctgtatgaatttttcttcctcaactaccatactgttattgcctttacttttgtggtctctagagtcataggggatgttgatagaagggtactggcaggaaagggagacacactgggagcgccttattttgcattttcttagtgtcgtctttgactaaggaggaagggtcagcaatgaatggtgcctttaacctttcccatgcactgcaccaatgcactgaaggtgagggagctccttgtgctccagggggatgcctgagattcatgcataccataaagttggccttcgtgtcccctttctttagttggagccatattggaagcccactgtcaggaaaacggtctcatggcctgagcagggccatagaggatgacctatcctctttataaagccctgcttgactccagggactacataagtctccttctattatgtggcctataaagtgccccatggcctacctaagggctgctgaagatgttagcgtagacacttatcatgtgtgactaaggacagtcttttgtgggtagtcaagcacgaagaccactgaatactagggaaatagcatctgttcttgaaagtaggtggtgactgaaataactaacaacatttaacaaggagttcatctgtttccatgtgcgctggactccttttgcacaaagcaatatgtagcttttctgagacatacagacaggaagagaggatagccttgggggtcaataatgctgagttcaagctctggaacaattcccatagccaagggggtctgtcatccatctgtagtcaccaccaattactctgagggctccatcattcttggagacagacagaatgatgtgcagacagagccaggaaaagagaagtaagatcaacttacatcaaagaaagccttgtcacttgtgtgctttggggctcccatgctggggccagcagggatgaccatttctacttcagccagatcaatgtggcctttacagcttgtgtcctcacctgagtcatagtagcgcagctggaaccaaaaggatacaagtgagatataagagacagaaagagaaaatgccatggcttttcaaactgcatttgaataccttcctctgtaccttggttatatatgctgaactatgcctcgaagaatacacaaaaaattaattaataatacttgttgcttctaggaagaactaggtggcttggagaaagcattgggggaaagacttatgtactgtttgaaaatcaaacaaataaatgtattacatcttaaaaaatagaatcaaggctgggcatggtggtttatgcctgtaatcccagtcctttttgggaggtgaaggtggacggatcacttaagcccaggagttcgagaccagcctgggcaacatggtgaaaccccgtctctacaaaaacatacaaaaatcagccaatcgtggtggtgcatgcccgtagttgcagctacccaggaggctgaggtgggaggattgcttgagcctgtgaggtcgagctgcagtgagctgagatcctgccactgcactccagcctgagtaagaccctgtctcaaaaaataaaaaaaaaaaaaagaagtcaagtaacaactgtaaaaagtatatgtaacatataaaaagagggctaatgtttagtaatatacagaattcccagaaattgataagaaaaagataaagtagaaaaatgctcaaaatatctcaacaggcgagtcacagagaaatacaaatgatctataaacatctgaaaagatgatcaacctcattaatcaaagaaaaataaatgacaataaatgagatttcacttttggattgagaaatattaaaaatggctgatgatatccaataaggtactagatcatctcaaatactgccagtgtgaatataatttgttagaaattttttggagaacaatttggcaatatcaactaaaatttagaatgtttatgcctattgaaacatctttccaggccgggcacggttgctcatgcctgtaatcctaacactttgggaggctgaggcgggtggatcacttgaggtcaggagtttgagaccagcctgaccaatatggtgaaaccccgtctctactaaaaatacaaaaattagctgggcatggtggcaggcgcctgtaatcccagctactcgggaggctgagccagagaatggcgagaacccaggaggtggagcttgcagtgagccgagattgcaccactgcactccagcctgggtgacaaagcgagactctgtctcaaaagaaaaaaaaaaaaaaagaaaaaaggaaaaaagtcaaagagactgctagggaataagccttattgggccataatctgtggatttcactctctagtatacatggcaagaaagtggtgcttctgataccgtggctctgacctgagacttttctctgtctctcctctcaggcatggtatgagcagggctaagtggaaaaaactgtatctatctttcatgttaaagaagtccagaagactggtaagaatgcaagtgtaatttgatgtaaattatagaaaaattatgacattctcctatgttatatttagaagcttaatggaacttttttacacagtgtaggctctatgatttcagagtatagctccctaacagggcttccatttgtatatttgaacataaattatctatctatattgtcccacaaagactctgtaatcgttatgaaactccttgagcagaggaaaagctggactccaaatacagtcttcatttggaaggagtcttttagatgcaggtccaaccaaagcactgtacaggagtaacagttcaggtttttcctaacagattccattttatagataaatgcattgagaatcaaaatgtgtaagcctcagcctcaaggctgagtggtcagtcccaaggtggagttaaggcctgcagtcagaacacaggagaccatgcagctctcagtaatgcagggtgcagagttgctggaggtttgggtaggaactgctctcccttgaaatcactggagtaaagactatgatgctaaggattgcagaggctgctacaggaatagctaagaacctaacagtagtcaaaagatttcttgacatagtcagcaaggaccagtctagtacttgcccacggtgaattccaagtttgggtgggcacatccccttctgccgcttttggggcccctttactcccctgttgctgccatctttgaagggtaacagtgcctcctttagtaaccagtacagcagtgggcacagaggtggtgttcgataaatgtttgtagaataaattaatgccctctgttttgaatggatgctttctgctgcgaggacgaaggtaacttgtattctggggagtgttcacaggcataggcttatatgtgcatgtggtatgtatgcaactggctgaaaacctcaggaatcccctcacctgggtgttaagatcaggcagcaagagatatttgagcattaaaaaaagagttctattgctctatgctctgggctcaattgttgctgcctctgcctgcatgtaccaggccgagctacttgggaaactccctcagaaggctattgcccttactcagggacatctggggcccttgaggagcctccagactacatatgagaggcactaaaaaagcagtctgtacatgaggaatctatctgtctgctagagccacataatagccagggactgggactagcctagacagaagtaatttcttttggctttaagagtattacctgatgttttgttacatccaaaacaaaccaacggggcttccaacctttcagcaaagcccctcttttataaagtgttccctcaaaggacctagaagaaatgatgacaggagagttaattttgatttacacttacaaaatgctgtaaaggggaggggatatctgttgtttttgtcaagtctctatttcccctagatgattcaaaaatggcctataagagttctccctggattttttctgctagacctctggggaaagactgctgctttctgctgggattaccacatctgtgaggcttggaatgatcagtagccatcctttgtgccatgttgggactgacataacacagagagagggcaaagcagagccaggaagtggatagaagatactgtgtgagaagctagcatacccttggctgtcctagcttatgtgagtaaattcctttttgcttcagctagcataagctggatttctgatgtgtgccactgacaaagtgctggctgacacatgttccctcaaacgttctggcagacaggagataagagccatcaggactcaactacaaataactacaacctcttcgaattatttttagttgtaatttttgttttttgtcttttcaaagaaacatctaaaacattacaaaaattaaagcaaatccatttcaagtttataaaaggctgtactgcacaggcctagcttattgagggacctgtggtttagcctcaggtgctgtggggaagtcttcagcacagcgagcagggttcagcatgtcacctgttttcatcattcttggatgtatactggctatagagcgtggctgctcttcgctccactccattggatggggagatgctggaattctgttcctcccccatgctgctgtctgggagatgtagcagagacctcttctgataggaaggtaggttggtagacacaattcctggggatctcgacaggtgtctttgggactgaaaaagacaggacaggagctaggaaacctttacagacacttaaactactgactggaaaatttcatttacaaatatttatctcaaggaaaaaactggactaataagcaacaataatgtacaaaggtatcaatctcagagttagttatcgtggtaaaaaactggaaacaacctacacgtccattattagggacattaaacaaattatggcatttccatacagtggaattctagacagccattaaaaaatgatgctgctatgaccaggcgtggtggctcatgcatgtaatcctagcactttgggaggccgaggtgagtggatcacttgagtccaggagttcgagaccagcctgggcaacatggcgaagccccatttctacaaaaaatattttaaaaatgagccatgtatggtggtgtgtgcctgtagtcccagctacttgggatgatcaccagaaccctggaggttgaggctgcagtgagccatgatcacgccactgcactccagcctaggtgacagagtgagacactatctcaaaaaaaataaagatgttgatggttttttttttgagacagggtctcactctatcgcccaggctggagtacagtggcatgatctcggcttactgcaacctctgcctgctgggttcaagtgattctcctgactcagcctcccaagtagctgggattacaggcacacactaccatgcctggctaattttttgtatttttagtagagacagagtttcaccatgctggctatgctggtctcgaactcctgacttcatgcctgcctcggcctcccaaagtgctgggattacaggcatgagccactgcgcctggcagacactggtttatacacagtgacagttggaaggacacgtatgccaacgtggagtgaaaaagcaggtttaaaatagtatgtctagaaaatctcttttatatgtgaatttataagggtaaaacaagtttgatagcatagtggtttacttctaggttataaattatgggtgattctcatcttttataactttctgtgtgttctttcaaaaaaatgaacattattactttcattattagaaaaaatcaataaactattatttttctaacaaaaaagcattaaggcatcacccacctgttgtctgtctgataacagctcctgaattgctatttgagggtaagagatagagccccagatgttctttttttaccacaaaggttttcttctaccctccattcttcttgacctttctgtaacatctgacctgctggcctcttcttcctgaactgttcttcagaacactcatctgtcctaatttcccttctgttgcatttggagccagtctgatgtgggttcgattggtggctctaccagttgccactgtatgctctctgtgcctgttccttgtgtaggagagggaacgccattccctcacagtggattaaataggatacgaaggtgtgtactgtactaagcacagacccttccacatattatgtgcttgataaatgtttcttaaatcagaaataggaaatggggtatgagaagcagaaaacagagtatttggttttaaaatatatatatacatttttttgagacggagtcttgttctgtcacgaggctggagtgtggtggcacgatctcggctcactcactgcaacctccgcctcctgagttcaagagattctcctgcctcagcctcctgagtagctgggattacaggcatgcgccaccacacccagctaatttttgtatttttagtagagacggggtttcaccatgttggccaggatggtctcgatctcttgacctcgtgatccgcccacctcggcctcccaaagtgctgggattataggcgtgagccaccgcacccggccgttaaaatatttttatgataaatgtttcttaagtcagaaacagaaaagggactgtgaacaacacagggtagcatattttgttgttttaaaatactttctgtggagcaaacgtggtcttggcattcccctcctgccttatgtggtagaagatcagctgaaaccacacgggcactgagatagaaaagaacccaatacttttccttggattcggggtgctgagacataagtattatgtcactgtggtgaagtgagacactcaggaagtattcagtcatttggaactttctgccctggacctccaggacatgacccctcccctttccacccttccttctggccataaacccagctgggtcttgtcacctgtggcagcaggctccacctgacttagcaccctcagaaagctcagaagtggctctcaaggggcattgccaactcacgcgatctgttcttggttcttctttaaggtccacggttaccctttcccacagctgctgccacttctcaggggcttggttcaatttgtgctccaatttttcaatttcctgcaaagaaattaaaagttttctgatcagtatttcatagaaatcaggatgggccccaaagccacactgcttctgtactaggcccagatgagcagcatggccagagggcagttgaggaaagtggtggacatgggcctgtgaggtctcccagccaggaatagtggtgagagctctagttggtgtgccgtactgtggcaaagatggtttattaggacctataactaggcctttttgtacaggatagcttacatactaggatgtgaaatatgtatctcagacatctgcacccttgggcagcccatgggaaatctgatagccaaagcaagaggtcaagcactggcccgtggcccagccctaatagctgaggtagatgagaagccagtccttgacaggaggaacccctcaactctgatgattcaaaccagatgtggaaagaatgaaccaagaaatgcccaaggaaacagatataccttctgacagggaagctggaaatcagggcagctgcctctgtgactgtatgaccactgaagcatactcttcctggtcaggaagccagatggggaagactctttaggaactgtctggcccatatcagggctcaaagctattcctcaggctggctactgccaggaggggttggttccggaacattccttgcagaagatggttgacagcactcccatcaggccactgactacccacacttctgaccagaggaagtaaagcacccacagaagccacagccaagacctgactaaggctgctcgggcaactaaaacagctgggaagctgctggaaggagtaaattgctctatttgcttgattgctttcttgtaacgctggaaaatcacttttttttttttttttttttactgagacggagtcttgctctgtcacccaggctggagtgcagtggcgtgatctctgctccctgcaagctccgcctcgcaggttcatgccattctcctgcctcagcctcccgagtagctgggactacaggcgcccgccaccacgcccggctaattttttttttttttttgtatttcttagtagagatggggttttactgtgttaaccaggatggtctcgatctcctgaccttgtgatctgcccgcctcagcctcccaaactgctgggattacaggcgtgagccaccgcgccaggctggaaaatcacttttattgagactcttttccagtagtgaagcctggtcccccactgatgatggggagcaaatctggtttcttcataaccataaccctagctcagagtaaggagagccatgttcagaagttacttagcctggttcctttgccctcatgcctccagggcccctggtgcccctaggtgtgtgtctacagttgacttacactgaaaaggctggtgagagcatcaggctgagtacagctgacatcatcatagcatggccacactgttctcctctggctccgtggcccagcttctccagccaggtcagagtcttcggaggggaagtgcttgggggttagcatcatccagtcataggaagggcctgtggacagggtctcttctatgtagtaatcccacttcttgaggctagagacgtttacattgggctttagagcctgttaaagaaaacagaaatatagtttcatcttgaccccaaagtaccccaagctcactgtcaggcaaacccctaacatttatagagtccaggggaggaagagtatgaatggagttcaaataccatatttctaaatatttaaaaatcatacatcaagataaattattaaataaaacattctccaatcctccctcctacattgagaaatgtaacttcctaatgacgtagaaggtcaagttcaatagagaattcttggattcctcagaattttatactaacaagtggtagcactggaggagctggccccagccccctgtccttggcctctcttctccacccacccctatcttacattctaagggtcttaacatgaatcattatgtataccccagcccacaaagtcaaactctgtccactctgtcaaacctgctactttttgccattctttgggccttggggtccatgcactgacttaggagactgacttggagaagtagcctggtgagcagcctgaatttgggcaaagaattctgaagtacccagacagagtatggtttagatgaaggaggggcatctaagcatgtacctttggtttcttgtactgctcacctccatgaggaggatgcagctggaggaaggccagactagggttctatgattggggcccaggggaggggcctctcttggccctaagtaatggtggaactgcttatcagaccagtctgttgcattccagggcgtgtgttatgtagatgtgcatggtggggcagttgccccgagatatgttatccttcttgggcttggctccgaatatctctgcttcctacaggggtccttccatggctttggtacagatgaacttaaagaaaccttttctaaagtattttaaggtttttcagcttagaccacctgttgatatttcaaattttgttagttctttctttctggggaaaggtgccttgctttgattctctgcaagttttcccttctaggttttgagagccagctcctaatttttgtggcaagaatttagggaacagtctccatttgtgtcacaacccaaacctatagtgtctcaaactttgaaatagctttttggtatgaaacctagtccaatgtttataaaaagcttaaactgcttatatatgttaaaactaaggaaaaccttaacacaaaatttcagaaagtgaaacataaatgatttcttactctacctctatttccaatggtgaatataaataattaaagaaaatgggactcctcttgtgcattctgtcaatacattcccaaatacagactccttttttggcatgcttttctcctttatcatcaaataaagttcctgtagattaaaaaaatccaacaaaacaaaattaaataaattcacactttgccaaaaaacgtatgatgcatgcagcagataaaaaagtggaatattttttatggctttaaaaacagcaacatttgtgtgaaaaccttagaaaataactgcaaagctaaagaccggaatgaatttcatcgctacagggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatggcatgaaattctataatatgtggggcccctaagactaattaacagtttcttctctaccttttaactgcagggtccagtgcagtagttctcaaccttggacatggatttaaaaaaccaagggctttaaaaaaatcccagtgtccaggtctcacctcagaccaattaaatcagaatctctggggatggcccgagatattagttattttaaaagttcaagtaactccaatgtccaaagttgcaaatgctctaggggttgcagtaagattttgaaagccaccttgtatattgctccatttggcgccttgaggcatggattagactgaaaggctgtgtggtagtcagcccaagttgaaataggctctaggcacctttgtagacagaaagagaatgagctgaaaccagaagaggagatgcaatacatggccctctgttccttagggctgttgtaacatcttgtaattggaaccaagtccaatggacttttcttacagtatccatatggctggcttagggcaacatgtacacatataaggaacatcttaaaaacagtccaaatcagacagctagtgccaaatcctatcaaattataaccctataatccagtatgtaataatcaacatattaagcttttaggacacaggagaattcattgtgtttaagtttttctgataaaatcttaaaaattatgactcagcgtggtgcggtggctcacatctgtaatcccagcactttgggaggctgacgtgggcggatcacttgaggtcaggagtttgagaccagcctgccaacatggtgaaaccccatctctactaaagatacaaaaatcagctgggtgtggtggcgggcacctgtaatcccagctactcgggaggctgaggcaggagaatcacttgaacccaggaggtggaggttgcagtgagctgagatcgtgccactgcactccagcctggcgacagtgtgagactccatctcaaaaaaaaaaaaaaattatgactgatgaattctaccagcagtggttgagattacttactctccacttcgtcattttggcagatagagggtagttaccacaggtgttcctaaacaaggtttcactgtaggcctgataacgagtgcatctaccagaacacaagaaggaacagacttcaagtaggcaacctagtctggactagggacacgaaactaggcttccttgatgttgattaggtgggtggcctaacatccagagaggaggctgggtagatgatttctactgaggcttcggcaatgacattctaggattcgaaatgcatgtttatgtgttgttgtttttgagacagggtctcaaccctgtcacccaggctggagtgcagtggtgtgatctcggctcactgcagccttgacctcctgggctcaagtgatcctcccaccgcagcctcctgaacagctgcaactacaggagtgcgccaccacacccagctaatttgtgtgtgtgtgtgtgtgttttttttttttttttttgtagagatggggttttgtcatgttgcccaggctggtcttgaactcctggggctcaagcaagccgcccacctcagcctctcaaagtgctaggattataggtgtgagccgttgcacccagcctgtgtttatgagttttaagaggaaacatgtttcataggatggaaatgcttatattttcaaataatcatgataatctttcaatatataccaaacatatctttttatccgcatcattgtatttaatcttttcaacagccctgtgtgataggcagggctgtttagtttttcagatgagaaaactgagactcagagatgaagtaatttacccaaagttactgacattttctgatccttgatctacggctctacccgtgggaccagtggtgggtctcagacttggcagcataatgggctcacctggggagtttttattttttattctttatttttgagacagggtctcactctgtcacccaggctggagtgcactggtgcgatctcagctcactgcaacctctgcctcatggggtcaagaagttctcgtgcttcagcctcccaaatagctgggattacaggcacatgccaccacgcctggctaatgtttgtatttttagtagagatggggtttcgccgtgttggccagactggtctcgaattcctggcctcaagcaattcacccaccttggcctcctcaaagtgctgggattacaggcgtgaaccaccgtgcctggccttacctggggagttttaaaagctgttgatgcctgggccttaccatcacagattctgatttaagtggttggggatgttgcctggaccttggaagttttaaaagctccccaggtgattctaatgttcagtcaagtctgagaaccactgcactagaccttgttgcttctctaatgaagagaaccatcatctgctataggagaagccttggtctttggccacatctgcatgctgctaaggtaatttgctgatcagcttaattcagcaaaacaaactgctttattaaaaaaccaaaaacttagcctgggcaagatggcagaaccctatgtctacaaaaagtacaaaaattatgtgggcatgggggcacatgcctgtggtcccagctactcaggaggctgaggtgggatatcgcttgagtcccagtggcagaggttgcagtgagccgagatcctgccaccgcactccagccggggagacagaggagaccctgcctcaaaaacaaaacaaaacaaaacaaaataccactgcccccctgcccacgaaacaaaaaaacaaaccaaaaaaaccccaaaaaacacaactactccaaggaggcaaatacctgcgttttactcccaatatttgtacatgttgttcctttcagtgataaagctgagtgacatggtgacccctgtaggtacaggtcagtccacttaagaccaggcctggccaggcgtggtggctcacgcctgtaatcccagcactttgggaggcagactgcttgaggccaggagtgcaagaccagcctggccaacatggtgaaaccttgtctctactaaaaatacaaaaattagccaggcatggtggcacaggcctctaatcccagctactagggaggctgaggcaggagaattgcctgaacctgggaaatagaggttgcagtgagccaagatcgcaccaatgcactccagccttggagacagagtgatacagtgagtgggactccgtctcaaaaaaaaaaaaaaaaaaaaaaaaaaaaaaagaccaggcctggggcagttgtaaccagttatacttactaccttcccaataagcagtatgcagatgcttaagaaattaaggtttctgattgtgatgtgaagaataacaattccatgagccaacaaaggtctggaagtataaacagggtggaaaatggtctcaccagtgctctttcccttatcaaaagtatgcagtatcatactagacaatttcaataggatgccctggaaagcggtatttcctgatttcagatttaaaactgagaacatcagtaaatattttcttggaattaagagtcctctttgtggtactgagtgcatataatatattgaacagaactgattttcgtttgcttaacaaaaatggtcatgtgtttcctctcccccgtaacagttataaaagtaagaatgtaaaattcccttgggaaatgtttttaccggggctgactttcagaatctactcattacaactatcattgctattaaaaaaatagttcatcactatcattactaatgcgagtgatgtctaaaatttattgagcgcttactatgcgctagtgattgggctaagaggctaagtgactgtgtgaagtttacaactttttcctcatgtgatcatcatggccctgacaggtgggatggtattactgtccttgttttaaagatgaggaaactgaggctcagagaggtacttaacccctccccaaaatactcagttggtaactggcaatgctgggattttaccctggtctgtttcgtctagagcacagggtcttagctgtattcaagctgcctccaagggcaggcacccttcctaccagagtgcatcagggttggaaaaactaggagtcaaatgtttcttctcaaacagtgtgatcactttgaggtatcaaaatagtaaacatatttaattttagaaagatgctataggaatgaccacctgctaagagctaacgtggcacgtaatttcagaatttggccacttatccactcctctacattcatagttcagagttaaaccttaactcagcttgtcagtcttggggatagttacattattagaattttcattaaaaacatgcagaactaacaaaaaagatgaaacaagggcatacagacacataccgtgctctaatctttcatagtctgaatccaggagaaatgttttaaagcgattagacacatagtggaaagccaagaactttaagtaatagagattgaattcaaactcagttggatactggttgtgaacctgaaacacacaaggcaaagaaaagagtaagaatcaaacagaacaaaaagtggatgccaggccactgaaggcttaactgaaacatgcaggagaccattcagtcattcactcaacaaatacctgaatccctaccataagtagagatgggaagggaaccagcttttccgagcacctactgtgtgccagacaccagacgagggttttttttttttaaataaacataatctcatttaatctctacggtatagcaagagaggcattattatctccactttacaattgagaaagcataggatcagcaagattaagacatttacccaatgacattaaacagtagttagtgagcccaaatttaaccctggcttattaggctccaaagtctctaccccactcactacattatactgtgtttggcaattgatagatatatattaacataagttatggttcttgctttccaggcaactgtggtgtaatagtgtgacatacaacaagaaaaattgttcttacagaagtttggcaatgaaaaggattgagaagagaaggtggctgcttaaggggacagcaagagatgttttctggtcaaaagaaatgtgtgtgtgtctgaaggcaatccagaaggagccagtagagaaaacaaattttagaaaaatttgttagctaataactaagagaataagatcctgggaaagcaagaatgaatgaggctcgggcctagatttagggaacagctttggaaacagggagggatgaaaggtaagcaagagaaagatagttcaagtgccaagggaaagggcaggagctaatgccttttagccctaatttttcatcagtaaattaggcagtgaggtcattgggcacaggaataggaatgagtgaatgacatgggaggcagaaggctgggcaaagcttggaatggtcattgagctatagcatgctttaggcaaaccgtatacagactgtggagccatcttacattggcagagggtaggctgatgaccctgtgacactccctagtctgcctcgcaatctcacctctatattgctcaaacaatctctcatgaccagctagaaaattttgtttggctgaagtaagttccaatcataattgtacttgctcaaaagctggttcaaattaacactaaatttaggcaagctgtctaaaagtcagcgttctcctccatgtttaatttggcaatacggacctgtacttagtcagctgggtcagccaaagtgagcaggcatgtgtgtgataatgttgattgtccagtggaccaatgggaatttaaagtcgtgatctggatatcattgatttatcaaaatttatcatctggttaggaacctggttttctgtgatcattaaagggttttctacattttcttactggcttttgaattgaagtaaaattttagcttgtaagtaatgtaaaataaaatggattttaggaagatgcattaaaaaagagtttgactcctatgcagtgggcctgcaaaccacggaactgcttccttgatgtgagccaatgccttcctgttgcatcagatctccacaggacagcagagctttccatgggacatggctctgaatagctaggtagcgtgccatactccaggtttgtagaactgtaagcatttgtattacgtagagttttctcatcagtgaaaatgaagggataagaaatcatgggtttcctatgatcatgcaatacaagcaactaattataaaaactggctgggcgtggtggctcacgcctgtaatcccagcacctttgggggaccaaggtggaaggatctcgaggccaggagtttgagaccaacctgggcaacatagtgagaccttttctctacaaaaattaaaacaaacaattagccaggtgtggtggcacgtgcctgtagccccagctactcaggaggctgaggaggaggatcgcttgtgtccaggagttcgaagctgcagtggagccacaattgtgccactgtactccagcctgggtgacagagtgagaccctgtctctgaatgaatgaatgaatgaatgaataaatgataaaggctcaacttgaggagtttataattataataaaacaagcagatgtgacacataattaaggatcaatattaaaaaatcttttatttccttgttttgttagccctctatgtgtgtctcagtagtcaaccatgtcccttaatacagcaattctcattcaaacgcttgcctctactgatacttatgcacagcaaagaaggccctgggtttgactctctagtaggcctggttctctggtcttcctggctcctttcttaagcattgctcagacctcaagtttccccctcaacctgtcctgtaatgccatacagagctctccagtctgagctgttgctttggaatcaacagccccaccccaaggagccagtgatggagaggggggttactcagattgtggatgctgggacagaagaaggggacagggcaactaaggatggaacttggttccctaccatctgaatcctggggatgagaaatctgcagtgtgctcaggcagggtgagctccaaggacaactgccccaacagcccttgggataaaccttcagtagtcacaggccagcccctcactcactgtttccaagggaggaagagttctttccactgaaccagtctacaatatgttctaaaatttcttttaaaaatctttattaaagcctcaagggccaggcgtggtggctcacgcctgtaatcccaacactttgggaggccgaggcgggtggatcatgaggtcaggagattgagaccatcctggttaacatggtgaaaccctgtctctactaaaaatacaaaaacaaaattttagctgggcgtggtggcgggcgcctgtagtcccagctactcgggaggctgaggcaagagaatggcatgaaactgggaggcggagcttgcagtgagccgagatcgcgccaccgcactccagcctgggcaacagagcaagactccgtctcaaaaaaaaaaaaaaccaaaaaacaaacaaacaaaaaactgtattaaagcctcaaaataacatttctctcaatgactattcttcatagaaaccagatacctcatacatacttgtatcttttcttgatgattctgacatttaatctactcaggaatacaattttgaagacccacttctgaggtaacagtagaatggaaatatgatcttaagttgaacttacaggcatttcagggagatcatgtgctcagattaaaagtgaaacgtctttacaagtcaaaaaatgctttcgtagcccagtatattggcctcaccacaagccctctacagttatgctagaaaggttagacaattttccaaggcctcttgtacccactccactgggactggaattggtgcttggagaaagcatcaaggtgtatacgcttgggggcactatgcatgtgtcctcctgtgtgccacaggagcacctgcagtcgctaactggggttgaaaaacaaacctcccccaaactggggttaacgatcaggtctactggaagtggaagagaagatgcagagcaatttgttttttactcttcagcaataaagtaacaagcatgtaaacatttctttggtggaaaaagaaaagtcagatagacctcaagcctgggttgattagtacctagataccacgtttagaatccgacattaagaaacataaggaattttctgagatgtctttcttccatcatgtaagaagaaatgatgagatggctgaactcttacggtgcttagatttctaggaagcaagaaaaatcatactttctccattgagtcctgcaccccagtgactcagtttgtccagttcactggcttcttttcctctttgcaaatggaactcacctagactcttgtgattttaatttgcattttctaatgaagaatgatgtcaacttttcatgtgcttatttgcatatctttggtgaaatcagtacaaatgttttgcccatttcaaaaataagctgttggccgggcatagtggctcatgcctataattccagcactttgagaggctgagatgggtggatcacttgaggtcaggaatttgtgaccagcctggccaatatggtgaaacaccatttctgctaaaaatacaaaaattagctgggcgtggttgtgcacacttgtaatctgagctattagggaggctgaggcgaaaggattgcttgaacctgggaggcagggttgcagtgagccaagattttgccactgcactccagcctcagggaaggagcaagattccatcctaaaggaaaaaaaaaaggttgttttcttattattgaattttaaggtttctttatgtgttctagataaatccttcagcaaatatatggtttacacatattttctcccactgtgtgattggtcttttcatttgcttaacagggatttttaaaaagtatttatttatttatttaaattattattatttttttgagatggagtctcgctctgttgcccaggctggagtgcagtggcgcagtctcggctcactgcaagctccacctcccgggttcatgccattctcctgcctcagcctcccgagtagctgggactacaggcgcctgccaccacgcccagctaatttttttgtatttttagtagagaaggggtttcactgtgttagccaggatggtctctatctcctgacctcgtgatctgcctgtctcggcttcccaaagtgctgggattacaggcgtgagccaccgtgcctggccaaaaaaagtatttattatgttttttagaggtggggtcttgctgtgttgcccaggctggtcttgaactcctgggctcaagtgaacccaccttggcctcccaaaatgctgggattataggcttcagccaccatacccaggatcagccttgtaatatttgtagaatctgtagtgacgtcatctttctcatttcttatattggtaatatgtgtcttttttttctcaagcagtctagctagaggtttatcaattttattgatattctcaaagaacagcttttggtttcattagttttctttattgttggccacaagattttggggacctaaaggcaagtgtgcttcaaataaatttagccttattatattatgtagaattgggaatgataggtatttcagctaataaattaattctatgtcagcatttccctaagtatggtgatgaatagagttttaggcttctctcaggtatcatctggattttgttgttcaaaataattttgtatttattttgttgcaggttaaaaagtatacagacttaaaagactaaactgcatgaagcattttagttttgtttttccgttatggagtgaaacttgccaacttcacttatttataagaagagaatctgaaatggaatttggagaaacatgaatttatagggtctttttttttgcccatgtgccattaagtactttgtaaaatttaaaggcctataaaaataagctatgactcaaacccctggaaagatcaacattttggaagtaaagtttaatacattaaaactggattctgctttcagaattataaatattgagctacaagagacactatacatcaacacgtgaaaacctggatatggttaaacagaccctaggagagtgtatagctaatattaatttttgttatttcacaaattaagatttaacaaacattgtgtgctttgtgttacatccttccatattacatggccttaaatattaagctttgatgcaaaattgccttgttataaaacagattggattatgttcatttttgccagtttgcagttgaataggcagcagacagcagaaactcttgaatataccaacaatccattagctacagctattttgccaatattactggataaattttagaataaccaacctgtgtgggggcagcttagctgctcacatatgtgctcacaaggaaggctcatatcttcaaaaggcaaatagcttttttctttggggtaggacctagcatagtgctgtcataaggtaaccatgaggagaatcacataaagccagaccaaagtgaatcaatttacaatttgaataaactttgaaatcacagtaaaaaatactgaaaaagttctaagatgccctcaaagatttactctaatgccgaaataaaggggatgctttcttcacgttttcattcatactattcatgttttctcctgatattatattttaaaaagaaagtttacataaaaatttaatctttgtatattggattttttttaatttggctcaactattttaagaaaagggagtcctgtaatgatatcatttgagctaagccaatttcttttagaagcaaaaaatctgccagatgttgctattatgaaacagtgagctagcatttataattcatttgacacctggatatactggcgtaaacaatggctttttatatgatgaggcagttctaatttaagttcagtgcttcatctgttttcttgtaactttattagtactaatggacaagcctaggcatatgtccatggactgccttttggcattcaatgttagaaatggttaataagcagggaacacattccatctgggaaagcttcacttgctgctgtgtaattttgaacctgtttttttgatgtttctgggcctagttctgttgtgtgtccctgagagactgagggcagcactaattcgaattatctggtaaaagccagagtcatgtaaagcactagtgttcacttgaaaggcattcaaagaaggcattttctaatgcctaaaaccagtatgtcgaagatgatgaaacactaccttataattaagtcagcaagagtcagaaaaactatttgctaactatagtcttcttagattcctctgtttttgagtgaataaacaatcccttttcagcacaaaataatttgcatcaccaaagctgatacctctggtagccaagcatgctttacttactgcaattaaggtcatatgcttgctttgctatgacttgtctgcacttaggttattatgtatgaggtattaagtgaaaggaggattcaggcaaattcttaaaaatttatgttttaatttaaaaaattttaatttggcacagccagatttgaagtcatactgatagggtctctagatcctgaacaatattactttttacagtttgtgaagcattcacctacaaataatcgaactttaattaaaagttaacttctgtttttgatttcagaatcaactggtttatataaaacatttgaattttaactctttacttgaaaaaaaaaacagatgaatcttaaattcagctgattagtaaataaaacaaaacagcagaaattaagcatataccccaaattgttttaattaacttagccttttgtagttttagcatctattgtattctaaagataataggaatgtaagttatgctacatcttagtgtatgttaaattgctttaatcataccacttaaggggtactcacagaatacaggttaccttccagcatctagacctctcccactcctcccccccagccccatccccaataataaaatagaagaatttcattccaagtaaggattattgtacttgggagacaatgatgttcccatctttgaggacagtgtatcttacatgagaacctcctatctcttactgattgtgagtggattatttcgctgaccctaatgtttaggtgtgcagaattctgcaagttgaacatagagatttaacatattaagtagtccatttaacttaagccagatttggctgtacaagctcattcccctggaatcctcccacattaaaggaatttttaagaggtaaaaaacccaaaagggagtggggagaatgggaggaaacacagcactgggccaaagcaattcagcaaatttttgaaagatggaaaatagaaggaagaatagcagtaaatgatagaagaggagaagctatactgggattcctgccaggaggaaaatgatttgagaaggtaacgatttgctgtgtaaacccagaaaggctcagggcacagaggcccaagtattgagtaatgcaggggtgaaatggaggctatcgtgggactagctggaagtctatggaggcaggaaaggaccccaggtcctttcccaccccatgtagtcatatgattacccttttcagagcaacagatcggaggtttattttctgaaaaacaaacaaacaaaaaaacaaacctgataagctctagacttgggaacaccagacacaactgggttagtggaaacactgaaaatagcatggaaaaaacgaaaagcctgcattactgaactgggatttccctggacctatttcctgccctgtttccataaagcaagcagccagacctacaagtactttctgggccccagacaaattcttctccgtagaaacaaggtagctgctgttttctttctctggaactctagtttactgagatgttggacttactaattaaagattattattttttcctccagatttattgaagtgttatttaaaaataaaatttccctactttaagtgtatagttttattagttttggtcactgtacacagttgtgtaaccatcaccacaatcatgatacagaacagtttcctgacgctgaaaagtttgcttatgccctttgcatgatgattgatcccctcccttggtcactggtcccaggcagtcactgatctgctttcagtcactatggttttgccctttttagaatgtcatataaataaacttatgtagtagtcttttctgcctggcttctttcactgaacatagtgatcacaagattggtcagtctttgtaatataaatatttcattccctttgtgtgctgagtggtattccactgaattaatatgccagaatttgttcatctcttcatcggttgatggacatttggtttgtttttcatgctacccctttatagtcacactcatttccttctcccccactatcttgaatctggcaaccaataatttatgatcttgtcattttaaaatattagctgggcatggtggctcacgcctgtaatcccagtactttggaaggccaaggcagatagatcacctgagctcaggagttcaagactagcctggacaacatggcaaaaccctgtctctaccaaaaatacaaaaaattaaccagctgtggtggtgtgcacctatggtcccagctacttgggaggccaaggtgggaagactgcgtgagcctgggaggcggaggttgtagtgagccgagatcacaccactacactccaacctaggtgacagagtgagactctgtctcaaaaaaaaaaaaaaattatatacatggaatcatactcagttggaccctttgagattgccttttttttctttcaatataatgtccttgagatcccttcaaggtgttgcatgtgccagtaattcctttttactgttgagtagtcgtccacggtatggatgtatcccagattgtgtagccattcacctactgtaggacagacatttgggttccccccagttatattcaaatcggatatgtggaagggtaattctttaggaaatgtggagccactgaaggtttttgtttgtttgctttgaagacttttgtggaggggaataaaaggattgtatctgagcttttggaagattatgccagcaattctacttaggatattctagattttttttttttcccccaagacggagcctcgctctgtctcccaggctgcagtgcagtgggggcttctcagctcaatgcaacctccgcctcccgggttcaagcgattctcctgcttcagcctcccaagtagctgggactacaggcgtgcgcccccacgtctggctgattttttgtatttttagtagagatggggtttcaccatgttggccaggatggttttgatctcttacctcgtgatccacccaccttggcctcccaaagtgctgggattacaggcgtgagccaccacgcccgaccaggatattctagatggtcttgatgaagggtggtaagagcatgaacaagacttgtggtctttcaaattctcatatattcattgagattatctatttattgtctattatattccagagactgaaactgtaattgtgttagatactagggatatgaagactagtatgacatagtccctgttcccaagaattctcagactaagtagagggcaatagttacatacaaataaacatactttagtgctatagatgttatcaaagaagtctatacctgactcattagaaatacatataaagtgggagcgtgagggtcagcaaaagattcaaagaattatgaactaaaataacatgtgtagtgctcagaacagtgcctggcacatagtaagcagtcgacacaaattagtaattattgttagtaatggtggtatacggaggcaggaaatagtctagtccaattgataagcataataaaaaagcaagataagaagtgctttcatgaagaactcatatgctttcacctgcctagaagtgagaagagatagatgcttgctcctctcctttggcctcaggtaagctttctgtttcagagacaatggtctccaaacttctccctcatctatttgccaaaaggagtatgaataaaagggccaatattcaaacagaaaacaaatatagtatactctttgctgcaaagagtttaaaggtacatgcttaaccttgtgaccagctcctccagttactgcttggacagatcaattgaaattcgtcaatcggtcttgtctttaataagtaaattagagcagtaaaaaacatagcttcctgtgtgtggggtgaaaggttggaaagtcactgctcatgagtatggagtttctttttggagtgataaaatgctctaaaattgattgtggtaattgttacaaaactttgtgaatggattcaaaaccactgaacactttaaataggtgaattgtatgatatatatagttcaataaagctgttatttacaaaaattatgtagtgatctggaaagttgatcaagtgattactagaataaaaacaaaataaaacataaccacatactaacttggtgtcatcacagttagtttcaactctggttcctgaaaacatagttctgcctttctttccaatcgatatttgaggccagtgtgtttcaaagaggctcaccattcccacaaatgtttgacatgccagaacccattcatccaaccctgggattgtggtcaaatgaaagctggaaataggcctgcttttcctaggccaattcagtcttcaacttgcaagctcagtgccatccaattctcaaacccaatcctgaccaaggccccatccagaggtctgtatctgatgtgcctgcgatgaaggcaggagggagcctagagcagtcacatctcccctaccctcactgcatttgaatggatatacctgggctcccacttataagtgagaacatgaggtatttggttttctgcttctgcatcaatttgcttaggataatggcctccagctatatccatgtcattgcaaaagacatgatttcattcttttgtatggctgcatagtattccatggtatatatgtaccacagtttctccatgtggtagaagtgaccagtgttctcaagcctgtatgcctgtctggctgggccctgattatttctccaggggttaggctttacctcttatgttcccaggcacaagctggggtcctcccaaactgggcagaccatgtgctcgatttcaggacccgtattacctagagattttgttcttaggtaataagcccaagtttgcttctcttctttgaagatggtcatttagagtgctggctacttcacttggggcaagcccaacagccagcttagctgtcctagtttcagaaaccaactaattttttttcttttccattcctaggagtctactgctaagatttcagcatgtcctgtggctgagttaatcagagttatgacaggaaggtaccgggcacaccatcgcaatgctccatcaatgctagtatgttgtgttctttccttcatatcaagtcaactcaagcttgctctacttacctggtgtacacagtctaagaactgtaagaagactggagcaaaaccactcccctgacagttgagggtcaagctgctcctctgactgaatttgtgaccaaaagagagccactctttttcaaccaacatctggaagccttcaagtgtcctataaaagggatcactgagtaactgaaccagggatgtcacctagggcataagcaggatggattgtcattaattttagttctgaaaaaggcctattactaagataaaagcacttccttctgatgatagctaattcacaaatttacctggacagcaaatttgttcactaaccattccaggatggccaataaaattaattttgtaaacttgccagtaaaaactaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtacatctgtggatgggagagcttgatgcccggagccagagctccaggctgcgtaggggctaagagctcatggtacggagttttctgatggataccaggtgctgtttaacacaggactttctctgtccataaacacattagtcattatacaaaagagtcatctgaagaatttaaaaatgaccaaatggaaatataaatataaaatatcaaaaaatatgtctaatagtttacttgtgcagtgatgtcccagccttcctccaaacagaccaaaactgaggaaccattctcaagtacttctgatacaaccacagccagctgcattatcctgtgaagctaagagacaggaaggagaacacaattagaccaagcgctttctgagtgcagaagtcagagagagttgctttcaaccctggataatcaaacgacttagggataaagcgcttgcacaaaagaaccacataatgttttaaatacctaaagttctttcaaatcaagattaaacaatgacacttttgactggatgcaatgactcatgcccataatcccagcactttgggaggccgagccgggcaggtcatttgaggttcggagttcgagaccagcctgggcaacatagtaagaccccatctcaatgaaaacaacaacaaaatgacacttcaaaaaagtagacacattttaaaacaatacattctagtaatacataatgaaataaaattaccttacatgattcccccaaaagtaggtgagctataattccatagagtacaaaaaacagagattctatgtggacttcccaacaaaagacggaaattcagatgaattttattggatttaaaatttgtttttccatgatgtagtaagttttgtttcagacattttttttttttttttttgagacaaagtctcgctctgtcacccaggctggagtgcagtgatgcaatcctggctaaccacaacctctgccccccgggttcaagcgattctcctgcctcagcctcccgagtagcttggattacaggtgcataccagtgcacccggctaattttttgtatttttagtagagacgaggtttcaccatgttggccaggctagtcttgaactcctgacctcaggtaatccacctgcctcagcctcccaaagtgctagcattacaggcgtgaaccaccacgcctggcctatttcaggtattcttaattttttgggaattagatagtggtgatagttacacaatgttgtggacataccaaaaagcgttgagttgtgcacctttatcataaggataaattttatggtaagtgaattatatgttaaaaaagaaactcctggctgggtgtggtggctcaacgcctgtaatcccagcactttgggaggttgaagcaggagtagtgcttgagctcaggagtttgagaccacctgggcaacatggcaaaaccccatctctacaaaacatacaaaaaccagccaggcgtggtggcatctgcctgtaatcccagctactcaggaggctgaggtaggaggatcgcttgaacctgggagatcgaggctgcagtgagctgtgattgtgccactgcactctagcctgggtgacagagcaagaccctgtctcgaaaaataaaaataaaaaagatactcctatttgtctatactgtgtactaaatgagaaaaaaactttcaatatatttgtgctaagtttttaaagccacatcaattggctcaaagtccttaataaacaattaaggtatgagaatagtatatagattttaaaaccagatgtataacattgtaattttaaaaaatattttaatgatcatcagacataatttgcaatttgaatccaactctgaacaagaacaaaaatgaaaaaacccatctcttaaacagagctaggctactttaaacacaggaataaggcaaatgccctactcagtaatgagaagctcctcatgtaactgtttctacaacatagctatcaccaggcctgaattcttttgggctcagaatttgttctaagaaatggctattattaaaaagtcaaaaaataacagatgctggcgagcctgtggagaaaagggaatgtatatacatttctggtgggaatgtaaattagttcagccattgtagaaagtagtttggtgatttctcaaataacttaaaacagaattaccatttgacctagcaatcccattactgagtatatacccaaaggaatataaattgttctaccataaagtcacatgcacacacatgttcagtgctgtactattcacaatagcaaagacatggagtcaacctatatgcccatcaacggtagactggataaagaaaatatggtacatatacaccatggaatactacacagccataaaaagaatgagcttatgtcctttgcagtaacacagctgaagcaaactaacacaggaatggaaaaccaaatactgcatattctcacttataagtgggagctaaacattgagtacacatggacacaaagaaaggaatagacgcctggggcgtatttgaggttggaggtgagaggagggtgaggatagaaaaactacctatcaggtactatgcttattacctgggtgatgaaataatctgtacaccaaactcccaagatatgcaatgtacctatacaacaaacctacatatgtacccctgaacacaaaataaaagttaaaaaaagaatttgctttaagagttaacttttaagatgtcaatatcccaagtgggcaattattttccactgtctttagtccctatcttttggtacaggtccactttctagcaaagagtagagcacagaatgtatcagaaacatggatagataagttgggtggaggggtccgtttggagctggggctcatagcctggggacagaagggagtatcgaccagttccttccacgggtatgcaaagcaccctaaattgccttaataataatgaacacagcatgatacatttatagccaaatatttatgtggcggcatttctctttggtttaagtatcttgagaacagtcacagccctgagtactgacatcatttcctttttttttttttgccttttagtccaatgtgctgtgggaaacaagaggcaggatgcttggaggtagatggaggcaggggactgggaatttctgcaaggtgataacaaataatgggggccaggcgtggcagctcatgcctgtaatcacagctctttgggaggtcaaggtgggaggattacttgaggccaggagttcaagaccagcctgggcaatataagaaataaaggggcttaaagacaaggccctttaatttctcaataaaagttcaattaagaatatcccaaagttgactgaactgaaagatgatagacactgtgtttttttttcaagccttaggtaggcttgggggcatccagtgtgcctttggtgggtagtgtggggtggatctaaaatctagagacctgggataggcagacaaatgaaaggtgagagctcttgggagtcatgcagaagttgccctctgccctggatccttactgtattgacaacagagcaggagccctgtaaatacatgctgattaaatttacatcaaagatttccatctaaaaataattttctccttagtgtcctatagataccaaacttttaaatacacagagataaaaacccagcgatcaagacttctactccctcacctcctataccagatgatttccttagtctgaaaggcctttactgatggcacacaatgaaggaggagaatgttggggagtaggggaacaaagtattttttttctcaaatacagttctgtatatctacttgggcctctgtttctttgagttataaagaaagaagctgcttcagacattacctgtgggaaccactcagaatctcccagcgctttcaggaaggtcacttctgagtcagtagggatggtgcttgggatacaagccctcatcagcttcttaaaactggctttcacttgccggatttcatgaaattcaacaggaacaaactcacaatttaaagcaaattctaccttgaagttctgcggatgaagattcagagaattaggcagatgaagtgctataggtaaaagagtgatgtttccaatggggcagtgcataatgacaaagttatttggggccaaatagctgcagaggctgccaatgggtcaagaaagtcaatcttgtacagcaatgtgtcagtgttggtgggaacagccattcagtacaagctagtggtttgcccagaatggcaaatctagtccttactagaggtagattacttagcctaagaatgcgttcattctgagaactggaagagcctactggtagactggaacttgatggagctcataataccaaatataagtcaattataaggccatgaacctggaagtttaaagagaaactaatgatacatggacagtatgattactccaacagtgtaaactaagtcttcccaagatgtatatggtaagggataggtaacacactgttggagttccagactgtacgtgtattaaagtttgtagatatgcacatatttgtttcttattatgcaagtaaaacatattcataataaaaatgaaaaaaggtagagataaatattgagaaagaaatagaaatcactttcttactgccccaagactaccaacattgtggttatttttttgtttttttgggatggagtcttgctctgtcacccaggctggagcgcaatggtgcgatcttgactgactgcaacctccgcttcccaggttcaagcgattctcctgcctcagcctcccgagtagctgggactacagtcgtgcgccaccatacccagttaatttttgcatttttagtagagatgggctttcaccatgttgcccaggatggtctcaatcttttgaccttgtgatccgcccacctcggcctcccaaagtgctgagattacaggcgtgagccaccacgcccagtcctacttcttaaaagtcaataataaaaaattacatggtcgggcacggtggctcatgactgtaatctcagcagtctggaaggctgaggcagacagattacctgaggtcaggagttcaagaccagcctggccaacacggtgaaatcccatctctactaaaaatacaaaaagtagccaggcgtggtgacaggcacctgtaatcgcagctactcgggaggctgaggcaggagaatcacttgaaccccggagatggaggttgcagtgagctgagatgacaccactgcactccagcgtgggcagcagagtgagactccaccttaaaaaaaaaaattacataaaaaaaccacgaaaggctttgttcatttctatctttgggataatattttttcacttaatatatgtatcaacctatatttatttgagtactttctcatttacatctttaatccttatggaatttattttgtgtgtggtatgagtgttgcatttgcaattaaagaatgctatactgatggcctactggtatatttcattttaataacctggttgcctagctctgaagaagatttaaaagtcctctaacttttcatgccaaagaatgaattaattttctcaaaatgtttccactttcttttcattgtgcccaaattactctattggaccatctgcttttctaagattaaaactgctttctggagattggttgcacagcaacataaatgtacttaataatactgagtcatacacttagaaatggttaagatggtaaatcttgttatgtgtattttataatttttcctttgtcttaataattctatttttaaggaagctattctaaggaaataatctaataggaaaaaacccccagggaatggtatctcaattaaaaaaaataacaaaataacttatttgcttggaattgtgactgtaattttatatacagaagataaagaaacctaaacatccaacaacatgggatgaatagtgactaaaatagttatgaagactatatgacatggaaacataatgttaaggcttcagataaataacctagcgatatacatgagttcctttctattatttttaaaaacttataatagacaaaacatagtttacttttcaggaaaggtagattcctatttcccaactatacatgagctaggtatgcttatcttataaaccaggagttactaaccaaagtattgagacactccattaggttgtaaggaatttgttcctaataataaagtattaaagtatgtgaatttacctaggtaaaggccaaattcaagattattttcagaataagtcactgtaatttattggctttcatgtttctttgttgggagaaaaaggtatggaattgtaactggatggcattgtgcaagctagaatgtggcacatatcagacagatacagagccatattctacatacaaaattgaataaaagataaaacctgaatggaatatatagaatagctgacaactattgtgccagaatggtgggattacatttttaaaaataataatacttgtccgggtgtagtggctcacgcctgtaatcccagcactttgggaggccagggcgggtggatcacaaggtcaagagatggagaccatcatggccaacgtggtgaaaccccatctctactaaaactaaaaaaaaaaaaaaaaaaaaaaaaaaaagctgggcgtggtgacgcgtgcctgtaatctcagctactcaggagactggggcagaattgcttgaacctgggaggtggaggttgcagtgagccgagatcatgctactgcattccagcctagcgacagagtgagactccatctcaaaaacttaaaaaaaatataataataatattttattgaggaagggcagacagaaagaaaaagagggcaggaggaagagagggaaggaaaaaggcagcatcccaactctttcttactcaaatacgtatgatcacatagctaatctgagaaattatgtgcaaagagaatggcagaggggagtattaaggagctaaacctcggagagtgattcggatcacgagtaagtgttgtgctgaagcatggaaagtctgtgctctggaaaagacactggcaccagcaaccctggattgctgtagaaaagggttctattttttggatataaaattatctactgtatcagaagacacatatgcagatttaaaacttgagcattacccagcagttttatgccctctaccctaaaggttagtgactaagtggttgcagcagtccaggcagtgggagaagagctagcaaagccactagcctgctccagaagagatgactcagttactggcatcttaagggccaagcatgtgggatcttgctaatggcaccctgctcacagtttctgctccacggttcagccagaggtctgtctaggttgtccagtgccaactggagcactggattaaacgttgagatttctgagttaacagataactttcatgtcctatatacctactggtagtaatgaaatttattttgtaatgtgtgacttgcaaaacattaaattcaaggaattgttgttgcttttggaggaaaagaccatctttacaatttatgggccctcagcatggtgaagctctttagcgcaacaatttaacagtaagaataaagttgattagcatctagtattttgaattttctgacacatcttaggacatgtgtctctttctatatagctttgcgaagttttaacaagtgttactcagaaaacctagacttggccttgccttgcctccatacatggtaccacagtcttcctctctccattcttctatgtttctgtagcctgctttaggtttaccataacaaaactatctgttttgccatgggcagattcctgtggaaactgaatcaaggctgttgaaaacacagcctgatgaagccttattccttttttttgtatgtatgtacgcttcctgatgtttatgttgattttttactattatgaataaatatttattttcatggctaataaatatgcatatgtatatacatgtattgatataaaaattaatatatataaataaatacaaaaggagagctaaattttttgagattattaactccaggttaagaatcatgctgtaaaaaaaattctagcaaagctggtttgtgatacaggttttatcaacagccctagcgtatccataaagtttctaagtgagaaaaaagaaatcttacccttagttgcgacttttcaccaaatatgtaaagggctgcttgccgtttcaagagctggttttgtaggtagctgctgttactgaaggaggccgagtgatccttgcctgccagccgggcgccaacatcaatgaaggatgttggagagctgatcaagcgagtgctagagcgaagacttgcccacacaccttcacaaaagccaaagtcgtggagtgagataatctaatgtgggaatgccactaactaaggaaaaaggtgcatgctctggagctacagttttagaggtcatagcaagctgattaatctaaaaaccgtaagtcatatggtcatttgctacttctgtaacataaacattatccaatatagcatttcaaaatcacacaatcttagcctcagaatgacctagcaaatcccccaaatcaatcctattttatattttgatgtaaattcaggatttaaaagtaaatactaagatcttaagcagaaacagtacattgatactgaaaacaaaacatgctggcaggaggtactaataaagtctaggaaggcaaatgctgagttatgcaatttctcagggcttcatgaaaaaagtaaggaacattcttctgcttatttggtcaatttaacatgacatttaaagatatgaaatagaaacttcataagtctactaaaatctgaagctggatttggaattaatatttgtatatcatgccaaaacgatgtaattctaaacaagattatattatatttttcagtatccatgaagaatgagaattataagtttagtaatgggcacagtgcctcatgcctgtaatactagcactttgggaggccaaggtgggcagatcgcttgagcccaggagtttgaaaccagcctgggcaacatggtgaaaccccgtctctaccaaaaaaaaaaaaaaaaaaaaaaaaactacaaaaagacacctgtattgggaggctgaaatgggaggatcacttgaccgctggaggtggaggttgcagtgagccaagatagcgccactgcgctacatactgggcaacagagtaagacactgtctctaaaataaaataaaataaatgaataaaatgtacagtcagaagcctatatctttattttattttttttgagacagagtttcgctcttgttgcctaggctggtgtgcaatggcgtgatctcagcacatcacaacctccacctcctgggttcaagcgattctcctgcctcagcctcctgagtagctgggattacaggcatgcaccaccatgcctggctaattttgtatttttagtagagacggggtttcttcatgttgatcaggctggtctcgaactcccgacctcaggtgatctgcctgcctcagcctcccaaagtgctgggattacaggcatgagccaccacgcccagccagaagcagataccttctaagagaaagggcaagctaaaatgctagcagagtctcaatgagataagatgaccttagttatattaattagaaaaatcaaggatttctatatgcaagtgagactattaaatatcaaacatccagacacaaaggcatgtactaattctcaaatttgactagcactgtatcaccttcaaatcaagaggccctcataaatgcctgtagaactgtggtgtttatctcattgatggggtcacagggatacaggactttcctactgcctccctcaagtgggttttcttctttagatctagaaagcctgtttgagaagctttagtcttttcctagtattaaagtcatgtttctaggtgaccagaagtcaccatgatgtcacatctgcttctctttctctttataagcatttacggggtcaggagaccagttcccaagaaaagtttttattggtcatttcagcttcacatgcacgaatctttctttgagatggagtttcactcttgttgcccaggctggagtgcaatggcgtgatctcggctcaccacagcctctgcctcctgggttcaagtgattctcctgccttagcctcccgagtagctgggattacaggtgcacaccaccacgcccggctaatttttgtatttttagtagagatggggtttcaccatcttggtcaggctggtcttgaactcccgacctcaggtgatccgcccgcctcagcctcccaaagtgctgggattacaggtgcgagccaccacacccggctgcatgaatctttctacgtagtttacgaggttttcttagacattatggcaattattaatttttttgtaaatggaatcagaggaaattcagaatgcagatgagaataaaggatataattttacaaatgcaaaaaaattacttgtaacatatgtagtttcacatgaagatggtttaaaagagtgatatatcaggacacataatacagtaccttgattatggactcttcccttagctgaagatttgggatttgactgagtaaaacatttatctctgtacccatgcactggtaggtaagattaaagacagaaagagaaataaaatgtatatagcagcaaatgtcagagcagattgagtaagagaagaataggctatttaatttttaaaattagcaggggaaaaatgtaaatataataaaagtagaagatttaattaacaaacaaaaagctgcacagtcacaaaaaaaagatgtattgagtacctgttaaatgaaatttcagcacctgtttataaatactataagcacaatgaaatggacagcacacagcagaaggtgccactaaaaaattataccaaatggaagaagcttttgaagattgtcattcagtcagaaacaaatttttataataaaattaaggaatttggggtgtgtatgggtgaatgttaggaatacattggtcctcatattgaaggagaatggcgaatgctgcatgttgtacaacacgtttgttctttgagcaaggtcatcacaccaggaaacaatgaagctctagcaaccatttggaataactaagggcatgtttttgcagtagagcattaagcattgccacgctatcttccttcttctcttttcatttggaaattatatttattttccataattagttacgagcagcaaaaattcataatcctgtgacaatacccaatatcactaataatacagcttgtgatgactgaagtaatgacttctcttaaaatccctacttgcaccaaaatgacaggcagtattagagataatagttttgtaatttgagtaatatatttttttccaacagaaaggggtttatgatgatggcaaaccaaaaattgtgagcagttttagcactttccaagcaaacaaattgctcaagtcaattagaagaaatgattttatatttattcaggattacaatctttaatagtagtattaagttataaaatgcaaaagtgtataacatatgacataacaaaaatcattacaagtgagttttcactcccacttcactcctttggaagcagaaaatgaagggcactgatggctctggtggccaaaggaagccagaaagtaagggctgcagaggtgctggctgatgacagacagagaatgtgactgcaagatggaacgaaggcttgggacatggccaaggcacactgtgtggcctcctctgtgttggctgactgctctcctttctgccaaaattttgaactttcctattgaatatgggacactaagatgatgacagtgatgcttgagtagttcctgattctgagatactgttcccttaacacatcacactttcttatgctagtcttactgcctggaatgatttcccccatttccttacctgacacattcctacttaacccttaagatccagatacaatattagcacctcttaaaggcattcctgactgctcccaagctgaggagctctatttgaactttgatcacattgtgtcgattatctgtatattctttcactctacaagattgtgtgtgtgaaaggaaaataaaaactcaggactccagttcactacgtcaaaaggaaaaaattaggctgaaaggtgagacataacaagacgctgcttttccttttgttcctaaacaaacagctacagttaaaaggttaaacttatccacaggtagctactggtatgttcactttaccttacagatgaatacataattgactattcccctacctgctccttttttcttgcaacatgtggattactataccctccctctttctcgtttaaatattaaagccctcaaaatcattgttggagaaaggcacagacctttctccagggcgagtccttaaccttggcaaaataaacttctgaatttattgagacctgtctcaggtactttttggtttacatgtgcttgtgagggcaggcacctaatcatgtttattctcgtatccatgctgagagcctgaaatacaggcactcaaagaatttgttgattatttactttttgcaaaccaatacattgtgagctgttctgactcattattgtatcttcaacccaattatttgcactgaaagagtgaaaagggggtattaaacaaaaaatattaaggactcccccaaacagaggctcatcaatgaaaaactgccaagttttggccaattagtagaaaatccgcaatgataaaatggccagtactgatatggggccagcagggagctttgagaattctaatcccatctggaagtcattttaaccaaaggaattagactaccgcattggttgttggtggtgaggtctacttagatttcctgaatgatttctagatgtcctgggcacttaacaccagcaaaacgtctcaagctgtgtttttccaagctgcaggatcctccttagtggcttgggaaatcactctaataggtcaaatcagtatttttttcaaaattaaacattacagttgaaaatactaatgagcactgcatgtggtacggatgaatattgtttcacagaacttttgttttagtgtatacattatacattttgcatgtgccttagtactacctgaattgtgatataaaatgaatgggtatatatacatataaatataaaatacatttcttactgcgagtcatgatcaaacaagtttgaaagtcactggctaaacctagggcatatgccttctatctcttgccttagatcagtaaggctcaaagcaatttaaatgcaaatgtcgactttcttcccatttcagcagagtattaggcaatggcaatgataacaataactataataataatgacaactaacatctattaaaatgctactatgggctagttactaagttaaatgttttacatatactatttaatttattcctcataactaccttaaaagtctatattattttttaaagatgaagacactgagaattaagaggtttcctaatttgcttaatcacacagtaagtagtgggactatggtttgaattagaatgtaactaaactcttttttttttttttttttttgagacggagtctcgctctgtcacccaggctggagtgcagtggcgcgatcctggctcactgcaagctccgcctcccgggttcaagccattctcctgcctcagcctcccgcatagctgggactacaggcgcccgccaccacgcccggctaattttttgtatttttagtagagacagggtttcactgtgttagccaggatggtctcgatctcctgaccacgtgatccgcccgcctcggcctcccaaagtgctgggattacaggcgtgagccaccgcacccggccactaaactcttaatgtattgtttcctgaggaaccatgtgaccttggacccaatcagtaagaaccggctaaggggactgcttcagggaagatatgacacagttcattttccccataggaatgcgttactgttcagagaactagtgtttcctaagcactggtgttatttcctctactctgttctgacgaaaggggagagggaaaagagatgcttaggtcacatgtggggccttattgatcactgtgatcttatacctggcccagtgcatgagacactagatgtattcagtaaatatatctgcactgatacgatgcaacactgaactaattctagtcccagttatactaatatttgctatgcagccttggccaagtcacttaatctccctgggcctctttaaatacatatcctggaggttatttcaagaataaaataatacatggagaaaaacttaaaatgtaaaggatgaaaaattaaaaagctgcctccaagtggctacttctcaaatatacccagctattatattttggtatttgagaggcagtactaattttctcaaggcatttttctactcaacaaagaaatttatccaagttgtaagtatatgtgtttccccattgggcttaaatgctactttaattttaaatgaaaaacaatgtgatctattcacttcttgcttttaaaatgattcttaggtaaaaaaggatgcagcccttgtattaggaactcaccaacatgcatgctgaatgcaaagtgatcaccctgactgaaaaagaggtgaaggtcaattttaaccctggctcatcagaccaggagagacacacagtggaaataacataagaaaacttggaactaagactgtacgacaatgaaaagaatgaaaaaaattgtgaaaataggggagcaaaaagaaaaaggctaggaagaagaactaggggttagggtaaaaaaaaaaaaaaagaagaagaagaattaaatgataggaggctcctctcacagtggtatctaactctggaagaatgaagagactctgtactgtgagtcggtacaaggaaatgaattacttgcaaggcatgggcatgtttatacctagtcttgccctggccagtctaaatgtgtgtctgcctggtatgttcacataacagagaatcttttgagacccttaacttgcttgcctcagttcattcgtcctactttgagaaggaatgacactatcagaagaaacacagaaagcagctctagagatcacagagaatgttgaaggtgtcaggaaacagcagtatctctttgtccagtttatcactgggacttcacaaggttttggaggctttaggagtgaagagttaagagatggagtaaaagaatgagatttgcgtttctggattttagcttaagataccataatgacaagcacctggttaggagtaaaaaactgtcataaggaaacaagccaaattcacagtaattttcagcagaaagtatttgagaagggtgtcagaaataatatttatagcctcagatatgcacatagtggtcataagttaaataggagattttaatctgaaaaggtaaatacagccttctgggtgcctttaggattagcaaagaatggagtcataagaatataaccactactgggaattcccttgtataaaagaagccaagagttggaggccagtgttaaaaaagaagatagtgtagttgaaaaagattgttaaggccgggtgcagtggctcacacctgtaatcccagcaatttgggaggctgaggtgggtgaatcacgaggtcaggagatcgagatcatcctggccaacgtggtgaaaccccatctctactaaaaatacaaaaattagctgggcacggtggcacgtgcctgtaatcccagctactcgggaggctgaggcaggagaattgcttgaaccagggagtctgaggttgcagtgagccaagatcaagatcgctccactgcactccagcctggtgacagagcgagactccatctcaaaaaaaaaaaaaaaagaaaaaaagaaaaagattgttgaaaatctatgaaccttgagtaccaacataataggaggagacaactgtgcagctacaatttatattataggccacctggccaaatgttggaatggataacatggtgacgtgtacaatggcaaaatacaagatcaggttgtggggtgggagggtttcaattaactagacatctgctgaaagttgcactgtctaaaagttgagtggaaaaattactgactttccttgctgacaatgtaaactttcatatggtaaataaagcagtaaggggaaatgcaatctcgaaccaaattctgacaagagtgcttagcaactgaaatactaggaaccttaggaaaaaaatcactgtaccatcttttagttcaaattcactgagaaagaaatgatgagaagaacgaagcgtgtatcttaaactttaaaataatagtactctaaaaattcagaaaaatgatatatatggctgtaatgggttgaaatgtgtccccctcccaaaatttatattaaatcccaacccccagtgcctcagaatatatatcattagttaagatgaggtcatactggagtagaatgggcccctaattcaatatgactggtgtacttataaaaggagaaatttggagccagacacagagggagaatgccatgtgaagatgagggcagagatttaggtaatgcttccagaagccaagcaatgccaaagatggccagcaaacctccagaagctaggagaaaggcatggaacagattcctcctcacagccctcagaaggaaccaactccctgacaccctgatcttggacttccagcttccagaactgtgagacaatagttgtttaagccacccaatttgtggcactttgttacggtagccctaggaaaccaatacaacgacttcaaggcctgacacactcattggaaagatgactcaaggaggttgaaagctcttaggaaatcctgcaattacagaaagttctgacgaggcaggaaaagaaagtatccaaaaaaccagtatgaccactaggagatgtgtacggttttcaaaagggaaaaaagtgaattttgtaaagtagaatctttatgttgattctgaaccaaattctaggaatggagtatcaatggactattcatagttacttttaaaaaaaagcactgattcgtataataagtcacagcaaaataaccataaaacccttggtgatgcagtgaattgtttgaaagactggcaaatagtggattaaaacgattgacagagatttagaaatatgggcctggtgagttttagtgggaagactcataaccagtatagatgaacagactgatctttttcttcagaggggtttatattattttgctgtaggtctttgtccttagctctggcttgttcaacatttttttaaacgaagaatcacatgagaacaatgatcaaatgtatggatgacaaaaggcttgaaaacagcaaatgcactggtagacagaatcagggtccaaaggtctaaaataccagtccacaccccaaaacatgaaatttcctagttgtaacactgctagtgggtccaaaaagcaaccatcaaggccagtgtatttttaagaacaatagcacatgtgaagcagacagggatttcaaatgatattaatctccacatgggttaacctagtgatggggctgcccatagctaatgcagttttaggctgtgagaacacctagagtgctgggttcaattctgtggagtgttcagagtgataaggatggtgagtggactacaaccatttcaactggggatattcagagttaactaaaggcaggaaaagaaagtatccaaaggaccaagatgtgtatggttttcaaaagggaaaaaagtgaattttgtaaaaagtgaattttgtagaaagcaagcctgacaagagtttttcctgaagggttttacgtgtgggagagtacacttactttctaacctcagaggatagagctagggccaatatgtaaaagtggtggtcaatatgagaaagcaacacatagagttgctcacaaatgtaagggattattttggggaagaaatgagtttcccattactgatgatgttcaagcagaaacaagattacttacttagtgtgtggtgtgtatatatatatatatatatgtgtgtgtgtgtgtgtgtatgtgtgtgtgtgtatgtatatatatacacacacacttttgtttattttttgagatggagttttgctcttgttgcccaggctggagtgatctcggctcattttgctcttgttgcccagcaatggtgcgatcttggctctatgcaacctctgcctcccggtctatgcaacctctgcctcccgggttcaactgattctcctgtctcagcctcctgagtagctgagactacaggtgtgcaccaccacgcctggctaattttagtatttttagtagagacagggtttcaccatgttggccaggctggtctggaattcctgacctcaggtgatctgcttgcctcagcctcccaaagtgctgggattataggcgtgagccaccgtgcccggcctacttagtatctttttaagggaattcatcattatatgggggtgagaggaagagtctaagattctgtgactccattgtgagacagtgggacttcacagttgagatatctggggccaggtgctttctcacgcctgtaatcccagcactttgggaagcccaggtgggaggactgcttcaggccaggagttcaagaccagcctgggcaacatagtaagactctgtcccaaaaaatattttaaaaatttagctgggagtggtggcacacacctgtagtcttagctccttgggagcttgaggcaggaggattgctcaagcccaggagttggaggctgcagttagttagctatgacagttccactgcactccagcctgggcaacaaagtaagactctgtcttaaaaaaaaaaaaaaaagaatctggtctggaatttcctctgcagagtgaaaagaatctcacataaacttccagagaacaaagtggatgaccttttggagcttaaaagaatgaatacttagcctttctctatttcctcatgtcagcagctacctggatatcatgatgtcttatcctccaaaccagtatttcagaggacaggagcaaaaataacaggacttggagttccttcgatctggaatcacttctccttaactatctatacttctgtgatagattggtctttctgccctgcaaatctggagtatcagggagtactcccagggctgactcatcatttagacatgctccccttacctcttaatgctcccaaacttatcaatatatatgacatcagcaattattatacttcttgtcccacaaggctaagctcatctgtcatcatgctagtaatacatttgaccattcattcagaagagggtaattaagaacaatttgaatcataattaattgatttaaaatatcaactatctagaaaaatgctttctgcttttaagcttgcatcagtgctcagttataaaatcaatcttactaacctccttgagcaaagctattggatgggtttacatccaaatgtcctggcactacctgcttaagcacagtggacattcttgaagtcctcctttcagtccctaaagtcagccaaaaagaagaacaaaaaccatgttgtttgggttaacattactcaaatgacaaaaagttatcttcaggtgtagcatgtttaactgctgccaaacattgtacttttaagtacccaaagctttattagagataacaaggcaatgttattattaatcagagataacacacatttgcaagattatagagagttaggtttggcaagtgcaatcagagaatttaatgataaatggagcaaggcatgcatggtgttattttacaagaaaagccactttctgcttatgttgagctaattcaaatagctgattaagccaaagagaccaacttctcaagtcacatgctcctgtgtctaacacattagggttacctctacatgaaccctttggggttccatcacatgataactgaaacagaatattagtacaagtcttaatggcttcatccaaatccagtgaaaacaaattgtactgaaaatcataataggctgcagatattttgggaatttcaaacttataaatgatgattttaataaatacacatttaacaaacatgttccacttacatattccatgtcataagaatattttaaagtctatgaaagataaatatgggaataaagggtgactttatttatatttcccacttcctctccaattactcttttgaaaaggaaataactgagctgggtatgataaatatgggaataaagggtgactttatttatattccccacttcctctccaattactcttttgaaaaggaaataactgagctcacacctcacacctgtaatctcagtactttgggaggctgaggcgggaagactgcttgagcccagaagttcgagaccagactgggcaacacagtgagaccccatctcttaaaaaaaagaaaataaaacaaaaaagaaaaaactgaatctctaagttaagttactatttactagacattaatagtggtagatttctaagtaaaaggagttaaacttataacccttcagggtaaaacttttaagaagtcttggtgaaggaacagtacaaataacaaataacagtacaaataaccctaggaacagaactgacctttcattagaagctgtcaagaagaaaagtattatcaaatcttacctggagatagagcaaaggctggcctgacagtaagagtgctgttgcctctgagtttctgatggacagaaacagcattcagtaaggcttgcaagtatttctcttgttctatgctactggaagattctaaagaggaggtaggagctataaaaggaaaatatattgaataaaataaactgtctctgtgttaacaaaacaagtatctatctatctatctatctacctatctatctatgcttatttttctctatatagtctacaagttaccacacccaaatatagaaaccagccccacttaaattgccagtctattaaatggctaatcctccactgtaatgctggttttaccacacctacttcttgattgcctcattatgcttccagaaagagcccaggtctggaaaaccagcacagggctacccttccaagcacagattgggcttgaaagcacagggcatagcttctcattatccaagcaactcaaaatgaagattcatgaacaacaacgccttgatgatatcccccaaccatcctgaccaggttattgcttgggagtgggttcctttgacatcccagaatgggtagagttaagaactttccaataccagcaactttatttcaattctgccacacaggcccaccaggggacatgagcctataaagatttgtagagggaagagtggaagaagatggggagaagataggagcaactactgccaatccctggtccttctaaatgaggagcaaaaagtatacacaattgtgagagcaattctgggttgatgggcatataagcctggtttgggtgaagcaaaacagaatcactgaaatcggcccagacagtttaaagaggacaggggatggactcactacaaggacaacagatattcataaattttcttacaacttgaatagaaaataaataattagcattattgtattttatcaactttaatatgtcatcaattctaagacgcactgttattttattgcctaacaataaaaactgcttatcaattaaaaaactgccatttaaactatgacactattctttctgatcacatcaattgtaagatgcattgcaatttcaaagatactagttgtcagccaggcgcagtggttcacgtctgtaatcccagcacttaggaaggctgaggcaggcagatcacctgaggtcaggagttcgagaccagcctgactaacatggtgaaaccccatctctactaaaaatacaaaaattagctgggtgtagtggcgggcgcctgtaatcccagctactcgggaggctgaggcaggagaatcgcttgaaccttggaggcggaggttgcagtgagccaagattgcgccattgcactccagcctgagcgacagagcaagactccagctcaaaaacaaaaaaaaaaaaacaaaaacaaaacaaaacaaaaaacaaaaaacaaaaaaaccctaaagatattagttgtgagtaaatgtggaagttgaatatgaaatatagtaaatttaaattagatttaaaaaaatcagcaaccagtggaataagtttcaattgttttccaactaaaagcttagtgatacgcttatcggtgctcccaaaatcattcactcattttacataacatatatgcttgtgttctattttactattattttatttcattttttttgagacagggtcttattctttcactcagggtggagtgcagtggtgcaatcgtggctcactatagcctttacctcatgggctcaagtgattctcccacctcagcctcctgaatagctgggactcaggcacgtgccaccacgcctggctaatttttgtatttttttgtagatatggggttttgccatgttgcccaggctggtcttgaactcctgggcgcaagcaatcctcccaccttggccttccaagtagctgggactacaggcatgagccattgcacctggccccttcttatgttctaacatacccaccaggtggcttgggagcacacagtgtttcagaggagaaatagtaaacagccaattgccttcaattacaccagtagtgagacttcaaggcaggtggaaggctgccctcagtcaacctaatgatcaaaacattggctgactttcaaaaagcacatggttgtacctggtgaatcacagattctgagtttacttcatttccaaaggtggaagaatgcagccatccctaaatcggatctgatatcttagtggcctactgtttcattttttttgagcatctattatgaggcagaagctatgagaaaggtcagcaaaatacagctcctgacttcaagacctcagacatggtactcacaagtatcctcagaatatgggacagctgtacttattatttcgctagcttcctaaaaacctctttgcttgaaagatcctgaagcagcatttgcagtcattagtttgctgtcttgtgtgtgcgtatgacttgtaagagtgaggatggatatctcatatcacatggcacagaagctcatcttacctctgaagctgttaaatgtatttggatgcttcccaggagaaagaaaaaagattggtataacctagtttccatctgtgaatactctggtttgctggaatgaaaattgcctaggaccaaagactttattatattaatttctattaaaatccaagtacagaccagacatattaagatgtcaaattcaatgtggagcctcacactatcaagtatagttcttgtttaagctgtacatgttgcatgtagcaaagtggaaaagtttgtgtgtgagacaagacttgatgaaaaggcaccattcccagattttacttcctttatttttagcactgtccttatgtgaacgggtggtaattgtgttatagagagatgcttaccggcctgaggggagttctgagatttgaaaagaccaacgactcccttcccatggaatcctccagatcggaggagcagagtaccacttcttgagttcttccaacatacaacaggcaggcgattgtgtcgatagcagcgagctactcttggtaaactactgtcctgtacagcttgaggtacgactaaaaggccaggatagcttcagagacatagaatagagaagagaatgattgggggaaggaacagaggggaagaaaaggggaaaggaaatgagagaagagggagacagagaatataagaaattgaatactaatatcatagtaattttctaagattcagaaacatattagttgaagggtaagatatatttattttcttttttaattttatttttatttttgtagagacagggtctcactttgttgtacaggctggtttcaaatttttgggctcaagcgatcctccttcctcagcctcccaaagtgctgggattatgggcgtgagccattgtgcctggccaacatatttcaaatatggaacttagtttcaacttctgaattcttcagggattgagaagaaaatccctagatggtgaaaatagctaactcatccactgatctgtagtcttttttgaaaagagccccattcactgatattgcagacttctgttgaataaacttagaaaataaaaatattatgtagaattctttaaaaggcctctgttgaactatttcccttgccttatacattacttttccacaacttgaaataaagatcgtaagattaccagattaatgtcaactttatgagaatgacaagtcaaattgtaaacaattcatagatcactgagatgacattagagaatacagcatgccaatattagactgcctgagatggtgaaaggcttaaaaaccaaaaccaaattatttttggcatgagaacaatttgttcaaatgtcaaatgagtttaaatagttaataacactacatgttgatacttattttaaaagattagcttataaagttacaggatatgatgctgggaaaataacatgtaagagtacacacagattaataaatgcaagaagacaggcaggtttcagagtcatttcttttttttagtttaattagaaatattacacaaaacagattttatatttataacctcctaaccactaatcctatatcttttttttggtgatttttttttttttttttgagatgcagtctcgctctgtcgcccaggctggagtgcagtggcacgatctcggcccattgcaagctccgcctcccgggttcacgccattctcctgcctcagcctcccgagtagctacgactacaagcgcctgccaccatccctggctaattttttgtattttcaatagagacggggtttcaccgtgttagccaggatggtctcgatctcctgacctcgtgatctgcccaccttggcctcccaaagtgctgggattacaggcatgagccaccgtgcccagctggtgatttataaattttgggaaaatatacctaacataaaatttatcatgctatccttttttttttttttttgagatggagtttcactgttgcccaggctggagtgcaatggcgtgatctcagctcaccgcaacctctgcctccggggttcaagcaattctcctttctcagcctcctgagtagctgggattacaggcatgtgccaccacgcctggctaattttgtatttttagcagagacagggtttctccatgttggtcaggctgtctcgaactctcaacctcaggtgatccacctgcctcggcctcccaaagtgctgggagtacaggcgtgagccactgcgcccggcccatggtatctttttatttattttattttttatttattttttgagacacagtttcgctcttgttgcctaggctggagtgcaatggtgcgatcttggctcactgcaaccttcgcctcctgggttcaagcaattctcctgcctcagcctcctgagtagctgggattacagacatgtgccaccacacctggctaattttgtatttttagtagagatggggtttctccatgttggtcaggctggtctcggactcctgaccttaggtgatctgcccgcctcggcctcccaaagtgctaggattcatgctatccttttttatgtgtacaaaccagtggcatttagtacattcccaatgttatgcaactaccaccactatccatttccagaacttcttatcccttatcttgataagaaccagtgctgacaggagggaaaggaaatctagtttatggtcacataaatcataaccttcaactactttactgaatgccaaattaactttccatacttaaccaatgataacttggaagcattctgaaagcctagggctttggtgatctaggaagctgtggcctgaatttttgtaataccacaaactgatgaaaagaccaagctatagacataatcactcatgaagactgaaaaggcagttccataattaggaccctctatctccacttgaatatcagtttttcccaacttgcttcaagatacaatgtgtattagacagggaaataatgtttaatggttccaggagctacttcaataatcggtaaagaacgagcacactccttcactccctgccccctgtagtgagccatctccttccactgtgaatgagcactacacacagaccatcctctgttacatacaagatctatggctctctcctgcttcctgacatgggcttgcatgacagctggagagcccctcatgctggggcaaattgtgtgaagcctaaagaccaagagaagctactcccagtaccagtctcatttcgtaatgaaagatatcaatttccctgccacccatcctaacccactactcagagccttcagctctgggctccacagttaactctcaagaggtagactaggcttcagaagctgttgtggaaactttttaattcaagcataattcacatacaaatgctcaaaacctaggtgatatcactaccacctaggtcaagaaattgaccactacaagcatccaagatctagtatttcctccaagtcactatttattcttctttcttaaagattaccactatcctgcctggcatggtggcttacacctgtaatcccagcactttgggaggcccagctgggaggatggcttgagcctaggagtttgagaccagcctgggcaacatagtgagacctcttctctacaaaaataaataaataaaataaaaagaaaattagacaggtttggtggcatgcgcctagtcccagctactcagaaagctgaggtggaaggatcgcctgagccagggaggttgaggctgcagtgagttggaatcacatcactgcactccagcctgggagacagagcaagaccttgtctcaaaaaaaaaaaaaaaagattactactatcctgactaacaatgtggatgaattttgcttctttttgaattctagataaagggaatcaacagagtttattctttcatgtttggcttcttttgctcaatattatgtttatgagatccatccgtgttatttgtactcacgtgtagtttgttcattttcattactgtatttcactgtgtgagtatgataccatttatctattctcttgttgattttgagtagtttctagtttttttaattattaagaatgttgccatgaacattcttgtagatgtcttttgggagcacatatgtatttctgttagaaattctactccacctaagaggagaatttctaggaattaggttatgaatatgttcagtagatgtttaaatgtttagacagcattagacaactttccaaagttatttaaccaatttatagtcctttttactctcttgatgatatctcctgatatacagaagttctaaatttatcaattttttactttatagataatgtttttcctatcccaagaaatctttccctatacctcaaggtcatggagacattctcttatcttctagaagctttattgttttaagcttatttgctttaaccttaataacaaacctattgttttattgttttaaccttttacatatagatctataggtcaatgggaataggtcaagattaatttttcccagcatcctttattgaaaaaacatcttctatccactgctcttaagtgttatttttatcttaaatcaagtatccacatatgttggggtgtttctgtttaatatattccctattttgctccactggtccgtttgtccattcttgtgtcagtcctatactgtcttaattactgtagctttataaaaactcttgacatcctatagtattattctgtaagactatcttggctactctgccttccacatttttatgtaactcttagaattaccttttcagtttccattaacattttgctgagattgggactgattctatagaacaatttcaggaaattcagttttagaatactgaatattctaatctaagaacctgaaatatctacttatttagctcttcaatgatcttcaatattgttttaagtattccatgtagaggtcttgcactggttattagattcatccctaagtaatgttttttagtgctactgtaaatagtaggaataataccaaaatagcatcactttttgaaaatttcattttgtaataatgtttttagtatatatataattattgtaaatgaccttgtactagtgaccttatcagtgaccttgtactaaatccacttaataattttaaaagtttattggcagattcctacagattttctacatgtgcattttggtcatctgtgagtaatggcagttttatttctttcttttcaatttttataccttttattacttttctagtctctttgcactgcctaagacctctagtacaacactgaatagaaatggtgataatgggcatccttgtcaggatttcagagaaaaagcttttaatattttatttatttctaagataagtaatttcctgtgtaggatttttaagacagaagattaaggagctacccactgttccactgtagacttctctgaggccttcagggcgctactcatgggagctcattcttactctcttttgctgagagcttttttctaaagatcacaaatgtgacaaaaaatacagaatttacataaataaatttacataaataaaactcataagtgtactttgcatttgcaaaatgcttatctttatataataaacttctttttaattctgttaatgtggtaaattacactgactgattttcagatgtgaaaccagtactctattcctacaataaactccacttgatcttaatgaattgctgtgtgtaaaataaaccttttgtcattatcaaccatcctttcttactgcttttaaagtctactttgatattcatatagtgacaacaactttttttaaaggtagttttgcgtggtatattttttctatccttttactttctacctttttatatacttgtatattagatttgtcccttaaaagcagcagaaagctttttttttggagacggagtgttgctctgtcaccaggctggagtgcagtagcttgacctcggctcactgtaacctccaccaccagggttcaagtgattctcctgcctcagcctcccaagtagctgggactacaggcacaagccaccatgcccagctaatttttgtatttttagtagacacagggtttcaccatgttggccaggatggtctccatctcttgacctcgtgatctgcctgcctcggcctcccaaagtgctgggattacaggcgtgagccactgagcccagccactttttttttttttttttttttaaagcaaaccctgatctctttctttgaattggaacatttagtcaattaataattaatgcaattatggatatatttgaatttaaatctaccatcttactacttgttatttattccatttgttctatgtccccttttttttcctttcttgccttcttttggattattttttattattccatttccttcctgctaataacttaatggatatatattactttttaccatcataaatgctttataaccagtgttctaataagtcatctattaaaattttattttacttctgacagattggaatgataaatgagtctgttttctcaatggctggcataattttgatagcaaactttccaaacagcaggacatcacaccccgacaacatgactcatcttcagagaaaatttagttagaatgacggagaattccagaaaaattactgcatactcagagtgccaatttttcagaacttcatgcaaaatgtttatttggccacaatctcaaaactatattcccaacttgtttctgaagtttcatattaatatttgtaaacttaaattgccatttaaaatgacatatctatcttcaagagcaacagggttgaaagtaacattaagataactttctaaaatatgtacaaagcttacaatttacaaagtgatttcagagctgtttaagcaggaatttataaatgcaaagaaaaatcttacctggagatgaaaatgactaaacttgtggatggtgaaaatgtaattttagaaaatatatatttacatatagtaaagcatggaataagactcaacatatttgaaaaacagtgagagatgacaagaactgaaaaaagaaaatgcctctttatttacatcctttaagtaatattcccttgaaaacattccaattagaccgcataagaaagccttgcctacacctgggtcagcaaattatagcctgtgggccaaaactggccatgcctactcatttccttactgtctgtggctgcttttgcggcacagttgaatagctgcaacaagagactctatggctcataaactgaaaatatttaccaactgaccctttatagaaagagtttgtggctccccagcctacaaaagactttcatgtcctctattgggctgggaaaatcctgttcttcaagttatctttagtcatgctagaaaagaagcaaactgggaagagaaagacaagagaaattcatagggggtgagtactttacctttcaccttctcacctactagaggtactttcagtaaggtaattgttccgagaatgccaatgagatgcttgctcgtatcctggagaccttgttcttattttcaggcatttttatctatctcagggctatggatgcaaatggcctattaaagattcaaataagaagaaaggaaggaagacctctttttggagcccactgacacacttacctccggcagagtgaatacatcctgttggaggcagtaattctaaaatactcgggtcttgaacgggaagagctgccacttatggttcctaaacctaaacgctgatagtctctgaaacaagctttttccaccaactgttccattgtagacttctcggaggccttcagggtggtacttgtggggagctcactctcatctgaaactgtgatggtagagacagatatcgaagaaatgattagctcaaagcaattgaggtcttcagggtagtacctgtggggagctcactctcatctgaaactgtgatggtagagacagatatcaaagaaatgattagctcaaagcaattgaggccttcagggtagtacctgtggggagctcactctcatctgaaactgggatggtagagacagatattgaagaaatgattagctcaaagcacaggattaaaaacttccttttgggctgggtgtggtggctcacgcctgtaatcccagcactgggaggctgaggtgggcggatcacaaggtcaggagttcgagagcagcctgaccaacatggtgaaatctcatctctactaaaaatacaaaaaattagccaggtgtggcggcaggcacctgtaatcccagctactcgggaggctgaggcaggagaatcacttgaacccgggaggtggaggttgcagtgagctgagaccgtgccactgcactccagcctgggcaaccgagcgagactttgtctcaaaccccgcccccagccgcaaaaaaaaaaaaaaacaaacccgctacttttgaagaagactcttacaccaagacaggtttatattaggatgacaagtattatgtatatcacaaattaaatcatgtaacttctgtgaggaatcacacttaaataaacataaattaaaagtgtaatgaatagtcaagaaataaaatatcagtaattcaactaaaaaatgtcaggaaaataataccatttaaataatttctaaaaacaatataattttgaattcattacctacactgttctgtttcatgaaggcttgcttattgtcaaattgcagtgatttctatttaggactctataaaaacacccaaagtttgtcagaggctaacccatcagtaaaatttatctttcataaaatcactatacaaactcatcatccagatttcagtttacttttcagactataaacttttattagaaatttctggattaaccagaagttcactagagggaaaaataactttatttcctcagagaggtataaaggagttacacttttttcctggaaatatttttgttagaggatgtggtgtacgtgggaaatcccctcacagttttacaatcacaggttacagaatcctttacaattttagatgtggaagaatttactcaataatcaaatattttagggaggcttttttttttttaaagaacattcctaattggtactgcatgttctaactggggaaaaaaaaaatccatgttaaaaactgtcctaatttacttccctatttattttgaaagtaagagacatcaaatcaagctttcaaagtttttgaaaatgtactcaaagtactaatgtgcaggcaaagatatggccctctttcattaaaatatattttaaaaaagcagaacatcaacaattaagtgtttcaatttgtgaacttcaattcatgtttccatttgtgaacttcacaatgcaatatcatcaggtatcaattctgtgttggcctttaattttcagaggagcaaagaacattatataatttggtcttttagtagaataattatcatagaataataggttttgttccatgaaatataaaaaaaattgagttagaagagtcaatagtgatgggtagcgataatatttttatggtttgacacatgactgtgaaaagatcagggttccaacaaatgggtgtggtgttatttcagtgatataatggtgggtattttcattgccccaaaggcaagcttgtatgtacatgttctcacccagggcatgcatacatacatacaaaaccacataggttcttttttttttttttgaggcagagtcttgctctgtccgacccaggctggagtgcagtggtgcaatctcggctcactgcaaccttctcctcccaagttcaagcaattctcatgcctcagcctcctgagcagtagggactacaggcgcatgccaccatgcctggctaaaattttgtattttcagtagcaacagggtttcgccatgttggccaggctggtctcgaactcctggcctcaagtgatctgcctgcctcagcctcccaaagtgctgggattacaggcatgagccactgcgcctggcccacataggttctttatcccagcaactgaaaatggagaccggttagccagtgctttctctgaagatgaggtttcttttttaaaatgttgttgttgttagtagtagtttttgcaaaaccaccggtgactgattctaagatcctgaggggaaaaaaagggtgtaatggcattctgcctcccattatatcagcttctctgtagtgctgattccatagcatatttgatactgggttaagaatgggaaacagtcactcagagattttgctactagctttctgcctctatttttcccactgagagatattgtagctgttctttcaaatatttagcaagtattttttcttatgacctaagtattccttcatcttaggtcccccattttgattaagagcaccaacaatgttcttaccaaaaactgaaatcttcaacttgaaatgttcaatgtccttaccttaaattcttattctagaaggataagatacaggggactactctatacctaaatttcccatgcagtggggttcccttctttcttcttttaatgagacacacataaaaatgaccaattagctgtatgaatttagtaaagaagtataatttaacaaaatattacctgaacaatgggatattgggaaaatatttttcccccagttctaagaagctggtaagtgcttccatcttctcatgagatctaggtttttgtgaatcaagatgtaagtgcaactacatctgagtctcttattcatataagaaataaagttgaataatgaaggaaattcaagttttcacataccagatacatcatcatcttcattccatccaggacgatttactctttcttccacaattgtccctgtcttcttcttcagtaaatattgccgcccaattgtcattttccctgcccttttggcacctttcacaattgtttttgagaaggtactacaagtcataaaaccaaagagaatgtcaacttaatataaaagcactacttgtattgttgacacctacttagctcaaattgtttcttctcctttcccacagccactactggtccagactcttgttaagcctctccttctttaggttacttttaatatggcagtagactaatttcccataaaacaccactgtcatcaggatactgtcttaggaaaaacgtgcaggaaaatgtaaagtgagacacaaactacttatcaccccaaatctaaactccttggtttagcttgtcggggaggactgccctgaacccactctggttatcctcatgccactgtccctaccacagttcccacaaagcatgcttgttggagtcctcctacatggaaagccagcctgcccacttctctacttactcaaactctctttctaccaactcacaagcctttctttgagatcatatggccttcatagttggcaacacatttgcttatttcttaactgttttaagtgtgtatatgtgatgtcctgactctaattagctgtaaactttaagaagcatagaaaaataatataattccccttttttgaaggagaaaaataagaaatcagaaacttgagtatccttttgagaatcagctttaattaaagggaaactaagatgtaatggacctagaagtactttatttattcaaacaatttaacccttcttgctgacagaaaatctaggcaatccagagaattaaacagagaacctatttcctgactaatcagatggaggtgaagactctgaagactgttcttgattatattcttctctatcacaaagaactcttctggtgttttcttgccattcagtaaaaagtgataaggcttcttttattatcaaatagtttcaccagactccatctttagttatttgcaatgtaaacctgaaggttatgaaacatgtttgagataacagctgggaatcataaaatactgatatttcctaaattaaacttattgtaaatcacttgtgtaacttttattttttaatttttattagtgggctttctggcaaaaactggaaagtctgctagacaaattctaaaagagctgtaacactaggtgtaacttaaactcaatgggatttttgaaattttttcccagctaaagctatatatatcttttgtttcatatacccaggcaactcttaaaatttttaaattgctacatctctgttgcagctgatataacaggcttgatacaggtatatatttctgaaactaatataaatatacatgtttctgatagtttctaaatgtaaaataccacacaaagctttgtctcttccattgaaggctgagataacaaacatcataggctcctctccgaccctatggtgctaagacaagatgcttggtccactgctgtaaatccctaggaacttgctcatgcttcagcataccatacctggatattacctggtaagcaaagctagacaggtggctagctgtgcaactgagaaataatatactgtctggaacctcaaattttctataatccccaatctacccttctttcaggcaaaggaagggcctcttttccaaagtctgcaaagctctccctagtattgtaatttgtattggcagatgcccgaattctacatggttaacagtgaatgaaattttagcccttatattttatcaccgatggaagataacttaaaactattgttatttcgtcataactgaagtttaaaactttcaacataaatttctaaaaactttctagaaaataagggttcatactaaagaaatatgacaactaaatgcaatgcctgatcctggattagatcctggaccaggaataaaaaagttaggtactaaactaaaaaaggatcattaacacaatgtgaatatagactctgggttagataaaagttttatattaattaaattttctggctttgattactgtgcttatataagataatgccggacaaggggagggatagcattaggacaaatacctaatgcatgcagggtttaaaacctagatgatggattgatggctgcagcacaccaccatggcacatgtatacctatgtaacaaacctgcacgttctgcacatgtattccagaacttaaagtataataaataaatttaaaaaacaaaataaaataaaaaacataaaaagataatgtctttgttcttaggaaacatattgtgatgtacttaaggataaagggacatcttatatctaactcaaatggctcaaaaaaaatatgtgtatatatgagagagagaatgataaacaaatggaccaaagtagaaactactggtgaatctgggtaaaatatatacagaaattctttgttctactgttatgaattttcagtaagtttgaaatgttcaagagttatgaaaaacagaaaatatagcctcctgtttctagataaaagcaaatctgtccactgggcctggatattaataaaagctgaagggattggtcaaaagcatttagaaagtgatcaatatggaaaaaagagaaaatagaatttcacattctaaaaatgcattgtgagcaatggacatgacagtcaaagcctctggtagcttttagtttttgaaacttgctacatttatcaatgctgctgttccgtaactttatgatcttggccccatgggcttgacagaaacagaacagtgaatgaaaacagcaatcgcttacacctggacacaaaggataggttactccttttgcaatcaattacgggagggctgaaattaacagacttgtctttcttcttaccgaaaagaagtgttcttttccttctgttttggtaaaattatttgtggggtagtttgtccagcagcaaaagcaaaggtactgaaaatggactgaggataacggaacttcatcagctgtttcttaaagatctctactacttctggactgacttcttcatcaaatgctaccttaatcaactagaagcaaaagagattaaacacaaaagaagcattaaggatttcctggcaactttcccccaaacaacagaatataataacacaaaatggcaagactggaggtcaaagggactttggataacatgcaatacaatttttaaatttttaaaaataaaaaaaggctcaaaaaggtttacttgccataaatggctagttggcaaggaaaatcatgtatcttcaagtcagtttctttaagattatttcttctacaatgggatagggaattgtatagcaaacacgcccttctcatttctcaactggttggttccagatagagaatttggcctaataaggtctcttcctacccagatacaacaaatgtaggaagaaaagaaatccatttgactagaatcctaatcagtacagctaggcaatatttgagtgtggagttctttggtagtcgggacagtgaggaaatccttaggcagccaatgctttcaggtgatgagagaaggtctggagcctaaagatcagcagccttacatttcacacaattagcatagaagccaataggagagatccttgactagaaggaaagaggcaagaactggcattcttagaaatctgagaagtgatgaagaataagacaagcaaaatattgcaaactgagaatttaagaacaggaaaaactaagaaaaggtcacttcttccagggtctggtttgcattattcaataattattgagttattgcagtaattctacaaagttctgatacagtcataaacccctggaaaacctcttgctttatcaggggtatgcaactagtaccaatagaactttagccctagctatactgtttacctttccatagaacagccacagggcatttccttcaaaacagatgacaagataattgctttttatctaaaggcttcatcaaacaggtattgaggtataacttggcagagaataagaaccaatcgtacttgtctaagtttctaagatcactcattattgagtatctgctggtactctgagttggctaaggggctccagggattaaatccaagactattcatgagtttactcagctgatgactaccctctcagaccctatgatcttccccattctcatcctcttaacttctgagcacatgaccacacaaaatggccataatatcatttgacttttgaaaatttttgaatagtaaaacaatggcttccttttttaatacctgaaaagatgctgatgtgatctgcagtccttcttgcatgttctgctgtagctggttctgcattgtaatcttcttctccttggtgatggaggcaatgggaaagctccgcacaactgtctgctcacccactgtaaatagacaggacacagcttcagcaacaacactttatagctcacttttagagtgtctactgcttacttcatcagtctctgctagagaaatgtatttgaagaggacactgcccagggatgcagtgaaagaaagtgcccttcactccagaaaaggattatgtctcaggagtggcaagtgacttacatttcacacaactagcacaggaagcagtagaagggatccttgactagaaggaatgaggcaagaactggaattcttggaaatctgagaagttagagacaagtgacttgccactcctgagacagagtcctttcctcgagtgaagaaactgtcacagcctgactgccttcattctttctatctccccaacctactgtgtgccacataagatcacctggtttaaggcaattttataggaagggaggttttacaaaaaaaaaaaaaatactcctcaagtattgaaaagacatccaagatatttaatataaggataaagcaaaagagaataggtttttaaagtttgtttcgaaatatgtaaaagatgttatactatatatatgtgcctttggaaaacaagcctggacttaagcgcaagacttttaggagtttattaaagcaaacatgggaaaatataaataattatttatcaagtacctgaggttatgaagatgagagtctagaaaaaaagtagcacactcaagacctcccttgaagagcttccaatttcccgtgggaggagagtcacatgcagaatataataatatgtggttagctcctacgtttgagggaacagtctacagggatttaaatatttcagagaaggatctctgcatgctagctggatagaaaatgatttttgggagaattgagagagaagatggagctttaaaggaagtgtagaatctggatttgcagaagggaaaggaagagcattttaggcagtggtagaggaacataacaggagtggcaatgaacaaggcctcccagctagtaagccagggtggggagggggtggggagatctgaactaggttcatcttatttaacagctcatacatttcttcatttattataatcagaatcctaattccctggatctatcaatctgtaatctagaaaaattctgactatattcttacatcaagctcatatccagaggctaagcaaagtcaggatgtacataggatttaagttctaggatgtatttaacacctacatttatataacatgtaaaattataatatttctatgtgtcatcaaaggataaattttaaattagaaatttaaaaggaaataaaaagattttctttgacaaaaataattttcctaagtgaaattaattcaaaatttgaaaggaaaaggcagagaatatgagatttcacactaagcatactttaaaataaataaattacagcaatttaaatgaccacataagcaaggaaaaggcagagaatatgagatttcacactacgcataacttcaaaataaataaattacagcaatttaaatgaccacataagtatcacgtttacgtgtccaaaatgtgtgtttatggccattaacctcacaaaagtcctactataaaaaattgtaagtactgcatagtttcttttaaaaatacgtttactttcaaatacaatttgtgtatagcaatatgaaggagcgggctaagacacttttctccttttcactttttcaaaataagcaaaactattcttacaaattcatctttccttatttaattttatgaactgttgcgcattatatggtaagcagtcttttatgactgatgtactaagccatcttgattctattcaacctaggaataatgcaactgttaagatttaaaagagaatacattttatatatctgaattcacttgtccaaccaatgagtagcacatagtgcatactcatcaaatgctactgcatacataatttcaaaggagaaaggcactttcgtgaccatttagcccagtggttctcaatcacaatcacttgtggggctaaagaaatacacagatgcctgggtctccctatttctactgcttcagattctaatacaattgtttgagggttgggcccagaaactggtatttttttttaaagattcccagataattcaaatatacagccaacattaagaaccactgaattatcaccaatgaaagcccaatctcccaattttataaaagaggaaaataaagtccagaaaggttaagtgatttaagtcactgagctttgacttggagtcctgttgttttgcccaaagtcttaattatgtgcttttcctatcaacaagagcattttacatatagactatagtgaatttaagaagataatgtagattacttctggtagggcatgctattcctttccaatatagaaggctgtactgaatagtagaaaatagaaacagaagttataggagtttggcaagtagaagagaagttgtctgctaaaagggaagtggagttaattggaatggaataagagggaagtgggattagttggtgctggacaaccttgtgatagttagcatatccttccacaaaaaggttcaagtatctgcaagaccttagttttacagttaactgtaggactcagaaagcgtggacaaaccagcaagggatatattcagcagttagagtgaatatctctagggtataacactctgcctcatgaaatgaaattatgatcatttcagcaaatgaacccttgatttattgtttagaagataacactttgttcttcaagtaaaaaactatgacccaaattatcattagctctgtcagactaaagtatttcaccaaaatacctgtgtggcaaaaagctgactttggatttaaaatgatctgcaaatcactgtgcacagatgggatcgagacctcatgtaccacacagatacccatgttctgatggcatatcgagtcatacctaactgatcatggggtgttcctctgaagagaattctgtatgtggtgaggaacaaggctccttctgctggcaggagctgagggcctccaagaagacctccagtagcttcttctcttccatcaggatccagcaagactcgaagaccctcacagacaatttcttctcctggcagcagagcaggtctaagaatcttgggcttacaacagaaaaagattgattgattgattgattgactaattgattgatttttggagacagggtcttgctctgttgcccagcctagaatacagtagtgcaatcatagttcactgcagcatcaaactcctgggctcaaaagatcctctgacctcagcctcctgagtagctgagactacaggcatgcaccactatgcctggcttatttttaaattttttttgtacagatgggatcttgctacattgcccaggctggtctcaaactcctggcctcaagcaatccacctgccccagcctcccaaagtgctaggattacaggcatgagccaccatagaaaagtattttaaacacaacttttgtggagtttctaatacttagtccatggttatcttttcagttacagacctaaaaaacttaagccagacttcccagatagtcacatgagaaacctgatttggtaagaggcagaaatgaagtttatatacccaaatgtgagaggattctttgcagaattgtgtaaaagtaaagtcattgagaaataactcaaatatctgaaatattcattcaatgaaacattttgtaacctttaaaaaatgacatagatctatatgtgttaacatggaaaaatatccagaaggctgggtgcagtggctcacgcctgtaatcccagcactttgggaggttgaggcagatggatcacctgaggtcaggagttcgagaccagcctggccaacatagtgaaaccctgcctctactaaaaacacaaaaattagctgggcatggtggcaggcgcctgtaatctcagctactcagaaggcggaggcaggagaatcgcttgaacctgggagggggaggttgcagtgagccgagattgtgccactgcactccagcctgggcaacagagcaagactccatctcaaaaaaaaaaaaaacaacaacaaaaaaaaacccagaatacatagattagttaaaaaagcaagttagaaaccagaatgtacattataatcccatttttggaaaaagaataggaattgtaagactgtgaacccaactgttaaaggcaatggtatcacagttaagggtggaggtggaggtagtatagggaggactgcaggggactttcactttctacaatgtgtatttcttttatgctcaaatttatacaaagaacattattacttttgaaattatttgcacattattttgtttttcaagaaaacaaaaaatatggacgagcttttaactagacctgtccttggccacgtaatgaacatttacacaactcaggaaattctgactcagtaaccatataatacattcctctgaagagtttagggctaggaaaaaaaaatctctcctgaaggtctaatatgtttattttttactaagcaataaaaactaatcagcactattatttttgttggctctagtgagtttagagctaaatgtaaagccaaagtataataatcgctgtgtctcaggtttctgatagaattatattcctacctacctgccttccgctcactcctttgactaaatgaatgaatttacctatttatttatttatttatgagactgggtcttgctctgtcacccaggctggagtgcaatgacatgatctcagctcactgcagcctcaacctcttggcctcaagtgatcctcccacttcagcctcctgagtatctgggactacagataacaccaccacggctggctaacttttacattattttttgtagagatggggtttcatcatgttgcccaggcgctggtctcaaactcctgggctcaagtcatctgcctgcctcggactgccaaagtgttgggattataggcgtgagccatggctcctggcctcaatttgtttttgttctattataaagttctgttatataggcaagagggtcctgaaccatagtctactggcgccagactacaaagtaatcatctgagagccttgttaaaatacagattcccagacatgttctggggtactccaattcaggaggctggggttgggtccaggactctgaatttttaatagactttccagctgtttgggatgtatagtcagattcagaaacctgggttttttatgataattgccttaaatcctttttggtggtgggggagggggagaaaataggcacagtataaaatcttgggttgggcttagaggttagaaatgttcctaatttatgccctgcctataaaagtagactcaatgagaggttattattgctcctttgttgaatctaagaaaagattctgttcctatttcagtatcctttttataaggttctatatgacacacttctctgacagtttaacatatcattaaaactggagttagtgtctgtcaaaggttaggtgaacatcctttcctggcacacagcagtctattgtttgtttttaagaagagaggctataccctgaaagcatgtagtctggaattaccttctgaataggcggaagtcttctgctttctcgatgtactgcttctagggtctcaatgtgcatagctacaattcctaggatgagtcagagtattcaaaatgaaagaacacagacaagcaggataaaaacaaattctggatattttagaattaaaagttaattacagtttactggttcctcaaaaaagttaaagagaattaccattatgacccagcaattccacttctacatatatacccaaaagaaatgaaaggactcaaacagatacttatatgtggatattcatgtattattatttataatagctaaaagggagggagaagtaactcaaatgtccatcaacagatgaatggataaaatgtgggacagccataccatggaaagttactcagccataaaaaggaatgaaattctgatacatgccacaacacgtatgaaccttgaaaacattatactaaatgaaataaaccaaacccaaaagtacaaatattatctaagtccacttatgtgaaatatctagaacaggcaactttatagagacagaaaatacattagaagttaccaggggaaacaggagttactgcttaatgggtagagtgtttggggtaataaaaaagttttagaaatagataacagtgatggctgcacaacattgtagatgtaattaatgccactgaattgtacacttagattattttatgttatatatgtattttacaacaatttaaaaacattttaaaaactaatcagaaaataaataaatagcatggctgaactataatggaagacatgtattgccaggttttatgctgaaactcaataatctccaatattctgattctctaatatctgcagagtgattacctggtatcatgcaatgaaggctcttgatgtgatcctgagtaactccactctctgtacaaactttgtcaataaatcgggtaatgaaccgcacaacagaattggcaatgtcagtattctctgaatcttcaaacccactctctgtatcatagctctcagctacacttcctgcaatactaagacagtcaaggaaagaaatcatggtcagtacttaaatgcaacaaatgactactatatagtagtcaatttacatagcgacagaaacatgagcaaagtgatgtctactcaagtagaaggctcacttaactccatggctccttggtaagtgatggtgataaaacacaatgttctactagtctacatttggaaactactgtcaggcagtaagtttctgtaaggaaatttgtttggacccagatttgtttctgtaaggaatacctttagtcactctcccaaaaggaatgcaggaaccacagaaaataaagcaaaagaggattttttcatttattatggactacctgggccttctaaagcaacctgtcctcccaagttaattattacatagagaacaagtaatacagctatctttggctacttggcaactgaggaacatgttccctggtaggcaaagtaagagaatttttctcagcaacaagcgtactcttccatatgtaaggaccaaactgtcccttctcttgccaggatttatcactctctgagttaactgcaacccatttggccactttgaagccagcattcttctgtagatgataaaatcatgcaagagaagggaacaaatttgaaatggaacagatgtgaaagctcaatctctgcccttcttgcttattcagctcttactgttcaacccatcagactctgggaaaagactcatttgtctgttcctattaacttctcttttctgcaaagccaaccacattagctgaatcagtgttagagattgttaaagtaaagctaagcagagactatggccatcaacatgcagactttgagagagcactgtcatctataatgattattatttgtttatatttatttatttattttagagacagggtctcactctgtcacccaggcgagagtgcagcgatgctagctgtaacctcaaactcctgggctcaagaaatcctcctgcagcagtgattctccagcctcagcctctcaagtggctaggactacaggtgtgtgctaccacacctgactaatttttattttttgtagagatagggtctcactatgttgcccaggctggtcttgaattcctggcctcaagcaatcctcccacttcggtctcccaaagtgctgggattataaggtagtcagccccatgcctggtccaaaactttaaaagaaatgtaaaatatagttattgcttgttataatgaagatgaacgtcactggcaatggagaatggagataaagctgtgacagctaaggaatatcttacaaattaaacagataggtcctgtattgaaacagagtcttgtggaattatgagtagtgaaggaatgggaaagcatcatttcgggaagatccttttggcagtagaaagaagaataaaaaatgaaacaactaagagactgttataattagggcttgaagtgataaaggccagactatgttgttcccattaaataaccagaggatgaacaagaaactctatatgggtgggggtaagagatctgtgcagttgactgtatggtgtgaaatgctgattccaagttgtctagcctggaagaccagaaactctgaggtgtccctgacaaaaatgaagtacctaggataacaagattaaaaggtttgggccagagatttaggcttgtggatgagtcttccacagagtaagaagagcttggaagaggaattgagaatgggaagagaagaggagctgcctgaaggagcatgaggagaagaatttatgcgagctcgaactaccaggatgttgcggcacccatcactgaagctctaaggatagaatttcactactgttgggttgataagttcatttattcactcatttaatcatctgttcaaccaaatatttattgagtactatatgcaaagacactaggaatacagcaatgaacaaaactgacaaaggaaacataacaagcaaacatatgaaaataaatcaggttgtaaaaaatgacatgaaagacaatgcaaagtaggagagggagaggtattattaagatgcagaagtcaggagggcttcttgaggcaagtaacatttgagcagagacctaaataaagtgaggaagtgattcttggcctgtttaggtgagaatattccagaatgaaaataccagtacaaaggatgtgaggcaggaatatgcttggagtgtctgaggattagcatgagcagggagaccagtttggttgacagaagagtgataggaaatagggggtcagagcagtagccagaggacggattccgttaggccttgcaggccatggtaaacactgggttttagtttcagtggtatgagaagttactggagggtagagaggaaggcatggttgagggtatgactacaaggttgaggaaaaggagggctgagaaacaaacagccacttttgcaagaaggtgctcactaatttctttggaatgatttctgtaaattgctttggcagacagtaactgaagggctggatcagtaatgggtgagacatttggaaaaattaggtcataaaaaagaagaaagtgtgggaagtggttaagaatagtaggatgaagtgaatcttttagaaagaaaagctgagcaagtccaaaggtgaggaaaaatggttaacttttgaaatatgtacagcagtatttgctcaaaatgtttaatattatctgtcaagccaagactggccccaagaagagtaggaggagggtctgtgtgttcacattttggtacctgtttgtgacaatgctgttgcttccgctctcccagtcacctggcgctgatgttcttaggagcttgtttttacttgtgtcgagtggaactagcaggttcaccatgaggtttgcaaagtgaatggcctgactaaagacagtgctttcctcatgttgcactagctcttgctgagttgacttgctcagggtaggccaaaggcgtagttgctcagctgccaggtccattgctgtcttctcctgataatggtcatcaggaagcttatcctaaaaaataaagcaacacaatccaaaagagaaccatcacttcaggtgagcttaaaaaacatagattttttttttttttttttttgagacggagtctcgctctgtcacccaggctggagtgcagtggcacgatcttggctcactgcaagctctgcctcccaggttcacgccattctcctgcctcagcctcccgagtagctgggactacagtcacctgccaccacgcccagctaattttttgtatttttagtagagacggggtttcaccatgttagccaggatggtctcgatctcctgaccttgtgatcagcccgcctcggcctcccaaagtgctgggattacaggcgtgagcaaccgcgcccggcctaacatagatgttttaaataactattctattaaatgcttaaatcagcaaaaatgaaaacataaacataacataacaaccacaaaacaaaacctagtcttctttcccagatccaacaggccttgagtggaactatgtgacaaacctcaggaagcagcagcaaagcaccttatagcttgtgaagagctggtatgtctatggtctcacttgtacctaacctagggctggctccgggatagacttctttagaatggctgacaaagaagcagtgacatgtgtttgctctatgaatgctttcgagatgtgtcaatattaacattacatctgcttaaaaaatgatcaaaagcacccccgaagcccagtaaatttctggagtagaatgataatcagccgttaaggctgctttaagttcaattcatgaggatgatagtttctaacacttattattactgcataccatgtactcttcaatgcactttatatatgagacactaaaatctcataataatcatatccattttaccagtgaagatataaggcacagtgaagtaacatgacttgccccaaaccagagagctagtaaatgatgttttaaactttcagagtatttaaaactactctttcaaattaaaaacaattttcttgatttttaaatttttttgatatttttcataaaaatattttatgctgataaaacatagagaaacatgtagaatattcctagaagaagacctagatttattactggcatttttttaatacaactaccaaattttacatttattttggagttaattaactttaatttgacattcctccagggaagttagttgcatagagaagtatgcctgttattttaggtttgttctttctattcaacttcctatagtcatttccaggaaattcttatttattaaagtatattaaaacaatcctagtgctgaagaactgtattaagaagttattatggaaaaacataatgtctgaaatcaacagaggaaagatatcacagggctccctaaataaaacccaaatacactggcaggaagtagctagagttttttttgccctgggaacatctgctttccttaaagccagaatcctaatcccacacaattagagttcttttcttctctcttaccttttgcttcagatgcggggcatgattgtcttccttggctgagagataaagggagcgaacctgttcctgcactgcattgtaaaaggttgtctcccaaaattgctgatttgtccaaatggggtggtcttgtacacacgtgtaagcaaactggctgactccaggggcaagtttctgtgagaacacacaaaatacatcatcatggggctggcagaattataacagttcataaggtcacaggggccacagttaatcatagatgagatcaaaggatttctctaaagaatatcgtatggtagtacaggcttagcaatcagcaacttactcctttttaactggcaactgtgggcttgctgttggatccttgagagtctcagtcactttatcaaaatgggtattttagtaacagctaaaaatcaaagctgttattatatcaattagaaaatacaggaaaaggaggcactgtaggtttagtgaatattattacaattagggcatataataaaatccatcacgatgtaaacataaaactccagataatttaacatttcttctatggctttagggtactctttttaaagagacagcaactgaaatatgagtgaacctacagcttggccttacacacagaatgaggatatagcatgaattagggactcaggagaactgcacttttcctactgctcattccagcccattacctccccgccaaagctgttgcctggctcacatactctctagaagactgccctgggcttcaagggcattttctggtaaccaaatttgtgcagggaaagataaacacaaaccaaacctccttcctttcagggacttcctgctgggtttcagcgtaagagtaaacttaagaggtgattaacaacagagggaaggaaaatgaactctgcaggcatttagaaggcacttcatatatatttaagtttgtttagttccaaaacccctgctctttttataacaccaaattgtctttcaaaagaactgaaagtaaatcaaaataaatgaaatgccaaattaactgccaattagcacttctgttttcccctcactttatgattttgtttcccaaagtaatattctaccttggaacctctgaaaaaaacttgtataacattgcattttaaattttaatgataatttacattgccaaatttcagttagtgacttgagtcaactttccaaaactatttctgccacctctaaaagctaaggatgtttcaaatttttaaaaattcataattttccaagaaagagtaggtaccattttcaataaacattttttggcccattttattctttggaattgagttcatctgttttctgtgagtagaactaaagtttctgataagttttctttcgaagcaatttaataagctgagtgtcttctcctgaaatgctggacactgaagatgattactaaggttatataactgttacacaacaaaagttggttcatttcttagggacgtataccagatatataagacatctggtaaaaattacacgctcaatacatgctaatctcctttttggtctagaactgcataccacgaaatgtagtacctgtgtagttagaagctgggtggttgtgattttgccttaaagagtctctgtgtactacatgccatctgtaagaccctttcaagataggactgtgttactgctgctgaggtaactggctataacctcaattctccctattaagtggctgtaagttgtggctatgaagcaaaaatcaggagttctttgagggtgcacagggatcattgttggatttcattatgcctatctgctcatttaagaaacagttactgtctacctatgggaaatcatgaacaaaatgtgtgtggttttgtgagtgcgtaagcagaagccacacacactgaatcacaagctccttctatactctgcatgaagacacttgggacatggattacacactttttcctccttcattttttagtcctttactgtaaggaccaacaattgtttcagtagcagtacacaagcctattttgaaacagtttttttttttttttttttgagacaaggtctggctttgttacccaggctggagtgcagtggcatgatcatggcttactgcagcctcaacctcccaggctcaaaagatcctcccacctcagcctccctagtagctgtagtagctgggactacaggtgtgctccaccacacccagcaatttttgtagcttttttttgtagaaaaatttgaacctgggaggtggaggttgcagtgagatgagatggggtttttgtagagatggggtttcatcatatttcccaggctggtcttgaactcctgggctcgagtgatccacctgccttggcctcccaaagtgctaggattatagatgtgagcccccatgaccagcctgaaagagattttaaaggcactaaattcaaatgagataaaactgtaattctcaactgcctttaccatgagtatactcagggcagtaccatttcttacaaatgcagcataacataatcaatggcaactctaaaaatgttgaagtcttgaaattatattcatatagataaactccaaaaaactgagcttttaacaaatccttatcagattctcacaaagtacttttaggataatcagcatgccaaaaaagttattaattaaacatcttttattaaaacttaacagagatgtacaggaatctgagggtgtaatgaagccccacctttcttcagtatttttcacactgatggtgtatatttgctttccttggcacatttgagttgacattacaggttgaatgtcccttatctgaaatacttgggaccagaagtgtttctgattttggaatatctgcatcatatttactggttgagcattctaaatctgaaaatctgacatctgaaatgctccaatgaacatttcttctgagtatcatgccagcccactacaagtttagaattttggagcattttgaattttctttcttctttttggagacagggtctcactctgtcacccaggctgatgacaatcatagatcattgcagcctagaactcctgggcttaagggattctcccgccttaacctcctgagtagctaggactacatgcatgtactgccatgcctggctaattttaaaaaatgttttttgaggccaggcacagtggctcacgcctgtaatccaagcactttgggaggctgagacaggcagatcactgaaggttgggaattcaagaccagcctggccaatatggtgaaaccccgtctctactaaaaatacaaaaattagctgggtgtggtggcaggcacctgtaatcccagctacttgggagactgaggcaggagagttgcttgaatctgggaggtggaggttgcagtgagctgagatcgcgccactgtactccagcctaggcaacagagtgagactccatctcaaaaaaaaaaaaaaaaaaaatgtttcttgaaacaggttttcactatgttgcccaggctggtcttgaactcctggcctcaagcaatccccccacctcggccttccaaagtgctgggataggattaggccaccaagtgtggcccaaatttttgaattagatatactcaacctgtatcttcatgtttatgcacaaactaaaagttgaatatgcaaaaactaatctaaatagtttgagcaaaagtgggactatatatgttccaaggaagaaaaacggtgcaagacagagtgacagtggcccaaagggtcagaacccacagcctgtttactaggtgagcattacagcagggtgaagtgactatagtacaaacacttggtggcaagacagacacaaacggctatggcatctgtgatagtggcagtagtcttagtaaacagagaaaataagtgcctgcagataaaatgatctcctgatatgtgcgttagaaatcattaacccccaaatacttaaaatattattctttttctagacatgcagtttgccttctttctttgtggtttcttgctttgtctggtcaaccacaagcagggagcactgtgtccctcagtgaggatgggcagggccattccactgatgggtgttctcaggaccagcagagggcagtatcactttattctgcctagactccatcatggcttgatctacaaattgcaaaaatggaactttgcagtcagcttgggctagaaagtgggtggtaaggtaaatatttcaggtgttcactgtgcatttgagagaatctataaagaaagagaactgttcagggtcatatggtaagatgagtagaacagatgggaacagaaataaagctttccattactctacgttgtttctgtaagatacaaaatgaacatattttacaaaacaaacctgtaatataattatgtagggaaagatgtaatgagactttagggtttcaaattcagtataacctgggacagtagcagtaattttagtaaacagagaaaataagcatctatggataaaactatcttctgattgtgataatttatttaaaaaaattttttttattattttgtgtttattttatttttttgattctaataatttctctggtttgaagaaaaactttcccaagacaagatggttttacaaattggtctgtatactagcatcataatcttttaatattgcacaaagatgagatttaactcatactgagggtgtgagatggtggtgctggttgggaatgcttttgtcaaatcacatctctctttcattctcttcaattctggcaacaatatttacatttcataataatttttaagattctgtcctaaaaaaaaaagtggtattgtgccatgcaattttatgagatgtttaagaatgtgttgacttccttctttatctagaaaaaacagcccgtgaaggtactagattaagcaatgccattcattttccacaaagctttcaaaggaaacccagcatgggacaggatatgaagaataaactcatggggctcaccaaccagcaggccagattcaaatccaaataaaggatgcaaatcatctgagagatgagatggttaagggaaaggttaagatatcagcatgaggggcctgttgaaggcctgtctggctagacatgttagttccccaagctcaaggctctcgtttgggagctcagggaaaaccagatttcaggaaagaaggctagctggcaggtcttttccataaacatgtaatggtcttaaagaataatagagagattcattgtctaaattgctggagatttcctatctagttctggtccctggaatataagtgtacctaactaactgcacaattcagggatggtgctagcaagtcctcctgtgattctgctctggcctgaccaagtccagatattaaatcactttaataattaattttagagcattttctgatgaaattgggagtctttcttttgcttagtcttgagagacaaacaaaaggaagacaggaatagaaaaaattgtatccaaaacctggctttatcaaatcttaaacatatttgctttgtccctccctctctctctttttttttttttttaaagaaaggacatacaatacatacaagtccactgtatacttctcctgattctatttctctcctatcctagaggtaaccatgatcatgaattacatattatcattcccattttgttttttacctgtgtatgtccataaagaatacataagttatattgcaggttttattctatcccttattgatgcttttcatgtatataactcatatttcatctatttatgtgacatctaacaactatataattaatcaggaacaaaacacaactggcttatgtaaacatacaactcagttagcaggagcagaaagagaatggcctataagcaatgagtatttaggatattatgctcattagttagtgggatttacagaatagtgagtaatccatttagttaaatgggatgactataagcatcttctacagtttttcctgttttactacctgatactcagattgaacagtacaagtatccttaaactcagaatggtctataacccttctagattgctcagatcaaggcatacaatttctgcacgagaggtatattcatccaccagcattgtccagtattcacttgatgtgccagattctataaatgtcagtagttgggatgaatggattgaagtccttttttatcaagacatagtctcgccttgtgacccaggctggagtgtagtggcacaaacaaggctcactgcagtcttgacctcctgggctcaagcaatcctcttgcctcagcctcctgtgtaactgggaccacaggcacacaccaccatgcctggctaatttctgtattttttgtagagatggggcctcactttgttgcctaggctggtatcaaactcctgggctcaagtgatcctcccgcctcggccacccaaagttctaggattaatgccatgagccaccaggcccagttgaactctgtttttaaaccatttagccttctaatgattctgtgtcttaagttgtttagtaaatattaagagttcagaggataaatcaatttctttcctttgtggtccagaaattggtagacatcaaatccaagactgttgtcaagtcctttgcctgggtttggtggtctcaaaaatataagatataatctaaattctcccaatcctccccatttttggccagtttttatttatttttttttttgagacagggtctcacctgctgcccaggctacagtgcagttggcacaatcttggttcactgcagtctcaacctctggggctcaagtgatcctcccacctcagcctcctgagtagctgagactacaggtgtgcattaccatgcctggctaattattaaacaaaatttttgtagagataggggtctcactatgatgcctaggctggacaactttatacaagtagtacaatgttgtgtttcattctgcaacttggtttttcatgcattatgttgttagatttattcaggtaatgagaattatctgacaactagaaatatctctgtaaaaaatatttaaaataagaaaaaattattataaccaacctgtactgagtataatacattctcagtataaatatttactgattcagttagtcctcacaacaatcttatgacccactgagataagtaccattatttctcctgtttaaaaatgaggaaaaagccgggcgcagtggctcatgcctgtaattctagtactttggaaggctgaggcacgtggatcacctgaggtcaggagttcaagaccagcctagtcaacatagtgaaaccctgtctctactaaaaacataaaaattagctgggtgtggtggcacatgcctgtaatccccagctacttgggaggctgaggcagaagaattgcttgaacctgggaggcggaggttgcagtgagccaagattgtgccactgcactccagcctggatgacagagcaaaactgtctcaaaaaaaaaaaaaaaaaaaaaaaaaaaaggcgggaggcgttggggggcgaaactgaggcaaaaagaagtaatttgctcaagggaacactgatagggagtgacagagccagagatgggatttgaacccagccagtttggcttatagagtcttgtttttcaactactgcacaatttaactattgtatggaattccatggtatgaatatacagcattttcttgtttctgttaatagacatttgtattatttccaactgtttgctattataaacactgatgcataaatatcatcatatatttcaactgccaactattaattattggtttcagtaccatttagtagggcctggaagtacttgacacgggtcccagtaaatgtggtaattctcattgttatctataccaataagcattttggggttattgcatattggttatttttctaataagaaattatttcatgcaaatattttgcaaatccactatttcaaaaaattaacaataattctttaatatcaggaagtcctagccttaaacaatcttaaaattcatatggaaacacataagaccctgaatagccaaagcaatcctgaggaaaaaaaaacaaagctggaagcatcacactatctgacttcaaaatatactataaggctatagtagccaaaacagcatggtactgccataaaaacagactcattgactaaaaaaacagaatagggaacccataaataaatctatgtatgcatagccaactgattttccacaaaggtgccaagaacagatactggggaaataacagtctcttcaataaatggtgttgggaaaactggatatccatatgcaggaaaatgagactagacctccatctctcaccatatacaaaaatcaaatcaaaatgaattaaagacttcaatgtaagacgtgaaactatgaaactactagaagaaaatattggggaaatgctgcaggacattggtctgggcaaagatttcttgggcaagacctcaaaaagcacaggcaacaaaagcaaaaatagacaaatgggattacatcaagttaaaaagcttctccatagcaaaggaaacaattagcaaactaaagaaacaacatacaaaatgggagaaaatatttacaaactatccatccatccaacaagggattaataaccagagtatacaaggaatgcaagcaactcaatagcaaacaaacaaacaaaaaaagggcaaatgattgagcagacatttcttaaaagaagacataaaaatggtcgacaggcatattaaaaaatgctcagcatcactaaacatcagggaaatgtaaatcaaaaccacaatgagatgggtacaaaaaaatagaataagacctagtatttgatagcacaacagggtgactacagtaattaatggtttaattgtacatttaaaaataactaaaagggtatataattggattgtttgtaacacaaaggataaatgcttgtggggatggataccccattttccataaagtgattattacataatgcatgcttgtatcaaaacatttcatgtaccccataaatatatacacctactatgtacccacaaaaattacaaattaaaaaacacaaggagatattatctcgtcccagttaaattgaaaaacacaaggagatattatcttgtcccagttaaagtggctattataaaaaaaagaaaaagtaacagatgccggtaaggacacagagaatggagaatgcttgtacactgctgatgggaatataaatgagtatagccattatgcaaaaacagtagtgagattccttaaaaaactaacagtagatctaccataccactgctggatatatatccaaaaggaagaaaactagtatatcaaagagattacatttattatagcgctattcacaatggccacgatatggaataaacctaaatgtccatcaacagatgagtggataaaggaaacatggtatatatacatagtggaataatattcagccataaaaaagaatgaaatcctgtcatttgcagcaacatggatggaactggaggtcattatgttaaacgaaataagccaggcacaggataaatatcacattttcacacatatctgggagcaaaaaaagttcatctaatggaagtagagagtaggatgatggttccaagaagctgggaagggctactgggaagggggaataaacagaggttggtaaatgggtacagaaatacatttagaaggaataagttctagtgtttgacagcacagcaggtgattacagttaacaataatttattgtatatttcagaatagctagatttgaaatgttcccaacacaaagaaatgacaaatgtttgaggtgatggatattctaattaccctgatttgaccattacacaccgtatacatgtatcaaaatatcacttgtaccccataaaaatgtatacttatgtaacaataaaaattctttaatatcaaatatctagtcattgttcaaatttacaattgttttttaaatgtaaaaaagttgttggggcgcagtggctcacgcctgtaatcccagcactttgggaggctgaggtgggtggatcatgaggtcaggagattgagaccatcctggctaacacagtgaaatcccgtctctacaaaaatacaaaaaaaaaaaaaaaaaaaaaaaaaaaaaaattaggcgggtgtggtggcgggcgcctgtagtcccagctactcgggaggctgaggcaggagaatggcatgaacccgggaggcggagcttgcagtgaactgagattgcgccactgcactccagcctgggcaacagagtgacagacaaaaaaataagtaaataaataaataaaaataaaaaaaaagtttgtctttgtttttctgttatttttacaatcagtttgcttaacttgagtaggaattaaggtcaaataaggtctacatattaccattagtttgtatattgctagcatcaattttattctagtttctttttccacctgcaatttatttgctgaagaaaccggatcatttgtcctagaaagtttccatcagtctgactgcatcccagtggtgacatctgacacatttcttttgtcctctgtgttttcctacaaattagtagttgaatctagatgcttgatcagactcaggcttgtttggcaagagtacttcagacagtactagcctgaggggtagcactcaccgggcacatctgtttgtctctccttttgttatgttagaggatgttgattgtcaatgcccagatttgttaatattagaagttgtaaaattgtgatattctaattctagcattacttcctcactcattagttagagtacttcgatcaagagaaactttcccttatcaactgttggtgaaccacaggcatagcctgtattagaaaagcaggataaatatttgattctatccctttgtttaacaattttaaaagcaataagttgtttttctagtgtctaccacaggtaaccaattagtttggtttttaaaaattaatatctctatcaacccataaattttaaaacatattcgattcactattaaattattcttaaatctgtttagaaacaaaccctcccaaaaaatctatccataagagttccctgaaaatttttttttcttttttttggagacagagtcttgcttagttacccaggctggagtgcagtggcgcgatctcagctcactgcaacctctgcttcctgggttcaagtggttctcgtgcctcagcctcccgagtagctgggattacaggttcatgccaccatgcctggctaatttttgtatttttagtagagacagggtttcgccatgttggccaggctagtcacggttcaacatatgcagatcaataaatgtgatatatctcataaacagaactaaagaaaaaaaccacatgattatctcaatagatgcagaaaagacctttgataaaattcaatatcccttcatgttaaaaactgccaataaactaggtattgaaggaacatacctcataataatgagagccatatataacaaacccacagccaatattatactgaataggcaaaaactggaagcattccctttgaaaaccggaacaagacaaagatgccctctctcacaactcctattcaacacagtattggaagttctggcccagggcaatcaggcaagagaaagaaataaagagtattcaaatagaaagagaggaagtcaaattatctttgtttgctgatggcatggtcctatatctagaaaaccccactgtctcagcccaaaagcttcttaagctgataagcaacttcagcgaagtctcagcatacaaaaatcaatgtgcaaaaatcagtagcattcctatataccaacaacaggcaagcagagagccaaatcatgaatgaactctcattcacaattgctataaaaacagtaaaatacctaggaataaagctaacaaggcaagtgaagcacctcttcaaagagaactacaaaccacaggtcaaaaaaatcagagaggacacaaacaaatggaaaaacattccatgctcatgtatttgaagaatcagtattgtgaaaatggccatactgcccaaaataatttatagattcaatgctattcccattaaactaccattgacattcttcacagatttagaaaatactatattaaaattcacatggaaccaaaaaagagcctgaatagctaagatgatactaagcaaaaagaacaaagatggaggcatcatgctacctgacttcagactatactacaaggctacaggaacccaaacagcatggtattggtaccaaaacaaatatgtagaccagtggaccagaatacagaactcagaaataagaccacacacctacaaccatctgatcgttgacaaacctgacagaacaagcaatggggaagggatttccaattaataaatggtgcttatagctatatacagaaaattgaaactggacctcttccttacaccttatacaaaaattaacctggccgggcacagtggctcatgcctgtaatcccagcactttgggaggctgaggtgggtggagcacaaagtcaggagattgagactatcctggccaacatggtgaaaccccggctctactaaaaatacaaaaattagctgggtgtggtggcgcacgcctgtagtcccagctacttgggaggctgaggcagcagaatcgcctgaacccaggaggtggaggttgcagtgagccgagatcacgccactgcactccagcctgccaacagagtgagaatccgtctgaaaaaaaaaaaaaaaaagtaactcaagatggattacagactaaaatgtaaaatgcaaaactatcaaaaaccctaggagaaaatctaggcaatacttttcaggatataggcatgagcaaagatttcataatgaaagcaccaaaagcaattgcaacaaaagcaaaactgacaaatgggatctaattaaactaaagagcttctgcacagcaaaagaaactatcatcagagtgaacagaaaacctacagaatgggagaaaatttttgcaatctatccatctgacgaagatctaatatccagagtctacaaggaacttaagtagacttacaagaaaaaaagaccccattaaaaagtaggcaaaggacatgaacagacacttctcaaaataagacatacatgtggccaacaaacatatgaaaaaaagctcaccatcactgatcattagagaaatgataatcaaacccacaatgagataacacctcacaccagacaggatgacgcttattattattattattattattattattattattattttgagatgagtctcactctgttgcccaggctggagtgcagtggcgcgatctcggatcactgcaagctccgcctcctgggttcatgccattctcctgccttagcctcccaagtagctgggactacaggtgaccgccaccatgctcagctaatttattgtatttttagttgagacggggtttcaccgtgttagccaggattgtcttgatctcctgacctcgtgaaccgcctgcctcagcctcccaaagtgctgggattacaggcatgagccaccgtgcccggccaggatgataattattaaagtaaaaaaacaacagatgttggtgaggttgcacagtataggaacacttttacactgttggtgggagtgtaaattagttcaacccttgtggaagacagtgtggtgattcctcaaagatctaaaggcagaaataccatttgacccagcaatcccattactgggtatacgcccaaaggaatgtaaatcagtatattataaagatacatgcatgcatatgttcattgcagcactattaacaatagtaaaaacatggaatcaacccaaatactcatcaacgatagactgaataaagaaagtgtggtatatatacaccatggaaactatgcagccatgaaaaggaatgagatcatgatctttgcagggatatagatggaggtggaagctattatcctcagcaaactaacacaggaacagtaaacctaacactgcatgttcttacttataggcgggagctgaaagatgagaacacatggacacatagggaagaacaacacacactggggcctgtcagaacatcaggaagaatacctaatggatgctgggcttaatacctaggtggtggcatgatctgtgcagcaaactaccttggcatacatttacctctgtgataaacctgcacatcctgcatgtacccctggacttaaaataaaggttgaagaaaaaaataagtaaaaattaaaaagtctaaatacgtgaacagagatttcaccagagatgatatattgatagcaaatacaaacatgcaaagatactcaatattattagtcattagggaaatgaaaatgaaaatcacaataacctactacttcatatctacaagaatggctaaaatgacaaacactgacgtgtggatcggaggaactggaactctcatacactgctgaaaagaatataaaatggcagtactatggaaaaaatgtatttttggctgggtgcaatggctcacatctgtaatcccggcactttgggaggttgaggcaagtagatcacttgagatcaggagttcgagtaaataataataataaatgctaagccaaataaccaaaagaaacctctgaattcagagttcaacatagttgtgtctgaaaagtacatcataaaagaagaacagggacctctgtttttgtaataaactgtaatctttatatttctgaaatgtatacatatatgccatagatcatgaggtcaggagatcgagaccttcctggctaacacggtgaaacactgtctctaccaaaaatacaaaaaattagctgggcgtggtggcacacacctgtagtcccagctactcaggaggctgaggcaggagaatcgcttgaacccgggaggtgcaggttgcagtgagccaagaccgcaccactgcactccagcttgggcgacagagtgagactctgtctcaaaaaaaaaaaaaaaaaaaaaaaaaagttactaaaaaatgctctatgtagtttgtcacaaaggtttaaagtgatatggattagtacagcataaaaatattggttcacaaccacaaatggtggttatagtcattcaccacagtctgagaattcaaaagatatgttatggaaacaaagctaagaagattatggtgtatgctgctaacttcatttcagggcagctctagcacatgaaagtaagaagatccacttaatatgtatttagtaaacagaagcagcagccaggggctcaagggatagtgggggcagcagcatagttgcacaaggtcatggtacaacagcaggaaacccacataggcagacatagataactgggaaatagaagtatctgcctaggtagaggaacagtgagcagttttagggatctgcatgagcagtgaggaggcatatacctagaaagttggctattatttagctccaaagagctttcatttagtagttcagcactatattaggatttaaagaaaagacaaaagtaagtcccttgaaagagcatatttctggccgggcacggtggctcacgcctgtaatcccagcactttgggaggccgaggcgggtggatcacctgaggtcaggagttcgagaccagactggccaacatggtgacaccccgtctctactaaaaatacaaaaattagccgggcctggtggcaggcgcatgtaatctcagctactcgggaggctgaggcaagagaatcgcttgaacccgtggtctctcaagagatggaggctgcagtgagccgagattgagccactacactccagtctgggagacaagagcaagactttgtctcaaaaaaaaaaagagcatatttctttccttgtgtgactgagctttagagtttaaatcctctcattaaatctgcatgatattattactatcttagagactaatgacaaagagaatctagaaaaaaacataattaggaagctctcattctaagtcatttttaacttgaatttttattgccaagtacataatagtgaatctaagtaaaaacttattccttacactattttctacttcttactagatgaaggcagaaatcacagtactactgaattacagttttatagtatgtctcttctttccttagtttctatctactcaacttttccagagacccctaaaaaaattatcagagatacaaaaagcaaagtcttaaaagcatttcctataaacaagaaaatcaatatcttttaggggcccaattttccaaatttcactgacattttgactaaaaagcttaagactcttgtcaatgaccaaataaagactcaaattgtaggatgcctccatgatatagtcaactgtgggtgcatttaaactgtaactgttacttcagtgcctacactttctaagggttttattttgatgctgtggtcttctgagaatgagtgacagccagccagtgtgattcactgaggtactgcctacacaaattagaggctacaaagcagtaaatatggggctgggccttgaagaggctctgacttacagaatattattggataagtcacctaagctcctagcttaagtttattattaaaataacacctcttgacttgcatgtacatctgctaaaagtagactaacctatcaaccttgaagagccaatagtacaaaaagttaaaatgttatatgaagagaaaggagaccaacctattattggaagaaaaacagcattgtaagctgattataagaacatttatttattgaggagaaatatgcctctgttactgaggaaaacagctcttcaacttatagactgtatttattttggaaagattgattaagactgagcctctagaatgagagacaagctgtttacctagtggccatttcccaggaagaattatctatcaaatcatatagactgggtcacaaagttctccaagtatttgcatggttaagccaataattatgcctagaattctagaaaatgagtaaacagcagtaattatctggttaaaaataaccaagacagatccagtgctaagaataaatagctataaagttacattaaactgttctaggactgcagatggttttcaagctccagaggatcatttctcacttctaaggcttctaggaacatcataaaatccaccttcctcctacccacgagctcctctttttattaatgtctagtggtttgctatttatgtttcatttgtacagtttaaggcctacttcctaatacaaaacaaatgttactgcaggcctgaggatacctttacctaattgtccataaccgaatatgaaagaaggctttgggattaagtttccataacaggatagaaagaccagttgtgagggaaatgaagtcaaaagcaggagaaaataacagggccagtgaagtggaaaaaagggtgtggaacaaggcagggtcagccatatatcttctctatttgcctggtcaatcctccctgcaaggtccagtttgggtgcttggaatatgctgaataagcttcccaattcatggaggggtaggagaaattgaaattcaacttaggaagccaaaatagatttttctgcctattatcaaaaatttgcagaagctgcacatctgctggtgtgagacacaaatgtgaaagtatgcaggcacacacaaacacataacactcgttaaacttaaatcacttaacttgttattaagtgtaaactcactgagttagaataaacctcagagattttttttttttcactaatacatgggaacgccaagataaacggaagaaaagaaacataacaaaggtcatacagctagacggagcagtgctgaagccagcatcagatgttttataaggtattaaacgatctggtcacatcctccctttctcaacttcctgaatactattcactcctgtaggtgtatcccacagttgaacgagttgaatgctctgtgtactaaacatactctttgctttctccctgccatgacattggtcaagctgtttcatctacttggaatccctccttccaatctctagtggttaaaatccattctccaagggcctattcagatgatacctctttcaaaatgccctccctgtttgctctctctttatttactatgtgttataaactgaatgtttgtgtcccccttaaattcatatgttgaaaccctatctccatccagcgtgcccatatttgtagtaaggaagtaattaaggttatatgaggtcataagggtgaggccctgatccaacaggattagtatcctgagatagagagcttgttcttgctcttgctctctctctccctctctccccactgccccacgttctgaagaaaggccacgtgacatagtgataaggcagccatctgcaacccagaaagaaagccgttcccagaaagtgaattggctggaactttgatcttgagaaaataaatttctgttgttaaaatatccactctgtggtatttcgatatggcagcctaagcagactatgacactatcttaagtagaactttgttgttgttgttttgagatggagtcttgctctgttacccaggctagagtgcagtggggcaatctcggctcactgcaacctctgcctccttggttcaacaattctcctgcctcagcctcctgagtagctgggattacaggcgcccaccaccatccccagctaaattttgtatttttagtaaagacagggtttcaccatgttggccaggctgctctcaaactcctgacctcgagcaatccacccacctcggcctcccaaagtgttgggattacaggcgtgagccactatgcctggcctagaactttgtttatacttctttaacaattatttcattctattttgtattacatttaggacagttttttgctctagaatgtgctgaaatgctatgctacaaccttccttaggcttgatacaagataaaatagcagccataataacaatacaaagtattagtatttctatgacaacaatgatgatcaaggtagagtttttaaaaaataaataatactctaccgttttataaggaaatgtattatatgaagtaagttcctgtgttgttcctatttttgtatgctcattaagagataatatttttaaaatgccaacaattaggttttaaaaactaaacatgaaatcattaattaaacctaaataattttttaaaattatactttaagttctagggtacatgtgcacaatgtgcaggtttgttacccaggtatacatgtgccatgttggtttgctgcacccatcaactcgtcatttacatcaggtatttctcctaatgctatccctaccccaatccccaaccccccgacaggccccagtgtgtgacgttccctgccctgtgtccaagtgttttcactgttcaatcctcacctatgagtgagaacatgcggtgtttggttttctgctcttgcgatagtttgctgagaatgatggtttccagcttcatccatgtccctgcaaatgacatgaacgcatccttttttatggctgcacagtattccatggtgtttatgtgccacattttcttaatccaacctatcattgatggacatttgggttggtttcaagtctttgctattgtgtatagtgccacaataaatttacgtgtgcatgtgtctttatagcagcatgatttataatcctttgggtatatacccagtaatgggatcactgggtcaaatggtatttctagttctagatccctaaggaatcaccacactgtcttccacaatggttgaactcatttacactcccaccaacagtgtaaaagcattcctatttctccacatccgctccagcatctgttgtttcctgactttttaatgaccgccattctaactggcatgagatggtatctcattgtggttttgatttgcatttctctgatgaccaatgatgatgagcattttttcatgtgtctgttggctgcataaatgtcttcttttgagaagtgtctgttcatatcctttgcccactttttgatggggttgtttttttctcgtaaatttctttaagttctttgtggattctggatattagtcctttgtcagatgagcagattgcaaaaatttcctcccattccgtaggttgcctgttcactctgatggtagtttcttctgccgtgcagaacctctttagtttaattagatcccatttgtctattttggcttttgttgccattgcttttggtgttttagtcatgaagtccttgcccatgccaatggcctgaatggtattgcctaggttttcttctagggtttttatgaattaaacctaaataatttaaaaaaatctgtgtacatatagtctgtctcttaatagcctttgagggcagagaccatgtcttgcacatcttggcatcaattcaaatgctaggttaaagcatcttaaatataggtactggaggtacacacaatgcttgttaaattccaaaaggttaattacatatttcccagaggcttgcttctaagattataattttaattctaattttattagctggaaatgtcacccaagagtataataaaaccagctaactccacagtcattcaagatggctctctgacttcttccaggtaatctcctgctatcagtactgaaacatgcctatgaccgagggttaagctcatgctttcatctccccaacacttaaaactccctctgaaagtgacccctctttatctttacgtctctcttatcatgtaaaaatctatcagtgacaaagaggaacaactgcaaagctgcagaaattaaaaacagaccttttgacttaggtacaaaatgtttgcactttggacataaagggaatttgctgagttactgaatcaagtatttatagcaccacataattgattttctgccataataatttcttctgtaatttagcagctcctccacaaatccccatcaaatctatgacttctcaaaaatgctaacaatgctggctaatacaaaggaaacagtgccacctaagcaaaattaaactagaataataatctattcataaagttctttttagggacacatagttattaaaatctttgcttttgttattcacgagtcatgagttttgcattttccattcttttctcaattatgttattaggctgtatcttatcaaaagtattctaattcctatcttcaggctacaaagtccttgccctaaatgaaaatattagagtccactaaaaaccaacataatcaagtatgccctgtgacttccaaccccaaaagtggaggatgctgacatgcatcatcatcggttttgccatttgccagctggaggacctgggctaagcttggtgagcatagggactgtgtctgttttatttgtcaatgtatatccagtgactggtgaagcagacattcaatttatagttgaattcatgtcctgtctttcattcaacaaatattcgctgtgcacgtactatatgccaggcactaggttaggtgctttacatgaataatttcatctttagttatcaccattttagagtagaagaataaaagttcagacagttaaacatttgtttcagatctcaggatgaggccaggcttggtggttagtgtctgtaatcccagcactttgggaggccaagatgggcggatcacttgaggtcaggagttcaagactgccctggccaatgtggcaaaactccgtcttcactaaaaatacaaaaattagctgggtgtggtggtgcacaccggtattcccagctactcgggaggctgaggcaggagaattgcttgaacctgggatgtggaggttgcagtgagatgagatcgtgccactgcactccagcctggacaatgagtgagactctgtctcataaaaaaaaaaaaaaaaaaaaaaaaaaagatctcaggatgagccaagattcaaatccagatctttctgtggccccagagttcaggccttttccttactataccacacaacaacaattcacaatcagaagctaaaagctggaggttgtgaagcttgcatgttattaactatatctggctgagtatgtgttttgttttggctgtctaggatttttgaaaaatgaagccaacattttaaactgaagaggttttacatacaatctaaatttcgcgcttcttttgaaaagcctaaagatgtggtagcaatgttcctacatccctgtatggcaacaactgctgaagctaagcagaggctgccccttagatgggacatgtgctcttcatgtggcctgctaactcatttgcgttatttgtttggcccctgtagatttggtttgtaacttctgctacctctatgtggatctctaagtaccctcatcagtgcttgtctattatactagcctactaagtggcctctgttgctctaacccctcatcttcctatcttctacactgctctagtttgtttctgaaacaatcacgtcactgccctactcaagagtatggtattacgtactccttagtgaccagagaataatattagtctaaactccttaacatgacattctagacattctgtgatttgatttcaaattacttttcctgtcatattttccttgtctaatgactgcatggattgcagctatcctagaagggggtgtctagtagcctgctacaaaattctgcccctgtcagcattttaatcaatggcttggatcacaagaaatatgattttcaaatttaagaaggaggaaaaggaaacctataatttatttatatccagcctcagaaatgcatgccttaatccttttactgcctacagaagactctggcaagtgcttaacaaaaagatctggagtcaatggtggttttaagattatgtacaagccactcacagagatactagtgctcctttgcccttttatagcataaaaaggcatttttggatatagaatctcatttcttcaagtccaacaacaaaaataggatgatagataaaatatttaaatgaaccgaatgagtgattaaataaagtaagaattgtatttggacagaaagctcttggcacagcagtgatacctaaggataaattataaccatgaacatttttcagaattccaaagatgtgttcagcactctgctgggggctgggatggtgattctaaaatgtactatcacatatgaggctcaaaacgctggggtgaagccagtgaaactgataacacagttgttttaggaagaacgagtaactgttaattgttacacgcatctcatctctcataactacagagagagttaagctataaaaatttagtttattaattccaaataaggggaaactgtccagatacttttcccccgccttaatccttctagaggattcaaatctcactcctggtggactgatttctcatgataacactttggcatggagcatgcccagagttcagctgcaaggcacttcccagaagtcatgtcagcttcagctagccttcttggatggaaaagagaacagattttagctttggccaagtagagtctctacaacactccccatccccccccaattaaacaaataaagttgattttgtaaggaaaacaataaaagcctgggcaacatagcaaaaccccatctctaaaaaaaataagaagaagaaataggctgggcgtggtggtgcacacctgtggtcccagctactaaagaggctgaggtagcaggatcccttgagaccaggagtttgaggctgcagtgagccatgattttgccactgcacttcagcctaggtgatagagtgagaccttgtgtttaaaaaaagaaaaataaagcacaaatgtgttgtttttccacagctctccttgtaacaccacagatctttacacaacataatgagtcaagttgttaaacatgcaattcggaaaacagttacttagtaaagagacaacaattccagaccaatacaaatgtcaccttaacttgaaagacagcaaaaatgcaagcagtcaccagacaacatttcagaaaatgtatcctagggcttgcttgagtgaaaacaaacctcttcataattttttaaccttgaaaactctgcatttgtacttttgttgtttttagaaaatttcctacaaaattcacaagattaggatgaagccagtaaaatttttattgttaccatgaggaagaataattgttaatggtgacacaatatcctaaatcacagaaggtatacaattgtctaacttcagcagatatctgtaatatgtaatttagtgttgaaccactgatttgcacttccatacagttctgtttttgtgaaacttctgatacagtgcttaaacataacttctcggccgggcatggtggctcatgtctgtaatcccagcactttgggaggccaaggcgggcggatcacaaagtcaggagatcgagaccatcctggctaacacggtgaaaccccgtctctactaaaaatactaaaattagctgggcgcggtggcaggcgcctgtaatcccagctacttgggaggctgaggcaggagaatcacttgtacccaggagggtggaggttgcagcgagctgagattgcggtactgcactccagcctgggtgacagagtcaaaaaaaaaaaaaaaaaaaaaaaaaccaccaaaaaaaacccattatcttctcttgcactaatcaatatttcttttaagccatacttcactacaaacttaataaaatatcgtttaattcacattgcttctcttgcccaagcacctaaaatagctatctattagcctgggcaacatggtaaaatacaacaattagccagatgtggtggcacactcctgtaattccagctactagggaagctgaggtgggaggattgcttgaactcaggaagcggaggttgcagtgagccgagattatgcctctgcactccagtctgggcgacagagcgagactctgtctcaaaaaaacaaaaacagacacacaaaaaagctccctattgatcacatatctggattttacaacctggcatcaaagatctgcataataatggcaatattagctaagatgtcaatagcacttactatgtaccagtatttctaccatctattgctgtgtggaaaaaaaaaacagccaaaacttagtggcttaaaaacaaccactgtatttttttattttaaattgattaaaataaatttatacccaggacatagcagaggactgcaggtgcctcctccagctctgtcccccaaaacaaccattttattacctctcactagtctatggattgactgatggttaagggaataggttctgaaatcagactaactctcaaggttatgattgtgaggattaaatcctcacgtgtgtatgtgaagtgtttagcatagtatctggtacctaggaagtgttcagtcaatgctgggcatcattattattatattttatgagttatttttcctaaactcaatgataataaatcacaagttcctcaaaggcagaggctaggtcttcgatgttgaggttcctcatttagactaccaaagggttcttaacacaagaaagagctgaataaatacttttgatttgaatcaacaggtgtgataaattaaaaataagtatccctcatttttcattaagcttttagaaccctaaacttacagacctgaaaaaaaggggccctaagttattttttggaggctagaatctccaagcactcccccacgccagcctggagagtactgtctttataaccagtgtctactggtgaagtatgacattaagctgtattagacatcatcagcatttacacagaagtgaatgacagactcttagggttctgagactcttgaatacttctggaatttttaagacactgatggcttcagccccagagattttgttttcaactaccctttgatggaggctttgcatctgttgtctttaaaagcactccaggtgattctaatgtgcagcagagttaagaatcatgggtccaggtcaaaggattagagcccatattgagcaataacagatctgaaatcaggagacctgggctcttgtattgaatactggatcatcaattcaattcaagaaactgtttttgtgaaatgctctatgctagataccataacatgaagaatgaggagccaataatctggacctttagtttttgagtctgatcatttaaagatgggagtggttttcctacttttaaaaaaaatgtggttttagcttttaaaaatgaaatcttacatataagttcaatatatgtaaaagaaacaaaaggaaagcaggttggcattaggaattcctactatactgcattagccttccccctgcttttctccattggaagctgactctaactgcattttcctcctacagttttggtggcgtactttctccttatcctaaggttgcaaatttcacttttcttggagcacaacggaagagaagtcaagcatttgccacagagctgtgggtgcacaaaatactcatgctgactagaaccttggctcagaagagtccctatctgctcaagtcttatgggaggcactgtagtttgtaccatttctgactttctgcttagactctcccatgtgttttctgggctaaattagtcactcttctccaattgttccaagtaatattctgggaaaggaaaacctaacaaaataacttaaatattcaatcatgtaaacacattctcaacatttcatggaaacaatctaaggcagtaaatccataaaccaaagaaagctttctgggacctagacattcaaatagtgtaattatggcctggcatggtggctcacgcctgtaatctcagcactttgggagactgaggcggacggatcacttgaggtcaggagttcgagactagcctggccaacatggtaaaaccctgtctctactaaaaatacaaaaattagctgagcgtggtggtaggcgcctataatcccagctactcaggaagctgaggcaggagaatcacttgaacccgggaggcggaggctgcagtgagctcagattgcaccactgcactctggcctgggggatagggtgaaacttttcctccaaaaaaaaaaaaaaaaaaaaaaaaaccccacccccccaaaaaaaacccagtgtaattacttcccattattgaacatgatgtcaatactcttcagtggctcatgacgaactcttcattgtattatttgaaaatttaaaaatattattaaaaacttaaatctatattgtctaatactttcttccaaccctcacgttgcccacgaacaaaactctttcaagtctaggtctgtatacttcacgatcttttcttcttcaagttttacaagacataagacagtgggtagaaacagcaataatcttactggttctgagaaaaatcacagtagacattaaagcttgctagttccttttttggtttagtggggacactttatattatattctatacatggtgatagcaaagtaagaagaggtatacttttggaagaaatctattttttttctggaagatgaaaaatttcaataaaaatttttacgtttttattaagttattctgttgtaaaaattttatttttaaatgtgtatgtcaggaattatttgatggtcctggaatcctcctgcaatagggtccaggatgattgtttccaaggcagaaacagaattgaaacagactcacacaggacaacctccgtagcgttgccccccaatcttctggcatgactttctaggagatgggatgcgttctcccttcagtacgatcttggccttcacctcctactgtctcagaattagaagagagggcattgttccttttgtcaaacacatggtccctttacctgtttgtgggaggtgttacaatcttctaaaaagaaaatgtacttggaggggccaacagaaataatcaaattccatgctactgtagaataaattagaggctggctcagtcataattatgtttcctttctcactgttttcttgcaaaataaatgatcaattgatttttaatggcactacataacctactaaagactgctcaaattagcaactttcttttaacttctattccaaagtagaaattctgcaacttcacctgatcttcacatgattctcctgtgctgtctcattctttagcttttcttcattttgttattccatagattttttttccatgtttctgacctctattcttttttttctcttcttccaacagagttctgtaatcatctctctgtagaagcctcttgtatttatatttgtagctggacttatctttcaagttaaaattctgcaattttccttgttttctggacagatccacatagaagtccaagctacgggtagcctgtagttctttggttttagttttattattaataattaggaaatctttaaaaagtggatttctgcctctttttttttgagacgaagtctcgctctggagtgcagtagcaccatcgtgttccttctgcctccatttccagtcacaattcccagtaagtgattcatgtgttttttttttgcctataatatttatgtcatctcatacttcacccactctttatctcattcccacctgcaagataaatgctcatttatcattcatgggcacacatgtcacaatttttgggggctgttcctccttgggtcaccaggaactaatgtattcttacagtacttagattgtatctgttttagaatacacatgctataatttgtttgactaatctatcttctctgtaagcgtgtgtatttaaggttggagattttgacttgttggcttttgtagtcctaatactcaggacgtggtagcataggacatcaatgtctactgaactgaactgtactatatttcttttggagtagacaaagaaatagtcttagtaggctgcctcatttttctgaagaatgaacaaaagggtccaaacctttttttcatcatataaaaaaaaattgtccatcacatgaaaaaagttaattatcattcaaaaaaagttgataagttcagaaaaatatttcataaaattaaaaattagtaattattataaaaataaatttaataagattaaaaatactgttaattattcactgaagaacacaataagtgttctagagcttctgagtaaattgccccagtttccttctatcactagtttaaatagtatatataaactaatcttaataaagaacattagttctaaactaattataataattcatagtttctcagaagcagaagtttttcaggagcagtaggatagaggaacagtttttcaaaactagaaaggaaaagtgggagaagccaggagaggttgtgctgaaagggaagaggaggaggaggaatgctaaactgtcttaaagaacaagaagaaaatgaagggaggaaataaaagcaagacactaattctctgaccattctaaaattctgctgtgctggaaagatgtgctgtaataaacacattcacatcttttccaggccaaatgtggattcagccagcactgatgcttgtcttcactctcaaacatttttctgctgactaatttatttttaagattaatatttggtttacagcagaaaaaaacgatgaaaaaaaacccttcatcacccactccctcccctatcttttttttttgtggtcaaaaatataatcccttgagacctattgtaggaaatgcgatgtatccagatcacgaagtctgaaaaaaaacaaaatccttttcctattttgtaaatttttgagacctcttatcatttaccaattaaaagtgatgacttaggaaatatctattttttatatttctataagatttttcttctagccacaatctcaatactatgaaagtcggcatatttgtattccatcagaattacctacaaactctcgtatctatagaaggacaatcaggatccatattaattactaaggcaaagccagtattcaaggaacttctgaattattagtgaaatacaaaagtgtatttagtgtaattttgaaaactatgttccctattagaaatacgtgaaaatggccaggcatggtggttcatacctataactccaacacttggggaagccaagggggaggatcacttgagcccaggagtttgagaccagcctgggcaatacagtgagatgtcatctctacaaaagaaaaaaatttttttaaattagctgtgtgtggtggtgcatgcttgcagtcctgctactgaggaggctgaggtgggaggattgcttaagcccaggaggtggaggttgcagtgagctgagatggcatcactgtactccagcttgggcaacagagctaaaaaccagtctcaaaaaaaaaaaagagaaatatatgaatatttgaaacttataaataatactatgtaacgattaaagggtaaaccataacaacttgactttgccccctctaagccaaaacttaatgaagtatccttgctggttatatgtgtgaaaatgcctgaagaaattagagggcaggagtgatgtcaactcagtatctctaagcaaaaagattaaaaaaaaagtttctagaggtatgcttcataaattggaactcatttgaagaactctattatagttaaagaacttgaggtttgaaatcagacagaattgagtgagtcctgttctgacatttactagctaggtagtatagattctttccaagccacatttccttcaccttaaaatggaataaaatttcactgggttagattaggtactgcaagtcaaacgtagcatcttgtatatagtaaaagttcagtaaatattagctctctttattattcctatcacctgcctctggactcccattctttactgtgttctgttaggtaaatgaacttacatgagaaacaccaggctttgacatgaaaaacacagattttactttactcatgttagggagtatcggctgggggaatacctagagtctgatggtggcaggaaggtcaccacttagctagctcaggaaatgctgtgactctctgcactttaatgtcaccaactgattaggtcagttagatttacacaaatgacacaagtgacttttctaactgcttctctgattaggtaagttagattcatacaaatgacacagattactttttccaggtagactttcctattaccctaccctgaatttacttgccatgggctttcatattttgaaatggaaataataactaggtctaaaaattttatttacagccagataaacctgtgggtctttacgtagaatgtataagccaaagttaaaattcagcaataaagaaattaaataactataaaatcaggtagaaatgtaaatttatatttctttaaactgaggagtcatgttgtacatctcacattttttcctaatatatttataagagaattagtttaattgtatattatatactgaattagacacattttgaaataatacaggttacctaagcactccaggtgtggaaaattcttaataattagcagtcttaacgaaatcttctaacaacatgggtgagcctcaaaacctttatgctcagtgagaaaagcaacacacaaaagaacatatattgtatgattccctttaaataaaatgtctagagaagacatatttatagagacagaaagcagattagtggttgcctggggatggggagcaactgagaatgggcataaggtttctttttggggtgacagaaatgttctacctatttatttatttatttctattttttatttttgagacggagtctcactttgtcacccaggctggagtgcaatggcgtaatctcggctaactgcaacctccacctcccaggttcaacagattcttctgtctcggcctcccaagtaactgggactacagaagtgtgccaccatgcccagctaatttttgtatttttagtagagatggaggtttcgctatgttggccaggctggacttgaactcctgacctcaggtgatccaactgcctcggcctcccgaagtgctgggattacaggcatgaaccatcactcctggcctatttatttatttatttatttacttacttatttttgtttttgagaaatgttctaaaattagactgtggtgatggttttaccactctgtaaaacactaaaattactaatacacacacttaagatgggtgaattttatgatatataaattatacttcaataatcttcttcaaacaaatcttttgaatggctagatactagaaaataaatttttaaatgttgaatggagaattttgaagaaaaaatatgtttctcctgagaatgagtgtctgaataacgctcttattctgaagtaagacctaactcaatcaataaaacttcctcaaatgccaactacatgtggaggatctttagaatctggaaaggcttcacttcaggatgattgcacttaaggtgaatagggtatttatttttcctcccagggtaaacacaggctataagggtaccaaaggagaaagtgttagctctcctgggagtcattttgagtatcaataaccaacagatgtgcctcaaagaagtaatgggacggctttgccatattttgacagattccaggaaaccctttggaataccctggttattaagaaccacaacagggtgaccctgaggtgcatgggtcactggagagaaggcattaagttaaaggtggcagccgggtgtggtggctcacacctgtaatcccagcactttgggaggtcgagacaggtggatcacctgaggtcaggagttcaagaccagcctggccaacgtggtgaatccccatctctacggtaaaaatgcaaaaattagccgggcgtggtggtgggcacctgtaatcccggctactcgggaggctgaggtgggagaatcgcttgaacccaggaggtagaggttgcagtgagctgagattgcaccactgcactccagcctgggcgaaaagagcaaaactccatctcaaaaaaaaaaaaaagttaaatggtggcttgtggtgaaggggccatgactttcactgttgctcactgctattgttgggaaggaataatacaaaagtatgctactgtggttctatttctgctctactgggttttactttattattttccttctaaaaaagtaacctttagacatgaacccctgctttacatattctcagtatacactctggctctgaatttaataaacataatctttaaatgcaaagggcataagtaaatcaatgagtagcccaatgttattattcatcaactttgaaacgattcctctactgtcaacagctgatcaatggatatgaaaggccattagtatgtgtcgtgagggtaagggattatgtgttactaatctgtgattactctgaaacagatataagcacagggcttggcatagctaataaattgaaatcgaaaatgaaagtaccatataaacaacaaacataagtataaaagattacattatttttcacagtaaaagtaatcctaagaatttaaacctggctgttaaggtaccaccttcaaagaaggcttccgtaagagttaatgaattacatgttacttagtaaaagtggaaagaagtaagaaggaactgtaggcttacaatccaggggaaaaaataatttgtggtggctgtcgcatgacaaattccaaaggatctaagacaggcgatgttacaagtgggaaaccttgaacactctgacactaaataaaactctaaaagataaacataacctttcatctgggctaatgaaatatcctgctcatatgagaatagtaggtacatatataccatcttttcattacaaatataaatggattaattaaaaataattaggtatatgtgctattatgagaggatgaccaagatgtaccactaagtgaaagaatcaaggtgtgaaaatagagtaaatggtttgtttttgttaaaaacgatacttttaaaaaaaattatttttatttttattttgagacatagtcttgctctgtcacccaggctggagtgcagtggcgtgatctcggctcactgcagcctctgcctcctgagttcaagtgattctccttccccagcctcctgagtagctgggactataggcacactccaccatggctggctgatttttgtatttttagtagagatggggtttcaccatgttggccaggctggtctcgaactcctggcctcaagtgatccaccaccaaaaaaaagaaaatttttatctgcatgtgctggcagtaatgcgtgactcttccctggcccctgaccctcattcccactccttttccccaggaaggaaaccaatggttcagaggaaatggggtgaaggtggaaaagggaacttttactttgcattttgttcctttctgtactatctggaaaatatatatatatatataattttttttttttagacggagttttgctcttgttgcccaggctggagtacaatggtgcgctctcggttcatggcaacctccgcctccaaggttcaagcaattctcctgccacagcctctcaagtagctgggattacaggcatacgccaccacgcccggctaatttcgtatttttagtagagatggggattctccatgttggtcaggctggtcttcaactcccaacctcaggtgatccgcccgcctcggcctcccaaagttttgggattacaggcatgagccaccgtacccggtatatacataacttttacttaagataatgtccatctggttggtggcattgtggaccagtttgatttttaaaaattatctgcagtattagactattaatataagttcctagggaccatgtcaatgttttattaatgttgctgcccagatgttgcctgttatagtagctttttatattgagatactcaataaacttttgttccactgaaaaaaattaataatgttatttaaagtattttaaaagtaagtttaaacaagacaagcagctgagtccattctctgaagcaatgctggcaagacccaggaatttatactggctggacagtatgaggatggctaatttgcaatttgtgcccaggaatatgtaatttacatctacttcctgaattaacaaatctaatatgcactagaaataattttccaaagggtaaagatttagaaaatatccgagaatccgtgtgatctaccttacctaacccctctgttatcaatgcagtacttctttcttccaaatctatccttctctgtcttgctttgtgatactggaactggcccttataaacatttctcctttgccaaaatgcagaatattaagctttgccagtaaaggtgctgaaggaacactgcagtagaaagtgtattctcttcctagttctggtgtactttctccttcttgctcctgtggtaagcacctaatggtggtgtgtgggaccacagtggcagtgctatctataaagtttcagtggtaccccaggtggtagcttcctatcaagtttcactagcaccctagaagtttcacggccatcctagtggggggcttcctagcaagtcttgccagcactccagcaggcagtttactgcttgccagttctggtctcttgaaattcgatgccatccagtggccacaacacctctccaacatgatctgaatcagcctagatctgggaaggggctctcttccaagtttgcttctttgttaggtagtatgcctgagccctagaggtagtagttgctccctatattttattcctgcattcttacgaattctctttacctcttagtagttaatcccctattactacttaataactccttatattaaaatttctggtcaggcgtggtggctcaccactgtaatcgcagcactttgtgaggccaaagtgggcagacagcttgagtctaggaatttgagaccagcctgggcaacatgatgaaactctgtctctacaaaaaaatacaaaaatcagccaggcgtggtggctcacccctgtaattgcagcactttgggaggccaaggtgggcagacagcttgagtctaggaattttagaccagcctgggcaacatggtgaaactctgtctctacaaaaaaatacaaaaaatctgctggacatggtggttcacacctgtaatcccagcactttgggaggccaaggcaggcggatcacaaggtcaggagatcaagaccattctggccaacacggtgaaaccctgtctctactaaaaacacaaaaattagctgggtgtggtggcacgtgcctgtagtcccacctactcgggaggctgaggcaggagaatcacttgaacctgggaggtggaggttgcagcgagctgaaatcgcgccactacactctagcctgggcgacagagcgagaccctgtcacaaaaaaagaaaaaaaaaattagctgggtgtggtggtgtgtgcctgtagttccagctacttgggaggctgagatgggaggatcacttgagcccaggaggcagaggctgtagggagctaagattgtgccactgcactacagcctgggcaacagagtgaaacactgcctcaaaaaaataaaaataggccaggcgcagtagctcatgcctgtaatcccagcactttgggaggccgaggcaggtggatcacctgaggtcaggagtttgagaccagcctgaccaacatggtgaaaccccatttctactaaaaatacaaaaactcagccaagtgtggtggtacatgcctataaccccagccacttgggcaactgaggcaggagaatcacttgaacatgggaggaggaggttgcaatgagccgagattgagccattgcactctagcctgggcaacaagagctaaaactctgtctcaataaataaataaataaaaataaaacaaaatttctctgttcaaattactggtgtggtttctggctcctgactagaccttgactgattcatccctaaaccaaaataacccaaaacaaactcatccaacaacaaaccatgccaaccacaaaaaatcaaatctaagcccaccactaaaacctatgtatgattaatctgctaacacagagaaacagtatggcagttaccaaacttgttaacttattgcttcctgaagctgactgtgcatgtagctgaatagtaagtcagctgctaccacagatttactgtttatgattgcatatttcagaaggatgtattaaatgcattgttctgagtgtgggtggttatctaattctttacaagtccttcacgggaaaagaaatttgctggttttttctgccataagaatgaatctatttatgaaaaagcatagatataactgtagtaagtgacagaattttaaaaaatcactgtgaacattccagaaagttctcagaaggttcgcagaaattaccagtaaagttaaactctaatttctggcttcaatgtcattcattcaataaatatttactgagtggccctgggacatagcagtaaagaggacagacaatattccagcctcatgaaatttactttctgtgatggggaaaaaacatgtaaacaaaccaatatgcaacataaattcaggtgttatgaagtactataaagaaaattaaggaaaaggatgtaacgggtgtgggtggtattttaggagatgatttagtgttctatattaaatttcctacacatagcatgcaataaatgttataataaatataaccgcagatatatcttaggcatgctactaagaggacaggattttcatgtagttccataataaatcaaactgaatacatttatgtaaatcataacaagcttatatatggaccaatgaaacttaccctatagaaagcactggtcaaagggagtaatgctgcggcaatgttgtattcttctaaacttgaacaatcctttaagcaaaacaaagacaaaagagcattaggatatttaccagaaatcacaaatacatgcgaactaacatctgggatacactgtttactgtcctatggggtttttacctttttattttgcagaggacctgacggaggggtttgtactcttattccaaattgccattaagacatagctaggtaagttttgggggaaaaaactgtgtgtgaagcacattcttttataaataaggtaaaagtatatttgagaaaggtattttcatacattattgctgagtagccacctttactttcctgctctacaaagattgttaaaagttgtgtaacttacacaaatttttttttggaggaagttttagtatattcagcaactgtattccattgagtctaagatacatttttttgcacattttaacatttctgagatggggatcatcttataattgactggagatatttttttctttcttattgttatataaaaagggttatctttcaggctgggcgcggtggctcatgcctgtaatcccagcactttgggaggctgaggcgggcagatcacctgaggtcaggagttcgagaccagcctggccaacatggtgaaaccctgtctctactaaaaatacaaaaagccaggcatggtggcgggcgcctgtaatcccagctacttgggaggctgaagcaggagaatcgcttgaacccgggaggtggaggttgcagtgagccaagatcccaccactgcactccagcctggacaacagaatgagactccgtctcaaaaaaaaaaaaaggggggtggggcggggaggatctttctattgatcagacaagatatatcactgattctaaaacccattgagtgaaatgctgatgaatagaaaggtcaggaaatctcagtgggaaggtaaaatggcacagtgactgtggaaaacagtatagcgattccacacatgcaaaaaataaatatagaattactgtatattacagttattcttcttctgggcatatacccaaaataatggaaaacaagaactcaaacaggtttttgtatactcatgttcacagaagcattattcacaataggcaaaaggtgaaagtgacccaggtgtctgttgacagataagtgaataaacacaatgcggtatacaagcacacacacatagatgcatagaatattcagccttaaaaagaaattctgacacatgctaccacatggacattatgttagataatttttttttttgagacagagtcttgctctgtcacccagggttggagtgcagtggtgtgatctcagctcacggtaacctcagtctcccaggttaaagcgattctcatgcttcagcctcccgagtagctgggattataggcacatgccaccacactcggctaatttttatatttttagtagagacggggtttaactcctgacctcaagtgatccgcctgtctcagcctcccaaagtgctgggatcacaggcatgaaccaccatgcccggcggatagatattttcatacagttatattaaccagtccttcctctgtctagcagtggggtccaatgtggccagaatccagaatagtgcccacaatggctgcaaaagctgcaattgattttcctagtgggtgaagaatagtgattaaagccctgaccttagacaatgtagctatctccatcaaaactcctcatccatccgttataagtttgcatgaaatgattttaaactcatagagctgggaccttagacatcaattattccagtgcaattcctccactttccagactagagaaaagaggcataggtgtcagccacagagccacaactggagtctggatttatctacctatcagtgtggtgttttttcctctagacactgccttttgtacttgctttcctttaatttttgaggtagaacatatggattgtctgaacttccagcactaattttagagtgtgagggtggtgagaactaacctgaccaggagagcagcagaaggcttagagctgcctaagtgcactagtgcccgggagaagcactccagaaaacaggaggaagagtcagaagggaaagtcagaagtgaggaagagtcagaagggaaataggcaaagataatctttgcctatttcaaactactgctgcggatggggagggcgtagtactgccctgaggaaaaaggaagaaactttctttcaagagcttagcctagaagtggccatctagtctaaagctagtctttctagcctgagtgcttttggtactaggatcagctaaaagagttttcaattgaatttcatgtattgtcaattctgaaaaacagtttagaatttactgcatgttctattgcaatgactactgaaacaataatggattataaggctgggcacggtggttcacacctgtaatcccagcactttaggaggcagaggcgggtggatcacctgagctcaggagttcaagaccagcctgggcaacatggtgaaaccctgtctttacaaaaaatacaaaaactagctgggcacagtggcctgtgcatgtagtcccagctactcaggaggctgaggcaggagaatcgcttgaacctgggaggcacaggttgcagtgaactcagatggtgccattgcactccagcctgggcaacggagtgagacctgtcttttaaaaaaaggattataagataaatctcagcagtaaaaagtcattctcatatggctcacattctgtgacccagttaaaaataaaaaagtaaaagataggctcaagcttcctatattatgctaaaaataatattttaactaattcatcctattgaataaacatttattggagaaatgaataagtgaataaataaaggaataaacataaggagaacaatgagaaaaaggggctaaggacagaaacttgggaaagatatgtatttatataaaggcagagaggaaaatcaagatggggaaggagaactggtgagaatggtatcacagatgttaagaggaaatgaccaacagtgttacatgctttagaggaagtttagtaaaataaagattaaaaaaaaaacaacaacaaaaacatgagaaactgatgaatataagaggtcactggtgatttctgaaattattagagaacaggtgagtagaataaaacaaaaggccctgactataaatcttcaaggttggaaaggagagcaataaaatagtcacttgggctgggtgtggtggttcatacttataatctgagcactttgggaagccaaggcaggaggactgcttgagcccaggagtttaagatcagcctgggcaatatagggtgactctgcttctacaaaaaattaaaaaaaaaaaaaaaactggccaggtatgatggtgcatgcatgtagtcccagctacttgggaggctgagatgggaggatcgcttgagcttgggagtttgaggctgcagcaaactatgatcatgccgtgacaccccagcctgggtgacacagagagacactgtcaaaaaaaaaaaaaagccacttgaagagttattacatctaaatttattgtttaatgaatctcaacagggctcaactagatgaacggtgagattttatccaatcctttgattcttgagaattagaagggtcccaagtacactaaaagggaaactccaatggaggagagagaggaaaaagaaagatcactagtagactgaggactctgagatacgtctggtagtcaatatggtccccatttctaaggcatggttagaccctgaaaacatcataaaaagcaaatatctagaatttatattaaacagcaagatccctgatgatatcatcagatataacatatgaggaaaaagcagcttggttctgcaaggaagactcaggacttcctatttttatggtgaggggaggatgagtggggagagctctttaaactattctgctaatactagctctgtagagtactgatagctgttacttggggggaattggggaaatgctgggtaaacaaaattaaacaaggttttccttttcttctttttttttttttttaaaaaaaaaaaacaggatttggcaggattttaaactgtgactccatgaagggaattcggtatacagcatttgtaaacccagtttcactgagtattttaaaagaaagcagttgtagaatatattttggaaaatgatgatttaagatcatcaaaaatcctatgaaagaattccaaccaaaatgttagatacgagttctaaatttcattttaaagaatcaatatgtcagtatgttcaattctttgccttctacttttaaacttaacttcctcataaagcaacctttttcgattactgctccaccctgactcattccagttaccagctccgccctgactcattccaattatgtgatacctgctccgccctgactcattctccaccctgcataaccatttttcccaccaaaccactcaccctgtcactctctttaaattagccaatcggaattagtttagcctgtgcggtctaaccctagccaataggggaaggacgcagcagcaggggccacgtgcgtcagggataagaaccccttcccttcccttgtccaagtgtgagctcaccattgctccatctgtaagggtgcacccttctatagaagtaacttgccttgctgagaaaaagacaattttatatttgagtgctatttcttttgcggcactgaaactttatttataacaaaaagatcatttaaaaaaattttttttaaatgttcttagacaggatcctgctctgttgcctaggctgtgcagtggcacaatcatagtttactgcagccctgaactcctgggctcaagcgatcctcctgcctcagccttccaagtagttgggactacaggcacgcatcaccgcacccagctaatttttaattttttttttgtagaggcagggtttcactatgttgtccaagctggtcttggactcctgcttccttctgcctccacctctcaaaatgctgggattacaggcataagccatgacacccagcccaaaagatcattttaaaatttacttatggatttttatttcttgacttatggttgttttcataatctgaaaggcaatttttctaaaaataattttaaatgatagataaaatattttaaaatctttaatacaatgcaataaattggcaagaaagcaaggaatatgcagaccaaaatataagtagaaacttggaaagataaacagagcactgaagctaaattttaacttaggaactggtggtgagcaaattttagtattagttgtgaactcaagagactcaagggataggacaaaaagactagcacttgctaaagggaggaagtccattagaagaatataaaccaaaaatgaaatcctgagccctacaaccaaatgaatagacccctggccaaagggatcccagcgaaacctgaaaaactgaattcctggccataacaggaagggaggtcagacacgccccattacgccctctcccttttggtgtttaggtaaaattacagatctgacaaaacagactctttgtggcaataagataccagattataaacacgacctaaggccatgcaaggcaggggttaagtcataccctataaaccataaaatctcattaaatgggttttttttaaatttttatattttgagacagggtctcactctggaggctggagtgctgtggtgcagtgtgcgctcactgcagctgcgacctcctgggctcaggtgatcctcccacctcagcctcctgaatagctgggaatacaggcatgtgctaccacgcccaggtaatttttgtattttttgtagagatggggtttcaccttactggccaggatggaatcaaactcctgaactcaagtgatcctcccacatttggcctcccaaagtgctgggatcataggcatgaaaacaggtttttaaaattatcccagcataaagcagcttcctttccaacctgattctgatacagcatcacatgatagatagaagaccctgaaggaaatcaaaatatttttctttgacatattgtgaaatggccctgcaaagtcatctgttgtgggagaaatctgcatctgtaaagaatctccattaatgcagccaggccttccctttctaggactttctcagctgtgggagagattagctgggagtctgacacttttatggtctaaaaagagacatgtaccatctattctctctgagggctactacctatgaggcttcatctacataataagggctttgacctccacaactcccttatcttgactcaagcatttctttctactctactgacatcaagtatttatacaaagcttaactctttcaatcagtagccaatcagaaaatctttgaatccacctatgacctgtaagccaccaccccacaagatatcccacctctttaggacgaaccaaggtacaccttccatgtattgatttatgattttacctacaatttctgtctccctagaatatataaaattaaactgcaacccaactaccgggctgtggtcactcctagtggctcagaataagcctctttaaaatattttacagatttgatttttcaattaacaagaatgacaataatcctgggatctctaaagccatctatgacaccagatagaaagtctgagatgtaagaagataactgagccaaaaaagagataaatatgtaggtaaatctaaacacacattgactgtataaaacaatgacaatactgtcttttgatagcaaagaaagttaagatacaactaaactatacaaccatggtagcatagactttctaagggagtggattggagttagattttgatagattttgataaattaagtaagcctttaagaatttctgtattatcatgaaagaaacagaaatagagtgggttgcaacttccaaactagtggaggaaaaaatggaataataggaaaataaaaaaaaaaaacaacaaacctgaacccaagggaaaacaaaaaagaagtggaaaaagaaactcagaaaagggaaacaattggccgtgcgcggtgactcacgcctgtaatcccagcactttgggaggctgaggcaggcggatcacgaggtcaggagatcaagaccatcctggctaacacagtgaaaccccgtctctactaaaaaatacaaaaaattagccaggtgtggtggcaggcatctgtagtcccagctactagggaggctgaggcaggagaagggcgtgaacccgggaggcagagcttgcagtgagccaagatcgtgccactgcacaccagcctgggcgacagagcaagattccgtctcaaaaaaaaagaaaaagaaaagggaaacaatcagaaaaagaaaaaaaataagatggtaggaataaatgtgttagtggtggcaaatatctgagtctcacagcaccaaatatgttaccagtcaaggtatccaaggtattactgatggtgaatccatatgcgtctgcagcaagctcaattcttgcctcctcagaagaaagaattggactgaggggcataaggcataaaaagagaccgaggcaagtttcagagcaggagtggaagtttattttaaaaagctttagaacgggaaagaaatgaaataatgcttggaagagacccaagcgggcacgtgaaggtcaagtgccattttaaccttgatcctaggactttatttatacgctggcccctttcccatgattcttcccttaggctgggctactcataagtgcagtgccctccttacacttgggaggtgagcatgcgcagtgtgtttaggaagttgtatgcacgcccatctgtggctttcttccctttttgggtggtgtgcccctgggaggtcatactctgccattttgtctcttaatgctcatgcccaggaagttgcttctccctggtgcctgcattcaattaacactttagtgtaccaggtgtggacaatcaggaaatggactctccctggtgccagctgccaatttatcacttttagagaggcaaagtgataactgcccaactatcacctgacattcctagagggtgggggacagctttctcctgccccgctcatgcctgtctaactacttgtaacaaatacaaatacaataacacaaatggaccaaatgttctggttaaaaaaacaaagattgacactgaatctaaaaacagaatctaaatatttgttgcttataaacaacatatatatatataaaacttaaggatacacgaaatttaaaggatgaaaaaatatgtaccaggcaaataccaaaagaagttggggtagctatattaataatcagaatataaaatactctttaaggcaaaatgcattactagggataaaatgaagcactacataataataaatagctcaatctaccagaaagctataacaatttaaatgtatataaacctaataacttagcctcaaagtatacaaagcaaaaactgacagatgtaaaaggaaaaacagataaatttacaatcatgctaaaatattttaatatacctctctcagtaactgatagttcaagcaggtagaaaaatcagtcatcatattgaagattaaaagaaatactgtaaacgttagagctaatagatatgtatagaacactgtatacaaaaacttgcttgctctaatggacactgcactttctaacactgtacccagaactgttcacatggatttaaaaaaattgacctcatactggtccataaaataagtatcagggctgggtatggtggctcacacctataatcacagaactttgggaggccgaggtgagaggattgcttgagctcaggagttcaagaccagcctgagtgatagtaagagctcatctctacaaattattaaaaattagttgggtgtggtgtcatgtgcctgtactcccagatacttgggaagcagagatgggagaatcacttgagccgagcaggtggaggctacagtgagccatgattgtatcacgtggccttccagcctgggtgacaaagcaagaccctgtctcaagaacaaaacaaaacaaaaaactatcagtaaatttcaaaatgttttgaatcatatagacagagttgtcagctcacaatgcaattaagttagaaatcattaatgcatgtaaaatacttaaaattgtacctggtacatagaaagtactcaataaatgttattatcactgaggctaggaaatgcttagcatatcacactctattgtgattatctatttacttgtatgtctcttcactagattataagcaatttaatggcatttttattaagaagcagttatcaatatttatggcaagttgttgaatgagtgatatgcctttttgaatgtcatacaaagctgaaagaacagtagaacaaatgatcttactaggtcttggatttccagaattaacattgagcgtaatcaggattttcctttgaataacgattttcatttactcaacaaatatttattgagtatctactatgtgccaggcatgctgtagctaatgaactcaggaatctctttatcccaggaggaaatagggatgacaaataagaacacattttaaagggatgagataaattcatggctgaataagatacatccttaaattagaggacaatgatgttcttttatgatgtctctgtggggacctttgttggagcccagttactggttagatagatttttaagtcagaacaagtaatcttttgttttaaattcaagaacatgagttttacatataaaaagagtgactgttaaaactcagtagcagctctccctcagtcaaacctctggaaatgaatgtgtgtgagaaaggagagggagaaaagaaatatgagtcaatgagaacttccttcaaagagaatattaaaatcaactaaaatattactttgaaggcagtcattaccttggagtcgtgtttaggtttttattttaaaatacagtcaggccatgtaggaaaacaccgcacctttttcctatgtggtatctctgcaaggtctccatcctctctatggattatatataataatcccagaatgcagcaaaaagtatgaatcatctttttcttcctgacttattcctcacccccttaggacactgctatgcacaagaatgtcatctgtgtcctagcacatctgaatttctttaacagaaatgccttgcatgtttctgaagactgtcatgaggcccaaggcaataaagttcaacagacttgagctgtaatcttctcccaaggaaatggttgggatgccaagatgccttttgactttgatttcacagcagggcttcatttgtaatgacactgtccaaactttaaatgacaacagctgtgatatgaagccctacacactcatttataataattttccacaaattaaaaaaattaaacaatggggaatttcaatccatgaccaattagcagggaacaggcaatcataaaacatttagactagtgggcactatttattatcttacaaaatgtttactcattgtagtgcatgtctcaaacctgtgtgctgctcaaatgctgattgcaaaatataaataaaaaattctttgcaaatcacgttagagacattctaagttaattaggttgaaagagggaaaaaatttacaacaataagtctacaactattgacacagcaaccgcattccagaattgtgtggttatctgttggggaatcagtccataaatacacaatctgaagtcccctgtgctttggccaaataatagcattgtagtaataaacataccagacattttataaacttgcaaggtcttgaatactgatacatgttttattctgaactttgctttgtaatttacctttaattttcctgctacaattgaagagtgagccctgcaatcttaatttcccattatcctcaattacttcgtacttttaacctagatacctttgaactgttgttgccaacattccagtttgataaaactctggaatctctaaaaaatgttatatttaaacattaaagaaaaaactagattgaaaggaacaatgtgttacagaactgactttcctttagagtttagattagacacagctcagaaaaaagtttttttgaattgcccaaaacactgaaaacatttgcatcttctacataaggacaaaaattaaaaacacaaattcctctctgtatcacattactctcctattcaaaaattcagctattttctgaccattatagaataatgaccaaactcttctgccaggcttattagcccttctcggtacggatccacctctctacccacccgaccatatgggcccctgccacaagctgctgctttagtcaacctattttatttatcaccttctattccacatcatacttactcctaccatatctaatacggttgaggaagcccatccatgctttggtttgtcatttacatgctttctccttggtattttcatatgcatgcccccatatttctcccttctttccaagtacaatgttaagcaaaaaataggcaaaaggatttttttattacagtttcagcttcaagttatattttaacattaaataaacctacaaaaccataaaggatgtaccacagttttgaataccactgttatttatatgcacaatgactcccattgcaatagaaggtgaatgctaggcttgacaaataatatcaagctttattttaagttatttgagtgaatggaccaagtcacttttaactttatatgcctggaaactagaacactgcacctggcatatggtaataattagttagcacttattaagtgtttactaagtatcacacatatttgaagtatgaatttacagatattatttcatttaatcttcacaacatctcgattagataggtactgtaattatgtcctttttgttgataatgaaactgagcctctcagaggttaaattatttgcttgcgattatatagccacaaatggcagagccagaatttgaacctggatagtcttactccagtatttgtgcttgaaacctcaacgttctcttgcctctcaagtaagatactgaactgaatataaaaatggagtctgtggaaacataattcatgaaaaagaaaccttctagtgaattataaataatatcctcaagagagtttgaaactatacatctatgaaaaagcaattaaaaacataattgttacaattaaaatgcaatggaagggcttgaagaaaatttttttcttatgtgttcattttatctctatatttaggaatttaaaaacattacaaaatatagaggatgaagttaaagcttctaaaatatacctaacaggagtactggaaattgtgaatagagaaggcagatggggggcttggtgcggtggctcacgcctgtaatcccagcactttgggaggccgaggcgggtagatcacgaggtcaggagatcgagaccatcctggctaacacggtgaaaccccgtctctactaaaaatgcaaaaaaaattagccaggcgtggtggcgggcgcctgtagtcccagctactcaggaggctgaggcaggagaatggcgtgaacccgggaggcggagcttgcagtgagccgagatcacgctactgcactccagcctaggcgacagagcgagactccgtctcaaaaaaaaaaagtcttatctttatttaaatttttggcccaaatgccatctgttcataatcttgttgttgctgttgttgttgttttagaaagggcagggtctcactctgtcccccaggctgaagtgcggtggtgtgattttggctcactgtagccttgacctcccgagttcaagcgatcctcccaagcagctgggactacaggcatgtgccactgcgcatggctaatttttttttttttttttgtaaagatgaggttccgccacgttgctcaggctggtcttgaactcctgagctcaagcgatcctctcacctcagcctcccaaagtgctgggattacagatgtgagccatcatacccagcctattctttactttgtattaaaattatgtatactgcatatcctccctaattagtcataaggccttttgagggcaatgattgtgttatacataatagatgttcagtgaatattactaaacaaaagaaagattactctaaaaatgaaaagaaagctattttacaaatacagctaaaagagaaaataaagtattagtatagtgattcctttttatgaaatcacttctcaaatgtgcagttttattctaaggaactcactttagcctaaccacttattttggaaggtttttgttttctattctgttggttttgtatttacccccatactttctctcttttttttttccttttgaccttagaaggaaggtaaaaaaaacctgacttacaatataagataccctgaggcggctgggcgcggtggcttacgcctgtaatcccagcactttgggaggccgaggcgggtggatcatgaggtcaggagatcgagaccatcctggctaacacagtgaaaccccacctctactaaaaatacaaaaattagccgggcgtggtggcgggcacctgtagtcccagctactcgggaggctgaggcaggagaatggcatgaacccgggaggtggagcttgcggtgagccgagattgcgccactgcactccagcctgggtgacagagcgagactctgtctcaaaaaaaaaaaaaaaaaagataccctgacgactttgtggtaaaaacactcaaatcttagtgagaagttaagttgtaaacatctgtagtctgtgggtttattttcagaagttaacctactgaaacctaaccttctatagctcagagtcttcaataactattggaatagtatctaggcctaggacttcccatcaaaaaatattgccattcctgacatgccattcctggcatggcagatcaaagaagaaatgatatatattttaatatatgatgctgaggctgttgggcagaaatatggaaaaataaaataaaattggactcttacttcaaactacatgcaaaatcagttccacgtgggtgaaggttagatggtaacataaaaaaatgtgttcatgacttcaggttaggggaacatttcttatgatacaaaaaagcacagtcaccgagaaaaagactaataaattcaactatagtcacgtggccttataatgatgttttggtcaatgatggactgcatatatgatggtggtcacatatgactataatggagctgaaaaattcttattgcctagtgacattttagccattgtaacatccaagagagcacagtgtaacacattactcagacatttgggctgatgttggtgtaaacaaacctactgtgctgccagtctcataaaaatatagcacatacaatttgtacagtacataatactgaatgataataaatgagtatgttactggcttatgtatttactacactatacttttaatcattattttagagtacacttctacttattaaaaaaaatagctaatggtaaaatagcccaaggcaagtccttcagtaggtattctagaaggcactgttatcacaggagatgacagctccatgtgtgttactgcccctgaagaacttccagtgagacaagatgtggtggtggaagacagtgatatggatgatcctgaccctgtgtaggtctaggctaatgtgtggatttgtgtcttcatttttaatgaacaagtttaaaaagtaaaaaaaaaacaacttttttttacttttttctacttttctattaaaaatagaaaacacagctggggctgggtacggtggctcacacctgtaatcccagcaccatgggaggccaaagcaggtggatcatgaggtcaggagattgagaccatttggccaacatggtgaaaacttgtctctactaaaatacaaaaaaaaaaaaaaaaaaattagctgggcatggtggtgcacgcctgtagtcccagctactcaggaggctgaggcaggggaattgcttgaacctgggaggaagaggttgcagtgagctgagatcgccccactgcactccagcctggtgacacagcaagactccatctcaaaaaaacaaaaaaaacaaaaaaaacacgactgggcacggtggctcatgcctgtaatcccagaactttgggaggccgagtcaggtggatcatgaggtcaggagttcaagaccagcctggccaagattggtgaaaccccgtctctactaaaaatacaaaaaattagtcgggtgtggtggtgggtgcctgtaatcccagctactcaggaggctgaggcggagaattacttgaacctgggaggtggaagtttcaaggaggcagaagtttcagtgagccaagatcatgccagtgcactccagcctaggtgacagagcgagactctgtctcaaaaaaaaaaaaaaattgaaaacacttataaagatataatgaaagaaaatatttttgtatggctatacaataccgtggcttttaagctaagtgttattacaaaagagtcaaatagtttaaaaaattaaaaattttgtaaagcaaaaaagttatagcaagctaagtttaatgtatttttgaagaaattaaaaaaataaattcagtgtagtctaaatgtaaagtgtttataaagtctacagtagcatacagtgatgtcctagaccttcacattcactcaccactcactgactcacccagaacaactttcagtcctgcaagctccattcacggtaattgtcctatacaggtgtaccattcttaatcttttatactgtatttttgctttaccatttctatgtgtagatatgtttagatatacaaatacttaccattgtgttacaactgcctacagtattcagtatagtaatgtgctgtacagatttgtaaccttggagcgataggctataccatataacctaggcgtggaatacgctaaccaagcttgtccaacacgcggcccacaggccacatgcagcccaggacagctttcaatgtgcccaacacaattcataaactttttaaaaacactataaattttttttgttattttttagctgggtgcggtggctcacgcctgtaatcccagcactttgggaggctaaggcaggcaaatcacaaggttaggagttcaagaccagcctggccaacatggtgaaaccccatctctactaaaaatacaaaaattagctgggcatagtggcgggtgcctgtaatctcagctactcgggaggctgaggcagaatagcttgaacctgggatgcggaggttgcagtgagccgagatcactccactgcactctataaattttttttgttattttttagctgggtgcggtggctcacgcctgtaattccagcactttggaaggctaaggcaggcgaatcacaaggtcaggagttcaagaccagcctggccaacatggtgaaaccccatctctactaaaaatacaaaaattagctgggtgtagtggcaggtgcctgtagtctcagctacttgggaggctgaggcagaatagcttgaacctgggatgcggaggttgcagtgagccgagatcactccactgcactccagcctgggcaaacatagcaagactccgtctcaaaagaaaaaaattctaatttttagctcattggctatttttagtgtattttatctgtggcccaccacaattcttcttccaatgtggcccagggaagccaaaagattggacattcctggtaccatctacagtacactcctacttattttaaaaaattagtttgcctaagtagacaacaacaaaattgtcaagctacacatttctcagcatgtatccccactgtcaatttaaaaatttataaaatggcatcatgaagagtcaaatgacaagtcactgcatattgcatacaagaagacatttgtaaaacatataactgttatccagactatataaagaattactataaaacattaagaacaaaagaggtaactcagaaaaagttgggtaaaaatgtaaacaggtacttcaaaaaagagaaaaccgtgctgggtgtggtggttcacacccgtaaccccattttgggaggctgacaggggttgatggcttgagcccaggagttcaagaccagcctgggcaacatggtgaaaccctgtttctatgaaaaatacaaaaattacctcggtgtggtggcatgtgcctgtagtctcagctattcaggaggttgaggtgggaggaccatttgagtggagattgcagtgggctgagatcgcgccactgcactccagcctgggcgacagggcgagactctgtctcaaacaaacaaacaaaatgagaaaactagaatgtccaagagacatgaaaaattgctcaacttcagtagtaaatgcaaattataatcacaaagagatagcattacacagccaccagattgggaaaaattaaaaaggctgacaagtgttgataaggatgtgaaacaataatggagtttcttgtgggaatgagactagtataattacttagaaaaaaacatttgacctcatttaataaagttgaacatatgcatatcctatgacctagcaattccattcctaggtatatattctaacacttatatacaagtgtactagaattgcatggcaatgatgttttttaacagagttgtttaaaatagctgagattaaaaaaataaaataaaataaaataaaataaaataaaataaaatagctgagatgtggaaaaaaccaaaatgtccacatgaataaaatgtaggagtgacagtccagaggtatgggctcaccagaaaactaagaccaaatcacagaactacagaacgcttctcttccctgacactttaccacaatacattagtaaaggcctacttacagcagctccttttggttgttgttgttgctgttgtttaagtagagacagggtctcactatgttgcccaggcaggtttctaattcctgggctcaagccatccacctgctctggactcccaaagtgctgcgattacaggcattatgagccaccacaccaggccttatagcagttccttttacatagtatatcacatttggctatcaagataaaattatgaggcatactaaaaggccaaaaacatagactgaagagacagcaagtatcagaaacagacttagatatggaggtatgttgaaattatcagaccaggaatttaaaacagctgtgattaatatgctaggggctccactggataaagtagacagcacacaagaatagacggacaatataagtagaaagatggaaattcctagaaagaaccaaaaagtaatgctagagatcaaaaacacagttaacagaaataaagaatgcctttgatgggcttagtggtagaccggtcatggctgaggaaagaatctctgagagccaagaaacagatctgcatagatacagtaaactgatctttgacaaaggagcaaaggcagtaggatggaagcaaaatagtcttttcaacaaatgatgctggcccaactggacatccaaatgcaaaagcagaacctggacagagactttacacacttcacaaaaaatatgtcaaaacggaccagataccttagtgtaaatgcaaaactataaaactcctagaaggttacacaggggaaaatacagacaaccttgggcttggcaataactttttggacacactatcaaaagcatgatccatgaaagaaataactgataagtgaggcttcacaaaaatcaaaattttctgttctgtgaaagataccatcaagagaatgaaaaaataagccacagattaagagaaaatattggcaaaatataaatctgtacaacaccaagaatgaaccctaatgtaaaatgcgcactttgggtcacaatgatgtgttaatgtaggttcaccaactgtaacaaatataccactatgttacagggtgtttatagtggggggggctatagatgtgcggggggcaggtggtatacagaaaatctctgtaacttttgctcactgttgctgtgaactaaaaactgttttaaaaaataaagtctattaaaaagaaaaagaatataaggcttcaaaaattaaaagacaagtggagaaggatgaacttgtgaagatggagatgaaatggccagagagacagaaggatatgctagaaatgtttcattatggaagccaaggaaagagagtacttgaaaaagaaggccgggtgcagtggctcacgcctgtaatcccagcactttgggaggccgaggcgggcagatcatgaggtcaagagattgagacggtcctggccaccatggtgaaaccctatctctactaaaaatacaaaaattagctgggcgtggtggcacgtgcctgtagtcccagatacttgggaggctgaggcaggagaattgcttgaacccgggaagtggagactgcagtaagccgagatcgcgccactgtactccagtctggtaacagagcaagagtccgtctcaaaaaaaaaaaaaaaaaaagaaattctagctgataaactgcttcctctaactttaaaacaaggaaaagatggacttacccatgaagagataacattaataatttgtacagtttacatagtttcaaagttgctactgtaattttttttgcttttctttcagaaaaaaaattaaagaccagacttaaggttcctgtgagaaaaaaggaaactgaattataaatctgtcatatttagaaaggttagtaggttgaccaaataaataaaatgtataaaaaaccattctgtacattagaaaaagcttcatatatataaaaaatgtcataagaaaccaaataggctgggcacggtggctcattcctgtaatcccagcactttgggaggccaaggtgggtggatcacctaaggtccaagagttcgagaccagcctgaccaatatggtgaaaccccatgtctactaaaaatacaaaaattagccaggtgtggtggtgtgcacctgtaaccccagctactctggaagctgagacaggagaatcgcttgaacctgggaggcggaggttgcagtgagccaagattgcaccactgtactccagcccaagtgacagagtgagattctgtctccaaaaacagacaaacaaaaaaaccaaatagtaatttttagcattttaaatctatgagctatcataatgttgcctttataatactagcaaagataaactaatcaaatacttatataatcaactatcacaaataactagggataattttctttatgacttatatcataaaaagatgataatagaagatcagagaaaagcttagctagctctcagtttcaagaaaaatatcctgaaatgttattgtcaatggtcaaaatcaaacactggcagaaaaattttaaattttaagaatgtaattgttcctgctgagcattattaatgaaaatgtttttgaaattcaaaatccagttgcacacaatgaatgaaatatatttatatctatatttcacatatttccctgtgcttcaatacatttttttcacactcggtgaaatgtgaagtgttacaggtggtcaggatagtaacatgaaagcggccttggaaatactaagaaacaatgtgcaagtcctgaacttacatctttttctttcttttccttttttttcttttttttgagacagggtcttgctctgttgcccaggctggagtgcagtggtgcagtcatggctcactgcaaccttgaactactgggctcaagtgatcctcctgctcagcctcctgagtagctgagattacacacatctggctaatttttaaattttttgtagggatggggtctcactacgttgtttaggctggtcttgaaattctggcctcaagtgatcctcttgcctcagcctcccaagtgctaagagtacaggagcaaattaccatgcctgaccctgaacttgtttcttaatgacaacataaaattggatactagtcagaagatcaacagcctcttgtttggcttgggccttctgtaacccccacccttatcaaccaaatggattatacttagacatttaatttaacctctgtaccatttaagattacacatgtgttcttttttttattttcatttaaaaaaaactcacaaacttccatttcaatatgaaagatctaggaaatacatgtaagtgaaaagaaagcaaaatatcttgtgataaatcctgccatctttgaatatcaatgtaacactttggtgtcaatacttcattttcttcctaattgcagatcatatatttatttatataatttatcttttataaagtcactttattcttgaactgatttccttccttggcctctgtgaccttcttttgtctcaggtcccattacaagtttttttgtttttgtttttgttttgagacagaatctccctctgtcacccaggctgaagtgcagtgacacggtcttggctccctgcaacctccgcctcccgagttcaagcaattctcctgcctcagcctccctagtagctgggattacaggcacacaccaccaggcccagctaatttttatatttttaccagagatggggtttcaccatgttgcccaggctggtcttgaactcctgagctcaagtgatccacccgcctcggcctcccaaagtgctgggattacaggcatgagccactgcgcccagccacaagtttttattattctatcttcccttcttaatattagtattcctcacttttttttttcatcttcagatctcttcttatggtacgtgccttcctgaggttagcgcgaccatttttgtaatataaagcaccactggaatctgtatcgccagcctagaccaccctcctcagctccatctgaccggacacctccaatttgatgtctttaaaaaccccaaacttgatatatcctgaactcaattatctgtacccaggcctccgacactcacccttaagcatgatcctcttccacactattttggtaaacaggaccagcatttattcagtcgcctagccaaaaacctttccatcacatcataccctacgattccatcacatatgaacttgatgcctgcaaagtgaccttctttctatctatccacccaacaatatgtttagttgaaataggcgcatctagggaccacgaattaagcagttatatgatcattgccctcttgaagcttaatcaagtactgttatttctatcttcgccacatttgtcatcggctccctcttactaacttactacctttggactctcaccatggctataacctttactcctatccatttttgagcctttgggggagctctgtagtacaaatcagattgcttctctgttttcccccccatcctcctatttttagctttcccatgtctactaagtctacttgtccattttctttttatttcttttttttgagacagggtctcactttatgatccaggctggagtgcagtggcacaatcatggctcactgcagccttgaacctcccaggctgaagccatcctcccacctcagcttcctgagtagctggaactacaggtgcacgccaccatgcctggctaatttttgtatttttgtattttatttatttttttgcagagacaaggttttgccatgttgcacagactggtctcaattcctgggctcatatgatccacacatcttggccttccaaagtgctgagattacatttatgagccactacgcctggcccctttgccttctgtcttctaaaatgttgtagctaatatctcttaatctattttcttttccttgtggatttacgtctttttttttttgagacggagtctcactctgtcacccaggctggagtgcagtggcgtgatctcggctcgctgcaagctctgcctcctgagttcacgccattctcctgcctcagcctcctgagtagctgggactacaggcgcctgccaccacgcccggctaattttttctatttttttttagtagagacgcggtttcaccgtgttagccaggatggtcttgatctcctgactttgtgatccgctcgccttggcctcccaaagtgctgggattacaggtgtgagccactgcatctggctttttttattttttaatcctctactatccaacttttaggaaaagagcagaagtaaatgtatggaggtaaattaccaggatcccagaattaggtcattcttcagttcgtaattcctagacatttctttataccactattgttagaatattttaatctcttttccctcacattctctagctgattttccatcaagatttgaaatagcctctcctttcttcttcttcttcttcttttttttttttgagatagagttttgctcttgttgcccaggctggagtgcaatggcaccatcttggcttgtagtaggacgagccacagacaaaactcctcagactccgagttaaagaaggaaggggtttattcggctgggggcatcggcaagactcctgtctcaaaagccgagctccccgagtgagcaatttctgtcccttttaagggctcacaactctaagggggtgtgcgtgagagggtcgtgatcgattgagcaagcagggggtacgtgactgggggctgcatgcaccggtaattaggtcgtaacaaaacaggatagggattttcacagtgcttttctatacaatgtctggaatctatagataacataaccaattaggtcaggggtccatctttaactaccaggtccagggtgtggccccgggctgtctgcttgtggatttcatttctgccttttagtttttactttttctttctttggaggcagaaattgggcataagacaatatgaggggtggtctcctcccttaggctcactacaacctccacctcccaggttcaagtaattctcctgcctcagcctctcaagaagctgagattacaggcatgtgccaccatgcccggctaattttgtatttttagtagagacaggggtttctccatgttggtcaggctggtctggaactcctgacctcaggtgatccgcctgcctgggcctcctaaagtgctgggattacaggtgtgagccaccatgcccggcctcttcttttttaaaaaaaacttacttatttcttatcttatatatacctctagtccaaagaaatagaaataagactcagtaagttgccaggtatactgggagagtacagcaactacatataactcataaggctcaaaactgcaaatactatatgtgtgtgtgtgtgtgtgtgtgtatatatatatatatacacacacatatatgtatatcatatatgtatatttatttacttatttttggcatggaaaaacaggcagaattgggaagggggaagaatttactctaagttgtataactgagctttggcagggagatagggaggcaagagtcaggccaagttcctgatacagagaagctaccagctttgtgtgtagtttatgagacctgatctagatattctaggcaccagtgcaagaagtatatactattaattaccacacatatggattagcatatgcctacataaaacctagtctgtctttcagaacatatacttaaaggaattttataattaggttgcagatcattagactctctgcttattgagttataaagtatcttctttcacatgtgagaagagacattaatctaaaatttctttatgattttatctaagatttcagtgctgtgtggaaaaagtagcccttcaaagtactggttttaaaatactagctgcagaaggaggccaatttcccgaaacaaaagtgagtggatattaaattgcaatgtggacaccatgccctgtaccgttatttcagaatgtccaggcacgaggacagtgataccctagtcagggaagcatgacatggagagagaccacgtctttctaatgccctggtgttctgtcagggttccacaacctacccttaagggttcctcctacccttaattttcccattcattgcatactttgccctacttctttctttctcttttccagtttacttctcttcccttctcagcctactgcctatagtaatagttttcaaaatgtggtccctggatgatatgcatcagtatgacctgaaaacttcttttttttttttttttttttttggagctggagttttgctcttgttgcccaggctggagtacaatggcttgatctcagctcactgcaacttccacctctcgggttcaagcgattctcctgcctcagcctcccaagtagatgggattacaggcatacgccaccatgcccggctaattttgtattttcagtagagatggggtttctccatgttggtcaggttggtctcctactcccgacctcaggttatccgcccgcctgggcctcccaaagtgctgggattacgggcttcagccaccgcgtccagccagaacttgttaaatatacaaattcctgggctccatcctagtttctacttaatcagaaactctgggtgtggccacagcgacctgtgttttaacatgctgtctagttattctaatgctcgctaaactttgagaatcactgccttatagtgtactaaaattatcctttctgatatggccttgaaacattctaaaaaactagaattatacctgattttggatacaagcaatgtgtgaaattctttgcatgattaaaattactctatttgcttaaagtaaattgtcgccacatttttaagattaaaatctaagtgttttaaggaaatatgcttgtgttacttacttcatacttatgtctttatttcttcaccagtaagtatgagcccagtgcatacaaagtaaaaacttgcatacagtctcttacaattggagttattctgtcttcaaagggcttacaagctattgcaactaacagataagcaggcttacctatagctaatataaatccatgtgtttaacttgccacaacagaagaaaaagatgttatgggattatagaagagggagtgattccaatagcaatcagaaaagccttcacgggctgggcatggtagttcatgtctgtaatcctagtactttaggaggccaaggtgggaggactgcttgagcccaggcgttttaagaccagcctgggcaacatagtgggactccgattgtacaaaaaacttaaaaattaactggcatggtggtgcgcacctgcagtcctagctactcaggaggctgaggtgggaggactggttgagcccaggagatggaggctgcatgcagtgagccacgatcatgacacggtactccagcctgggaaacagagcaagactctgtctcaaaaaaagaaaaaggaaaaaaagaaaaaagaaaaaaatcagcatccacgagtgaggcatattttagctggactggaagatgaatagtctatttggactcatttttctttcacattttcctctaatttttttctcttatatgccagtacttaatggctgttattttgcacatagtttaaactatgactataatttaaataagacttttacacatatctgcaataaaaatggggtctactgcttttcatttttaagcattatgttttgcctaaatagaagtttacaaaattaaactagtttatcattatttatgtgaattcaaaacttttttttatttcacacaaatttaaagaaatgttattatggttatagaccaaacaccattatcatttaaagaccatctgtagtgtactgaaaaaagcacaggacctgctttgaaacatacccttgtaactgagcacccccatttttctgagacagagagaatgagctcgtttttttctcttttctctatttccccctctttccacttcttacttagccctttagaaatgcaattataaccttttacctccctgttaccagatactccctacagagcaagttcatttaactatgtgcttagaagctccagagtggaacttgcacccaccaggaggttgcctcgagagacaacagtcaatctacaacccaaagtatgcccactaggaaactttctcctacctggagagtttcagctacctttataacctagttctgcctacaaaggcacagtgctcgccagcttgaatgctgggcagacagagtactgaagcaagtcatgtggatcccctcctctttcttcctccctcgcatgccattcctgccaaactcccttttaaaagcactcacttcctgctccaaaagtgaagcggtacccttaaggcaggaagcctgtacttcttccccaaactagctttggaataaaaaatcattttctttatactagatctctcccttgttaattggactctgcaagtgacgagcaactaaacctgcattttggttacaccctagttaaaaacaacaacaacaacaacaacaacaaaacagacaaggcgtgctgagttctacaatggagagactaagcaatttaaatccagtggcagaatttttggctacagtgagacaaactttagggacaaatgatactctacaaaaatgtggttagaatggtttcagtctaaatgtaattcttagaaacatcacggccactgtttactacatttgtgaaattttgaatctgtcaagagttgtttgagtaagcaaccttaaagaatgaaaagctatttacaatgggacatattttcttgactctaaaacaaaaaatggttgtagatcttcaccattttctaggcaggctcctcctggcacatggagatcatgctgtgaattgcaggaggaagggtttagcagtaaactttggaatgtaaccccttattggcaaagtatctgtacctaattgattttctttacccttttaaaaaaagaatctctagttcccggccccaaatggccacctaaacttcaatcaaatattgcaataaaatccaaactaagaggatttcactgaagtataaagtgtgaggcagaaaattagagaccagatttattagcttgggttgaatttcatgctagttccattaattaaaaagcaatttttgctaaatctctgtaagggctttgatgctctcaactgttctcacttacatccaccactacttcaggggcttctatcatcaggatcaaaggaaaatgagtggtggaaaaggaaagcaagactagtgtcttaagctagagtttgagcatgggattctagagcaatgatgtctgactgaaatacagatggtcctagacttatgatggtttgacttacaattttttgagtttaagatgatgtgaaagtgatatgcattcggtagggactatacctcgagtacccacacaatcattctattttccacttttagtatagtattcaataaattacatgagatatttgacactttattataaaataggctttgtattagatgattctgcccaactgtaggctaacgtaagtgttctgagcatgtttaaagtatgctaggctaagctatgttgttcagtaggctaggtgtattgaaagcattttcttatttatttatttatttatttttgagacagagtctcgctctgttgcccaggcttgagtgcaatggcgtgatctccgctcacggcaacctctgcctcctgggttcaagcaattctcctgcctcagcttcccgagtagctgggattacaggcatgcaccaccccgccccgctaatttttgtatttttagtagagacgaggtttcacgatgctggccaagctggtctcaaactcctgacctcaggcgatccacccccctcagcctcccaaagtgctgggattacaggcgtgagccaccacgcccagtcgcattttcttatttttatttatttattgattgattgagacaggctcttgctctgtcactcatgctggaatgaagtggcatgatcacagctcactgcagcctccaccttccaggctcaggcaatcctcccacctcagcctcctaagtagctgggaccacaggtgtacaccatcatgtccagctattttttttatgttttgcagagatgaggtctcactatgttgcccaggctggtcttgaactcctgggctcaagcagttctccctcctcagcctctcaaagtgttggaattacaggcgtgagccaccgcacctggcctaactgcactttcaacttaggatatttttaacttacaaagagtttatcaggaatgtaaccccattttaagtcaagcaggatctgtatgatgtgagctatatgtgtaatttaatattttctggtagcctaatttaaaatagtaaaaggaaacaggtaaaattaaatatattttatctaaccaaacacatctaaaatatgatagttcaacctaaaattaatgtaaaagtcactaatgatatatatatatatatatttttagatggagttttgctcttggagtgcaatggtgcgtgatcttggctcactgcaacctccacctcccggcttcaagcgattttcctgcctcagcctcccaagtagctgggattacaggcatgcgccaccacgcccgactaattttgaatttttaatagagacagagtttctccatgttggtcaggctggtctcaaactccaacctcaggtgatccgcccacctgggcctcccaaagcgctgggattataggcgtgagccaccgtgcccgtccactaatgagatattttatattcctttactggactaagtcctcaaaagccaatgtatatgtcacactaacagcacatcttggtttgaattagacacatttcacctagtcgaatctagttccacatgtgtcacataaagattttggactacattagactacaatacccttaaaatataggtcttatagtcctaaagttatagaaagtgtgattttctatctcttttcttcccacaattgccctttccttaggcttttggctgctatttttagaatactgtttagaaaattatggcaggggacatcaaatcagggtactgaacttgttatagggcaactgaaaaatgtcagtctccccaggctaaaaaataaggtttggaaccaacgtgataacgttttccatgaaattagttatagataaaagagagaacagtttgaacttcaaagggtatcaaagtcagacagcctcaaagactgatatgtggatctttcccctttgattttgttatgaaactgggctgtctccattgcagactatctgtaatctggcttaagttgtacttataaaagtgttttagtctccttgtttttttcccttttcacattgaactttggtcatttctacactgcataagtagaaaaatatttcgggtagactgtatttgattttcctgtagctgttagaaacttgcaaacctttttgtcactggtgagaattcaaaattgaagtttagccttaagaataaaaaaaattgtctttttttttttccttttaacaaactaccattggaaagactgaaaatcttaagtagggaaaaagcaaaaggatggcccctacttaaaatttcataatgctataccaatcaaaattcttatattagaacacacattcttttcaagtgcataaggaatagctgccaatatagaccatatactggaccataaaacatctcccaatgaatttaaaagcatgttatctgaacatgatagaagttagaaagcattaagagaaaaacctctgaaagatccacgcaaagagtataatataaactacataacataattctaaataacctaagcgttcaaagaagaaatcaaaagggaaatgagaaagtatttaaaaatgaataaaaatgaagacatattatataaaaatttgttggctgctaataaggcggtatttagtgagaaatttctagcactaaatacctgtgttagaaaagaagaaaggtttcaaatcaatcacattagcatctaccttaagaaaatggacaaagagctaattaaatataaagtaagtagaagaaaggaaataaaatgtcgtgtagaaatcaataatagacaacataaaaacaacagagagaaaatcaatgaaacccgaaactggttctctgagaaatttaataaaatgtataactctctagcttgactgaacaggataaaaaggggagacaacacatttttgccatgaggaatgagagagatgacattattctagattctatagatattaaaaagataataaagaactaggattaacatgttatatctatatattggacaattttgacaaaatgaacaaattccttttaagataccaattgctaaatacctcttacaaaataaataacccaaatacattacatctacaaaataattgaacttgaagttaaaaaccttctcataaagaaagatctaggcctggatatctttatttatgaattccaccaaatatttaaggaagcaataataccaattctagacaaactctactggaaaattgagccggagtatgcacttcccaactgattttatgaggccagcaataccctgctaccaaaaccagacacagaaattagcaaatcaaatccgacaagttaaaccggatgcagtactatgtgcctatagttccagctatttgggaggctgaagcaagaggatcactggagtcagtctgggcaagatagcaagtcctctgtctctaataaaataaaaaattaaataaaaaaataaaaaatacatcatgatcaactagaatggaaagctggtttcacattagcaaatcaaccaatgtaattcaccctgttaaaaaactgaagagaaaaactatctgatcaccttaaaagatacggaaaaaaaatctgacaaaataccacatcaattatttgattcctcagtatcctaggaatcaaaggacactttcataaacagataagagagtatctacaaaaaaaccctacagctaatgtctgcacttaaatctatactatttttcacaaaagtgcaaagccaattcagtgagtaaacaaatgatgcaacaacaactctatatctgtttgtaaaagaaatgaacttggtcccataccttataccaaattaaaaagataaactagaaacagctgagatctaaatatgaaacctaaacatttagcatttttaaagaaaatgagagaaaatttttgtcactttgggtttagagaagacttcttagatatgataccaagtgcatatctattcatgaataaaaaattgataaactggactttatcaaaataaaaagcttctgatctttaaaagacactgttcagagaataaaaatataagacaatatctgaaaataactgaaaatcatatatttgagaaggacttgtattcagaatataaaaatttttccaaactcggtaataagaaaacaaacaacccaatttaaaaagggcaaaatatttgaacatacatcaacaaagatatatagatggtaaataagtataaatcaagatgtccaatatcatcagtcattaggaaagtgcaaattaaaaccacatgagatacaaccacacacctattaggatggcttcaaatggaaagactgactacaggaagtgttggagaggatgtggaaatactggaactctcatatactcatggtgggaatgtaaaatgatagagctgcttgaaacacagcttggacatttcttaaaaagttaaaagtacacatactatagggtccagccaatacactcctgttattttaaactagataaatgaatgcattatgtccatcaaagacttatgcatgaatgttgagagcagttttacttgtaccaggccccagctggaaatgaatcaaatattcattaacatgtgaatggataagcaaaagtaactgaggtatttgcattgttggaatctgccgtttgatactggaatacgttcttaaataaatgtggttatgttttatacatcattttaatgggcatttctcactttatttttcttttgttaatgacttattacttgctgttcatttcatgttttagactatgaaaatgatgttagataaaaattaaattcaagcaattttcttgttcgagttcaaaacgggtcataaagcagcagagataacttgcaacatcaacaatgcatttggcccaggaactgctaatgaacatacagtgcagtgcttgttcaagaagttttgcaaaggagaagaggaagatgaggagtgtagtgaccagccattagaagttgacaacaaccaagtgggagcaatcatcaaagctcatccttttacaactacacgagaaggtgccgaagagctcaccattgaccattctatggtcatttggcatttgaagcaaactggaaaggtgaaaaagctcgataagtggatgcctcatgagctgaaccaaaaaaaacaaaaaacaaaaaaaaaaaaaccatcgttttgaagtgtcatcttctcttactctatgcaacaaggaaacatttctcaattggattgtgatgtgccacaaaaagtggattttatatgacaaccagtgacaaccagctcaggggtaggaccaagaagcagctccaaagcgcttcccaaagccaaacttgcaaccaaaaaaggtcatggtcactgtttggtggtctgctgccagtctgatccactacagctttctgaatcctggcgaaaccattacatctcagaagtatagttggcaaatcgatgagataaaccgaaaactgcaaggcctgcagctggcattggtcaacagaaagggcccaattcttctccatgacaatgcatgtcacacaaccaatgcttcaaaagttgaacaaattgggctacaaagtgctgcctcatccaccgtatgcacccaacccctggtcaactgactaccacttcaagcatctcaacaactttttgcagggaaaatgcttccacaaccagcaggatgcagaaaatgctttccaagagttcgttgaatcttgaagcacagacatttatgctacaggaataaagaaacttattattaactggcaaaaatgtgttgattgtaacggttcctattctgattaataaagatgtgttttcattgttcagctcccatggacacaggtaggggaacaatacttactggggcctgttgggggatggtgggggtgggagagcattacggaaaagagctgatgcatgctgggcttaatacctaggtgatgggttgacaggtgcagcaaacaaccatggcacacgtttacctatgtaacaaacctgcacatcctggacatgtacctcagaaattaatataaagaattttaaaaaaagtacaaacaggtgaaaaaaaatgtgtttgagcctagttataatgatttaaaattcatggtccaaaactgcatttacttttttaccaacctaatatttatacaatatataacagtactattcaccattaaaaaggaatgatctattgatgcatactacatacatcaaaataatgatgctgagtaaaagaagccagaccaaaaaaattacatatttgattccattcacataaaatgtagaaaatgcaacctaatctatagtggcagagaaaagatcagcagtcacctgggaatgggtatagaggcagggtgttgagaagaggggagagtatcctttgtatcccttttcttgtacaaaagagtacaagaaacttttggggataataaattggttcattattttgattgttgtgatagtttcaaaggtgtctatacatgttaaaaagttattaacttggggagatccgtttcaagatggctgaacaggaacagctctggtctgcagctcccagcgtgatcgatgcagaagacgggtgatttctgcatttccaagtgaggtacctgtttcatctcattgggactggttggacagtgggtgcagcccacggagggtgagccgaagcagcgtggggtgtcacctcacctgcgaagagcaagagattgggggatttccctttcccagcaaagggaagccatgacagactgcacctggaaaaacgggacactcccacccaaatactgcacttttaccaaggtcttagcaactggcagacaagaagattctctcccatgccaggcttggctggtcccatgtccacagagccttgctcactgcaagctagcacagcagtctgagattgaactttgaggtggcagcctggctgggggaggggcatctgccattgctgcagcttgcgtaggtaaacaaagaaaccaggaagctcgaactgggcggagcccactgcagctcagcaaggcctactgcctctatggactccacctctgtgggcagggcatagctgaacaaaacgcagcagacagcttctgcagacttagaagtccctgtctgacagctctgaagagagcagtggttcttccagaatggcggctgagctctgagaatggacagactgcctcctcaagtgggtccctgacccctgtgtagtctaactgggagacacctcccagtagggatcgacagacacctgatatagatgggtgcccctctgggacgaagctttcagaggaaggatcaggcagcagtatttgctgttctgcaatatttgctgttctgcagcctccactggtgatactcaggcaaacagggtctggagtggacctccagcaaactccaacacacctgcagctgagggacctgactgttaaaaggaaaactaaacaacagaaaggaatagcaccaacatcaacaaaaaggacatctacaccaaaaccccatctgtagttcaccaacatcaaagacaaaaggtagataaaaccacaaagatggggagaaaccagagcagaaaagctgaaaattctaaaaaccagagcacctcttctcctccaaaggatcgcagctcctccccagcaatggaacaaagctggatggagaatgactttgatgagttgacagaagtaggcttcagaaggtcagtaataacaaacttctccaagctaaaggagcatgttcaaacccatcgcaaggaagctaaaaacttgaaaaaaggttagacgaatggctaactagaacaaacagtatagagaaaaccttaaatgacctgatggagctgaaaaccatggcacgagaacttcgtgacgcatgcacaagcttcaatacccaattcgatcaactggaagaaagggtatcagtgattgaagatcacattaatgaaataaagtgagaagacaaggttagagaaaaaagagtaaaaagcaacaaacgaagcctccaagaaatacgggactaggtgaaaagaccaaatctacatttgataggtgtacctgaaagtgatggggaaaatggaaccaagttggaaaacactcttcaggatatcatccaggagaacttccccaacctagcaaggcaggccaacattcaaattcaggaaatacagagaacaccacaaagatactcctcgagaagagcaaccccaagacacagaattgtcagattcatcaaggttgaaatgaaggaaaaaatgttacgggcagccagagagaaaggtcaggttacccacaaagggaagcccatcagactaacagtggatctctcggcagaaaccctacaagccggaagagagagggggccaatattcatccttcttaaagaaaataattttcaacccagaatttcatatccagccaaactaagcttcataaatgaaggagaaataaaatcctttacagacaagcaaatgctgagagattttgtcaccaccaggcctgccttacaagagctcctgaaggaagcataaacatggaaaggaacaaccagtaccagccactgcaaaaacatgtcaaattgtaaagaccatcaatgttacaaagaaactgcatcaattaatgggcaaaataaccagctagcatcataatgataggatcaaattcacacataacaatattaaccttaaatttaaatgggctaaatgccccaattaaaagatacagactggcaaattgaataaagagtcaagacccatcggtgtgctctattcaggagacccatctcacatgaagagacacacataggctcaaaataaagggatggagggagatctaccaagcaaacgaaaagcaaaaaaaaaaaaaaaaaaaaaaaaaaaaaacaggtgttgcaatcctcaatcctagtctctgataaaacagactttaaaccaacaaagatcaaaagagacaaagaaggccattacataatggtaaacagatcaattcaacaagaagagctaactatcctaaatatagatgcacccaatacaggagcacccagattcataaagcaagtcctgagagacctacaaagagacttagactcctacacaataataatgggagacttcaacaccccactgtctatattacacagatcaacgagacagaaggttaacaaggatatccaggacttgaactcagctctggaccaagtggacctaatggacatctacagaactctccaccccaaatcaacagaatatacattcttctcagcaccacatcacacttattccaaaattgaccacataattggaagtaaagcatgcctcagcaaatgtaaaagaacagaaatcacaacaaactgtgtctcagaccacagtgcaatcaaattagaactcaagattaagaaactcactcaaaaccgctcaactacatggaaactgaacaaagtgctcctgaatgactactgggtacataacgaaatgaaggcagaaataaagatgttttttgaaactaatgagaccaaagacacaacgtatcagaatctctggggcgcatttaaagcagtgtgtagagggaaatttacagcactaaatgcccacaagagaaagcagggaagatccaaaatcagcatcctaacatcacaatcaaaagaactaaagaagcaagagcaaacaaattcaaaagctagcagaaggcaagaaataactaagatcagagcagaactgaaagagatagagacacaaaaaacctttcaaaaaaatcaatgaatccaggggctggttttttgaaaagatcaacaaaattgatagactgctagcaagactaataaagaagaaaagagagaagaatcaaacagatgcaataaaaaaatgctactcgggaggctgaggtaggagaatggcatgaacctgggaggcggagcttgcagtgagctgagattgtgccatggcactctagcctgggtgacagagcgagactgtctcaaaaataaataaataaaaataaaacataaaaaatgataaaggggatatcaccaccgatcccacagaaatacaaactaccatcagagaatactataaacacctctgctcaaataaactagaaaatctagaagaaatggataaattcctggacacatacaccctcccaagactaaacctggaagaagttgaatctctgaatagaccagtaacaggctctgaaattgaggcaataatagcctaccaacaacaaaaaaagtccagaagcagacggattcacaaccgaattctaccagaggtacaaagaggagctggtaccattccttctgaaactcttccaatcaatagaaaaagagggaatcctccctaactcattttatgaggccaacatcatcctgataccaaagcctggcaaagacacaacagaaaaagagaattttagatcaatatccctgatgaacatcaatgtgaaaatcctcaataaaataatggcaaaccgaatccagcagcacatcaaaaagcttatccaccacgatcaagtcggcttcatccctggggtgcaaggctggttcaacatacgcaaatcaataaatgtaatctatcacataaacagaaccaacaacaaaaagacatgattatctcaacagatgcagaaaaggcctttgacaaaattcaacagcccttcatgctaaaaactctcgataaacaaggtattgacggaacgtacctcaaaataataagagctatttatgacaaacccacagccaatatcatactgaatgggcaaaaactggaagcattccctttgaaaactggcacaagacaaggatgccctttctcacaactgctattcaacttaatgttggaagttctcaccagggcagtcagggaagagaaagaaataaaaggtattaaattaggaaaagaggaagtgaaattgtccctgtttgcagatgacatgattgtatatttagaaaaccccatcgtctcagcccaaaatctccttaagctgataagcagcttcagcagtgtctcaggatacaaaatcgatgcgcaaaaatcacaagcattcttacaccaataacagacaaacggagagccaaatcatgagtgaactcccattcacaattgctactaagagaataaaatacctaggaatccaacttacaagggatgtgaaggacctcttcaagaggaactagaaaccattgctcaacgaaataaaagaggacacaaagaaatggaagaacattccatgctcatggataggaagaaccaataccgtgaaaatggccatactgcccaaggtaatttatatattcaatgccatccccatcaagctaccaataactttcttcacagaatttgaaaaaaactactttaaagttcatatggaaccaaaaaaggagcccacattgccaagataattctaaacaaaaagaagaaagctggaggcatcatggtacctgacttcaaactatactacaaggctacagtaaccaaaacagcatggtactggtatcaaaacagatatatagaccaatggaacagaacagaggcctcagaaatatcaccacacatctacaaccatctgatctttgacaaacctgacaaaaacaacagatggggaaaggattccctatttaataaatggtgctgggaaaactgactagccatatgtagaaagctgaaactggatcacttccttacaccttatatagaaattaattcaagatggattaaagacttaaatgttagacctaaaaccataaaaaccctagaagaaaacctaggcaataccattcaggacacaggcattggtaaggacttcatgactaaaacaccaaaagcaatggcaacaaaaccaaaatagacaaatgggatctaattaaactaaagagctactgcacagcaaaagaaactaccatcagagtgaataggcaatctacagaatgggagaaaaattttgcaatctacccatctgacaaagggctaatatccagaatctacaaagaactcaaacaaatttacaagaaaaaaacaactccatcaaaaagtgggtgaagtatatcaacagacacttctcaaaagaagacgtttatgcagccaacagacttatgaaagaatgctcatcatcattggtcatcagagaaacgcaaatcaaaaccacaatgagataccatctcacaccagttagaatggtgatctttaaaaagtcaggaaacaacagatgctggagcggatgtggagaaataggaatgcttttacactgttggtgggactgtaaatgagttcaaccattgtggaagacagggtggcaattcctcaaggatctagaactggaaatagcatttcacccagcaatcccattactgggtatatacccaaaggattataaatcatgctactataaagacacatgcacatgtatgtttattgcagcactattcacaatagcaaagacttggaaccaacccaaatgtccatcaatgatagactggattaagaaaatgtggcacatatacaccatggaatactatgcagccataaaaaaggatgagttcatgtcctatgcagggatatggatgaggctggaaaccatcttctcagcaaactatcacaaagacagaaaaccaaacactgcatgttctcactcataggtgggaattgaacaatgagaacatttggacacagggcagggaacatcacacactggggcctgtcaggggtgggggtctggggtagggatagcattaggagaaatacctaatgtaaatgacaagttcatagttgcagcaaaccaacatggcacatgagagcaagaactcctttactcccttgaggattaactcagttaagaaagagtggcattaatcactgtcaatgacctaatcatctcttaaaggtcccacctcccaacaccaacacatcaggggccaaatttctaacacatgaattctgaggaacatactcaaagtataggaagggccaacatctgaatagtataaatcccagaagagcaaaatgagaaaaagaaggaagattaaagaaaattgcccagaatttaaggacaaaagcttccagattaaaagggtttgacacatattcagcacaatatatgcaaataccccaatgacatcagcggacatcactataacatttctgaagactggggtcaaagggaagatcctacaagcttccacagagaaaagataaagttttgtgggaagcataaaggaatgcaatcatggatcaatgaaaaaaatttatcaatttcatctattaaatcaggacactaaggaagagaaaaacattataataagtgctgaaaagcaattgaaaaatatttatcagccaatacaaataacaagcaaaatgggaacagaagaaaactagttcaagataataaaaattatttactaaagccaaataaaaaataattatcctaaataacaaaacactaaccatttttattaggattaagacagtgataatttttatcagatttttatttaacattgtcttggaggttctggagaatacaatatgacaagaagatgaaataaataaattgtataaaaacgggcaaaaaagatataaaactttcttttgaattggtattattgcatgtctagaaaacccaagaaactaataaaaaactgaaattaataagagaattcggtaaaatggataggtattaaataagtatgtaaaagcaatagttttgatttattatagcaaaaaagcaactgaaaatggaaacagaaaaatacttcactcacaatatcagtataaactataacatgctaaagaatacatctaataaaccaaaaaacttgtaagaaaaccttaaaagctactgaaaggcacacaaaaaattgaaaactggatgttattagatgggaagacttataagaaaatattaaattttcagggtcgggcacggtagctcacacttgtaatcccagcactttgggggccaaggcgggcggatcacgcggtcaggagatcgagaccatcctggttaacacagtgaaaccccgtctccactaaaaatacaaaaaattagccgggcgtggtggcgggcgcctctagtcccagctactcaagaggctgtggcaggagaatggtgagaacccggcaggtggagcttgcagtgagctgagatccagccactgcactccagcctgggcgacacagcgagactccgtctcagaaaaaaaaaagaaaaaaaaaagataatattaaatttccaaaattaacatataaatggaatgcaattccaaatggtttgcactctcaattccagtggatttttttttcggggaactgaacagtattgtcttaatgtttatattaaataatcaatgcccaggaatggcttaaaaagtacaaaaaaaaaaaatcaatgtaggataatttgcttttggaacataatgtccttttatcaaataaatatggtattcgtttagaaataaatatccatggattagaataacaatccagaaataaatcccagtatgtataaaaatccaatacatgacaaatattatagttcaatttagtaggaaaatgacaaattatttaataaattttgccagaataactggccattctttcagaagaaaataaaactggatatttctaatatactgtatagttataaattccagctgcaataagaatcttgcaagaaaatttagacaacatatatatcttgatgaagaaaatgttctaaacagactgaaaatatagaggttattaaaaaaaaggctagccaaaatgagcaaatataattaaaagtttttctatggcaaaagttaaaacacaaagtcaacagataaataatgtatttgggaaaaaattgtaaagggcaatatctaaactaaagtgctcttacaaaatgtcaagaaaaagttaacccaaaagaaaaaaaggcaaaaagtatacataagcaagtcaaagaaaaatagaaaagccaaacaagcatgctttatttctttattttattttattttatttattttattttactttttgagacagagtctcactgtcgcctaggctggagtgcagtggtgcgatctcggctcactgcaacctctgcctccaaggttcaagcgagtctcctgcctcagccttccaagtagctgggattacaggcacctgccaccacgcccggctaatttttttctattttaagtagagacggggtttcaccaccttggccaggctggtgttgatctccggaccttgtgatccgcccaccttagcctcccaaagtgctggtattacaggcgtgagccactgcgcccggcctaaacatgcatttaaaataatgctcaaattcaattaatactgcagggactacaaattgaagtaacaataacataagttagttgactgattcctgcatccattcactcaacaaatatttactgaaacttttcatgggtgaggccctatttcaggtgctggggatcagaagcaaaccaaacaagttctttatatgtacttttaccaccttttttgcccatataacaaacaacatttacaagagcaactgaatctgttgttggtaaggatatgggaaaggagatactctgaaaaactgctggtggagatatgaaacatagccctttggacagcaacctgccaatacttattaactacaggtatcagtaaataaagacgtatatacaaggatgtttgttgaaattttgttcaaaggggaaaaaagctggcctgcaccatgaaatattaagtaataattaaaaagaatgtctgaaagcctcgctcctaaactgtggagtaagtcatcctaggtgctatgtggaaatgtcaagagtgatgtcatatatttttaattttcaggggaaacacagcatttttgaatgtatattgacactgaatctcttgatattatatgcttgaagtaattcggtttcaacattagatcatgccacattactattaatgatattgtgtctttgcaaagctgggtattgagtggttgctgtgattaaaaagtacacactatgctaaggccgggcgcggtggctcacgcctgtaatcccagcactttggaaggctgaggcaggcggatcacgaggtcaagagatcgagaccatcctggctaacacggtgaaaccccgtctgtactaaaaatacaaaaaaaattagccgggcatggtggcgggcacctgtagtcccagctacttgggaggctgaggcaggagaatggtgtgaacctgggaggcggagcttgcagtgagccaagatcgcgccactgcactccagcctgggcaacacagcgagactctgcctcaaaaaaaaattttttttaaagtacatactatgctaaaagatagaaatggtggtggtgcagccagtctaataccaaagtctgagcagctgtgtagtacccaacaggagcacgtataccattagtaagcagttgtagttatttttaaatgaaataaaaatattactatttttgaaaaaatttaagtgtatattttttcccaaatagctattaagttgtaggaatataatacacattacttggcctgaaagatttactaaatgaagctgtcaggtatttggtttggcccagggggcaccaagaaaatattgctgagatactaaggactcattgtgaactcagaaaatttgggaacctcttaaacctgcagcccaagaagtaaaaaataatagaacaagtgaaaaacttagatgaatggaaataataaagatagaaaagaaattaattagacagaaagcaaagatacaaaggcaaagagtttatagactaataaaatggacaaaactaattttaaaaaagaaaaaagccactaatcagtagacatgttcttaggaaataattaccaaaatgaactcaagaaaagctgaaaacctgaagagactataattagaaattaaaaatattctcccaaaggctggatgtggtggctcatgcctgtaatcccagcactttgggaggccaaggtgggagagttgcttgagagttcaaaaccagcctgagcaataaagcgagaccctgtctctacaaaaaaataaaaaaataaattagctgtgcatggtggcgcatgcctgtggtcccagctacacaggagagtgaggtgggaggatcacttgagcccataagtttgaggctgcagtaagctatgattcccacccctgcgtgccagccccagcctgggcaatggagcaagaccctgtctcttcagtaaaaataaaaaaaaaaaaattatcccaaagaaaacattaggttaaggtggctttactggtgagttttaacaaactttcaaggaacacacgatttcactctaacataaagtgtttcagagaagagatacagaggaatactccctatttcattttttgacgttagtataacttagctccaataccagccaaggagtatttgagaaattataaactgatttcaatcataaaaataattgcacattaagaatgagatagagctgtacaaaaagcatttcataaaactgacacctattatgacaaaaactcttaaaccaggaatggaaatggacttaataacctgatagcaaatatctaccaaaacttctagcacagataaagcttaatgattaaactttaaaagaaaggcacttactgtcacttctatttaatgttatactataggtccttgccagaaaataagaaagaaaaaaaatatatatataacgtttagaaagtgaggtaaaaaccattcctattactggatgatatgattgccaacatagaaaacagaaaagaatatgtggcaaattactaaaattaaggaagtttgcaatattaatagataagtttactgtatttctatatattttaaaaaaagcaattagaaaatgcaattttaaaagacagcatttacagtaacaacaacaaaacagggcacctaacaataaatttaacaaaatatgtatgagaccttcatggagaaaaatcatacatgtattttttgaggcagggtctcgtactgtcacctgggctggagtgcggtggcacaatcacggctcactgcaccctcgagtgggctcaagtgattctcccatctcagcctctcatgtagctggggctacaggtgtgtgctaccatggctggctgatttttgtattttttgtgagacagggtttcgccatgttgtccaagctgggctcaagcaatcttcctgcctaggcctcccaaggtgctgggactacaggcatgagctactgtgcccagcccatacagtgttatgaaagacattaaagatctagatgtacaatactatgtttatagatacgaaaacttgcaaaatgtcaattcttcctacattaatctatggattcaatgtaatcttaatttaagttccagtagaggctctcatggaagtgaataaggttattctaaaatgatatggaaacacaaggggaaagaatacagaagacatttcttaggaagatacagcatgggggcttgccctggtagatattaaaatttattataaaactttaattaagactatgtgatgggcaacatggtaaaatcctgtctctactaaaaatacaaaaaattagccaggcatggtggcgtgcacctgtagacccagctaccagggaggttgaggtgagaggatcacctgagcccaggaggcagaggctacagtgagccatggtcacatcactgcactgaagcctgggcgacagagtaagagagtaagaccctgtctcaaaaaaaacaaagaaagaaaggaagaaaggaagaaagaaagaaaagaaaagaaagagagagagagaaagaaagaaagaaagaaagaaagaaagaaagaaagaaggaaggaacgaaggaaggaaagaaggaaaaagaaagaggaagaaagaaagaaagaaagaaagaaagaaagagaaagaaagattgtgatgctcttacataaataggcgaatgaactgaatagaaatcctgaatggagtcacatatttatagaaatctgatatataaaaaaggggttattgcaaatcagtggtgaaaagacacagtatgaaataaattcttctggggcaattggttattcatttgcaaaaaattaactggatctctacctcacacaattcacaaaaatcaatttcagatagattaaggacttaaataggaaaggtaaaataactaaacattttaagagagtatgagaatatttttatggcctcatgatagtgaaggatttcttacacaagacacaaaaagtgtcaaaacatcaaggaaatgattaacgaagttgatgacattaaaattacaaacatatttgccaaaagacatcagaaagacagagaaaagacaaccacaaactaggaagaaataccagctgcatgtataagtatcaaaggactggtattcagaacatactaaaaactcccataaatcaatgagaaaaaaaagaaacaatgcgaaagaaaaaagggcaaaagaagcaaaaggcatttccttacacagaaaacatgcaaagccaatgaacatgaaaaattgttccacttattagtcatcagggaaatgcaaatgataattacaatgatatgtccttttataatcactggactggtagaatttaagaattcagaatttttaatactaaaagttggcaaggatgtgaggcaatagaaactctcatatattgctgtcagagtataaatttgtaataccattttggaaaataatttgttataatctaacacagctgaagttgcacatactcttgactctgatttcattcctatgtatttatccaagagaagctcttgcacaagtgcatcaggagacatctattaggaatggtcattacaacactgtgtttagttacaacaccgttttcattgccagggcaatgaaatatccttcaatagcagaatgggcttaaacatcagtgaaaataaataagccgtaactacatgaagcaacatgtatgaatatcataagctgctgctcaatgaatacttattttatcagtgaataaacaggatgattccaatcacaagaaggtcaaaatcaggcaaaactaaactgaattatattttaagagtacatccttattgggtaaaactgtaggaaaaagcaaagaaatgattaaaccaaattcaggacagtggttctaaaggagaggaagagtgaaagcagttgcagtatagctctgaaggacttcaatgttcatgttctatttcttaaactgggtggtgggcacacagatatattttactattgttctttaaacataacatatattaataaatactacagatttcatttcacaggtcatacaatgactactagaaaacaataccaagttgagatgcagaatgggtagtgattagcaaggtttacacactcgtgtttgactagcaaaaacacacattactacatattatggatattttcaaatagtcaaacacatataatatcaaattttcacaaaagagtgaaatacctaggaatacagataacctgggaggtgaaaaaatctctgcagtgagaattaccaaatactgctcaaagaaatcagagatgacacaaataaatggaaaaaacagtccatgttcaaggattcgaagaatcaataccattaaaatggccatactgcccagcaatttacaggttcaatgctattcctatcaaactaccaatgttatttttcacagaattagaaaaaatgaccctagaattcatgtggtgccaggagtgggagctcatgcctgtaatcccaccattttgggaggctgatgcaggaggaatgcttgaggccaagagtttgagaccaacttgggcaacaaagtgagaccctgtctctacaaaaaataaaaaattagccaagtgtggtggcacatgcttgtggttccagttacatgggaggctgaagcaggaggatcacttgagcccaggaggttgaggatgcagtgggccatgattgcaccactgcactccagcctgagtgacagagccaagattctatctcaaaaaaataaaattcatatgggaccaaaaaaaaggccaaacatccaaagcaaacaaagccggaggcatcacactacctaacttcaaactataccacaaaactatggtaaccaaaatcaggatggcactggtacaaaaacagacacataggccaatgagacaggttagagaacccagaaataaagccacacatctacaaccatctgatcttcaataaagtcaagagtaagaagcaatgaagaaaggacttcctattcaataaacggtgctaggataactggctagccatttgcagaatattgaaactggaccccttcctttcactatatacaaaaataaactcaaaatggattggtgacttaaatgtaagacctaaaactataaaaaccctagaagaaaatctaggaaataccattctggacacaagccttggcagaagtttcatggtgaattctccaaaagcaggtgcaacaaaataaaaaatagacaagtgggatctaaataaacagctttggcacagcaaaagaaactatctaaagagtaaacagacaacctaaagaatgggaaaaaatattaacaaactatgcatctgacaaaggtctaatattgagaatctaaaagagacttaaaccaacaagcaaacccaaataataaaaaatgggcaaaggacatgaacagacacttctcaaaagaagacatatacatggccaacaagtatataaaaaatgttcaacatcactaatcattagagaaatgcaaatcaaaaccacaatgagataccatctcacacgagtcagagtggactattattaaaaagttaaaaaaaaaacagatgttggtgaggttgtggagaaaagggaatgcttatactttgctggtgggaatgtaaattagctcagccacagtagaaagcagtaagagatttctcaaagaacttaaaacagaaccaccattcaacccagcaattccatttctaggtatatacccaaaggaatataaatcgttctaccaaaaagacaagtatacctgtatgttcattgcagcactattcacaacagcaaagacatggaatcaactgagatgcccatcaatggttgactggataaagaaaatgtggtacacatacaccatggaatactaagcagccatacaaaaatgaaatcacgtcctttgtaacaacatggatggagctggaggccattatcatacaaaatctagcaacacacaagttaaccacataacaagtctgcacatgcaccccctgaacctgaaataaaaattggggaaaaaaatgccaaatctacaactgctgacaggctattatatttctttttttctttctttctttcttttttttttttttgagatggagtttcacttttgtcgcccaggctggagtgcagtggtgcgatctcggctcatggcaaactctgcctcccaggttcaagtgattctcctgcttcagcctcccgagtagctgggattacaggcatgcgccaccatgcctggctaattttgtatttttaataaagatggagtttctccatgttggtaaggctggtctcgaactccggacctcaggtaatccgcccgcctcggcctcccagagtactgggattacaggcttgagccactgcacctggcctatgtttctattaacaaacacttatatatgtataacaaacacttaatacaatttgatataactaggtaagatactattttaaattctacttgcaaaagcaattatccagaatatttggaaattactgtgagtcttttctatacacttagacagatataactgggataagtataataaagacttgcagaaaataaagagtattacttaaggaatttcctaacctgtaacaaaagttgttttaggagaaatgaaacttaaggactggaatctagaattagttatttgatctaattagattgaaaagcattaataagttttttgccagcggttaatgagaaactggtagtccatggcatgcaatggcaaaacaattaattaaataaattatcacctatggacaactataatcaagtgcctatagataaccaaatagttactgccataaaatattttagttcaaataagaacaatggggttagtccattgttttaaagtgtgctagagaatttggagaaagatcacaatgagctcaggctttagattcctatcacgagtttcaggtaagggaacagaaaaatgtctatgaccgctctaaaagataaatcaagtaagatatagcagctgcagtgctgagatgtctaaatataatatacaaagtctaatcttttagctgactcagctaacaagacacactgagttcacaacctcacaggtcttttaggttaaattagatgctgatggggaagaagggtgtggtgactatatactgtcaatttagctaagctggtactacattacctctagttcctttctctgtatggtgctgttagtgtcactttgtgattggaaggtggaagtgaagcggcatctatgcttatgctcagaggtcaatgtagggtcaggtactcttgcagcttgctcatactgtcactaaccaaaaagatgctcaacaccactcccgttagggagatgcaaatcaaaaccacaatgtgatatccggttcacatacattaggatggctactattaaaaaaaaaaatcaagcgttggtgaggatatggagaaactgaaacccttgtgctggtgggaatgtaaaatgatgcagctactacgcaagacagtataacagttcctcaaaaaattaaaaggataattaccataagatccagcaattctacttttggctgtatactcagaataactgaaagcaggagcttgaagagatgtttgcatactcatgttcatagcagcattatttacaataagcaaaaggtgacagcaacccaaagtgtccactgacagatgaacgggtaaacaaaacatggtatatacatacaatggaatattatttagccttaaaaaggaaggaaattccgacacatgctacaatattatgttaaatcagcaagtcacaaaagaacaaatactgtatgatttcatttatattaagtacttagggtagccaaattcatagacacacaaggtagcatggtggttgccaggagctgggggcagggggaaacgggagttatcgtttaatagataggaagtttcagtttgggaagatggaaaaagttatggagatgtatggtggtgacatttgcacaacaatataaatatacgtaatgccactaagctgtatacttaaggatggttaaaatagtaagtttaatgttatatatatttaaccacagtttttaaaaatccaactagagttcattgattctttaagtacttctgtactttctgaaataaaaagatgttcaagcccttcttatattttccttgccctactcctgctgctagccatttcttcaagaattcttagttccttttagtagactcatatttagaaaccaagatctggacactagacatgctcattgctatagggtgtctctgttgccagactctctcagaacagagccaggaaatatatgtatgcattcctaactcctcccctcatatacacatagacgtatacccacatttccaactgttattttagtatttataaaaagataagcatcattagcttaaattcatccaaaaccatatgattcattctagctttctccttttccatatttgtactcacttctatatctgtgaaaaacttggctaccattaccctcaatagatttacttatttgctttgtcttctgaggataaacaatatcctgacttcactaggccacctatactacctcatttaaactcaatgtttataagcataaggcccagcttctatttggctgccattacttctctccctgagcctgtttaatggtgcctggacaaggaaagaaagaaggaaagaagggagggaaggagaaaggaaaggcaagagaaaagaagaaggaatgggaggggggagaagaaaggtagaaagcacaatttctaaaaaattttactttttagttgttttttgctgatgaaaataaatgctattgatttttataggctaatcttatatttgaaaacctaactgagtcatcttattagtaaaaatagtttgttctcatacattttctaggtagaggatcagaaatctgattttctatctaaaaataatgacagctactgacacactaataacattgttaatagtgtaatagtaagcatctttgtcttgctctaattttaaaggaatgcatataaagtttcttcattaactacaagggttgctgtaggttttaccaaacatggaagctcttttctaataacagcttctaagaacttttaaataaatagcattaaactttattaaatgccttttcttaactgactgagataatcataattcttttcctttaatctattaatggggtgcattacactgaaagaatcctaggttaaactccactatattatgacgctttacttttttaatgcactactggattagattagccaatatttttcttaagagttctgcatttacattcataagaaaaaggggcttttttttcctttctttatattgtatctatctgattttggaatcagagttactcgagattcacgttttattaaaaacataatgctgactgacaaaagacaaaaacaatgaaatacataatacaccatttacataaattaaaatacacatgtagtaaacaatatacatttttcaaggacacctgcatagaaaataatatattgaacacattaaaatatccacaatgtatacatacttcaaaacatcatgttgcacatgataaatatacaactttatctgtcaattaaaaaagcacatttaaatgcttgagggagattgggagcataatgctgataaaaataaacaaataaataaaataaggaagggaccttgcagggaccaaagatgatactgtgttatgaactggagaaccaggaatgcttctcgtaagcagggattaaaaaaaaaaaagtgtcctgagatcatgaaattcagaggaggagacactttagagggcatttagtccaatctccctgacaatgtagaaatcctttacagctttcctgacaaatgactataagagtgtttgatggcacactgtatgagatgaggatggcatttctacaaagctgcccatttcactgttgaaaagtttcaaatgttagctctgatctccccccttcccaaacttaacaaatcagaacatctgatgatggggctcagaaatgaacatgaaaaagttttaaaatgactactgcagataataggacactgatatttcaactctaggtatatatcaaatttacttgtgggacattaaaaaatacagatgtgtaagcttcagctatgatgattgtaactcagcagtatgaacatttgcactttaaatatatcgatgacactcctgtccactggcacaatattgaccagctgtatgtaaactttaagtttactttcaagctaggtcatgaattatcaacatgtccgtcaacattctctaacctagagattactgtgcacaaagacataaaggtgaatagagcttggctcgggttgatgattagattatagccaagaaaggggcaaaagctactggcctgtgaagggacagaaactcagtatagggactaaaattctaaccagctgaagtaagcagctacttacaacacattcatttattcatttattaattcatcaaatttttagtgagagactactccatgccagacaaaatgggaaatatacatgtcaacaggcaatatcattatatgtggttaagtgctactgcaggatcatggtggatagtataggggaagtacaagatgaagtagaggcacagagttgctaccaatccaggcttcatgggctgaggaaggcttccagaaagaaatgacatccaagctgaaattaaaggatgagtaggagttggccaagggaaaggaaagattgagggagcagggaggagaaaggaaaggaggaagaaacagtgttccaaacaaaggcaatagatgtgtaaggcctggggactgacagcagtgaacgatgagactgtagatataggcaggggccaagataagatcagaatttactatgaaggcaaaggattttaaattgtgaagtgaaaagatacaacttgaaatatacgagtatcactttggggaaatggagaacagttatattatagaaatgggtcaggatggaggtagggtaaccagttaagaagttggtgcggtagcagaatttaggagatgaatttaggcttgagatttggaaggcagaagcaagagatggtaatgcagatgagtaagactgcctagggagaattttagactgagagaagatctaaagatggatctaaagaggcaaatgaaaataccagattttcatttagaattcattgctttaatttactagttgtgtgatttcaaaaatgtacttaatttctttaagtctatttccagagggcaaccatgattgtggcttacccagtttcacggacaaataaaagctgagattatctgaggcagtacagagtgatacaggcacccaagaaggaagaggacaggacaattataagtgctgactggatggttcttttacaagaaaaaatggaaaatgaaagcagactgggggaacaatggtggggagcagcaaatgactttgtttgatggtcccttctgtttaggtcattccctgaaaggagaagtaaatcaaagaatgacagaagaaaataatgtccacatggatgaagcttgttgagtgacagcttcattatagtatgccctgggagagctgttctactgaaaaacgtcaacctccacatctttaataaagtatttttctctttggctggtcacatttctcagagaacagttttacaatctcttgcctggaaggcaggctgccagagtcctggaagctaaagggggaaagcccactggcattctcaatatttggcattcacacaacctccttgtttgcagcaagacagaatttccctcaaccagacctagtatcttccaggccaatgacagcctctctctcataaaaataaatacacaaacaaacaaacaaacaaacaaacaaacaaacatctaatcttctgccatggtaaaggagaggcagctggctgtttacaccgaattaagaaaggaactgggagggggatccaacagaatcttaagcagctttcaaccaatcctctattttttatgttttagcctcaccttgtccttctgctcgcagagatacctgatgttactaattcctgagccttttggggttttgtaaactgggctgcctcaaggcttttcccgctgctacttgggaaaaggctttctcgggtctgctaagtaaagatcactcatctatcagctttctagcttctaagatgttgctgttgcctcctctcctgttctgcctgtgggtttatgtatttttttaagtggcttacttttgttttaatgggcttttgggtggtagcagagattaatgtacatatgcaatctgcttactttaaccacaggttactccatctactgttctcatctcttctccaaccacatttctacactatactcactaatatggaaatattcctcagttttcaaaatcacaggctctttcctgcatatcaaaaccacaatatgataccaccctattcctgcaagaatggccataatcaaaaaataatatatattggtgtggatgcggtgaacagggaacacttctacactgctggtgggaatgtaaaccagtacaaccactgtggaaaacagtgtggagattccttcaagaagtagaagtagaactaccatttgatccagcaatgtatctacccagaggaaaagaagtcataccaaaaagattcctgcacatgaatgtttctagcagcacaatttgcaattgcaaaaatgcggagccaacccaaatgcccatcaatcaatgagtggataaagaaactgtggcatattgggttgggcacagtggcttatgcctgtaatcccagcactttgggaggctgagacaggtggatcacaaggtcaggagttcaagaccagcctggccaagatggtgaaactccatctctactaaaaatacaaaaattggccaggcgtggtggcatgcgcctgtaatcccagctactcgggaggctgaggcagagaattgcttaaacctgggaggcagaggttgcagtgagccgagatcacgccactgcattccagcccgggtgacagagtgagactcaaaaaaaacgaaaaagaaaaaaaagaaactgtggcagatatatatgatggaatactactcagccataaaaaggaactgaattaatggcattcgcagcaacctggatgagattggagactattattctaagtaaataaggattactttattctttttccaatgttccagcttgacgcaaaactttcaggttcaaccagatggccaagacttatagaggccaagggtgtactcacaaatctgattgtcccaactgttaactgctcagggcttggttttctctacttgtccttttcttcagagtataaagaggtatacattagagattttcttttcttcttaggagaaacaatgtaccaaaataatggtttatatttgtttgtaattttctgagatctatttctatgttagtgagaaggttcctcatcgtatatgcaatttaacataatgctggacatagaagacttcactgggttttaaaattataatttatttttaaaagatcttagctaggatgtagacacataaaaagctttaattgtatatttgacaaaataaaaagttaaggccatgatatttttggagagatttttagtaatctcagtttcaaaaaatactaaaatatgatcagttctttgaaatgaaatgataggtaggaatagtctataacctctatgaaacagtgctataaaaaattacactggcattgaaataacctgataaacagccttttggcagtactcatgttccatttaattttcccttgtggataggaaagacagaagaataacttctaggtcatgaaaagtaaaaattaccaaagtttttgaatcactacctaaaaattagttcatttagttaatgtttctttcttaaaacatcaacacagatgtttggccactctgccttgaaactctatgcttttgtaaaaaaatgttcagaatgtcatgttaaatccctgttgataagtacgttgttgcatcaagaatataaatactaacaaatcccaagtgggtgacacattaaacaaataacacattaaagtaagaacatcacatgtaagtccattcataactgcgaagggcctctatacaacgttcaacaacagcatgtgcttgatgaagcacaggatctctttttatgtatacatgaaatagtgaattataaaatattaagtgcccctcaatccaaatgtatttggtttttttcaaacaactcctgagtaaatcaattgtatttgaaagctgcaaaaacaaaaacaaaaacaaaaaaactccatgtctttttgtttctagaaatatgattattcaaatgaaaaatatttgtagcctaagggtatctgctattctataagtgccataattgtaaatgctaaaattaagtttagagaaagccttaaaagttagttcttcagctaataaacagcacagaaagtactaatagcaaaaagctccaaaatggtttttgtcattttaataccaatcattggggaattaggaaattgcctgactttaggacttctagagaccttaatctgttaattctattcctttatcctctataataatggtaacaaagtaactgtaataaagtaacaaaagacagggcttttcttttagggcaagttcttctcataggatgctaaaatttcctttctaaaaaactgaggacttttttcaaattataaaagtaatacatgcttgttatatatcttatataatgtagttatatgtgtatgtttcaagcagagaagggtttaaaatggaaatcaaaactcttctaatccacatcccagaggtaatcattggtatctctcttatcaggataatcgtaacaggttttagtgtaaatatccttccagatttttactatcatatacatacatacatacatataattttaggtcaaaaatagattcatatctactttatgtaacttcccttttgcctacttagcaatatataagaaatttttccatatcagtacatatatagatgtacttgtttctatttagtagctgaacagtgttctaaagaagaggtgcaccatatttaatcgctagccaaatggtaggcagttaggctgtttttgatttttgccattataaagtattatatctactgtctcatactctaaagaatgtatatccagtaaaagtgaatcatcccctaacttggcaattaacttatacaatctacaaaatgtttgaagtgagtttgagaagataaatatgccctgtaaagaatctaatagcagtcagtactttaagacataaaatatacataagctataaggttatgaagaatgatacaatgaacacccatgtacctaaatagtatattatcattacattggaagatccccatgtttactgcccctcctctgtgtcccgcagaggtaattttcttaaatattttgtttcttattaccttagttttaaaaaaatacttttaccacgtatgtttgtatcattagattaaatatccttaaatagtatataacatgcacttgaattttgtaaagtggatccatattatagttgaattgtccttttttttcttttttcctttttatttttctgtaactcatgacagtgctgaattgtctttttatttttgtacagaattatcttctttaagattcatctacatcatcctttgtaactgcagttcatttattttctctgatatataatattctagtgtaagaagatataagttatccattctagtgttggttggcatatgagtcatttcaagttttctgctattttgaacaatcttgccattaacatttttgtacatgtctcttgatgtatgtgggcaagagctcctctaggaaggaaatcactaggtgatagagtacgcttcatatgcagctttataagataatgaccaataatcttatttctcatatcttattaaaatttctaaagtagctataccaacttacacgttcactagcagagtttatatactctatttgttccatacatttgtttgatattatcagactttttaattcttgccagtgagtgtaaaaggctctgcttatagttttaatttgcatttcttcaattattgacacagatcatcttgttatacacttatcatccaagtgggtttccttaactcttttttttttttttttggagatcttatgttaggctgatttataagtgctgctctgggcagttacacaatttgtttatagtaaggagttgtctgactttgagcatactgtacttggcgattagaagtcatcatggcaagagaaaaccacagctggccccctgaagcaaacacaaaaaccagagaatggtagcggaaatgtagagataaaggtggggtttgtttcttattacaaaagaaaaaaataactgctcagtagtcttaacaaaagaatggaatatttcacactgggagaaaagacattgggatacaaaatttcaagtgttttgactctagccctgtccccatatccttcaagagcagaggcagaaggagacagttaaagcaaacaggcaattctgcaaaaattacttagaaactctacagatttgattaaaatctaaacttctattttgttttttaaaaatttaatatatcaaaagtcctgctttagtgacatgttattcccaccagaaaataaccccaatattccctctgtcagtaacatgctcaagttgaccagctaactcttacctctaaacccatgtggacaagtatatgtcttttaaaccaaagccatggggatcaagtgactgctagtaacatgtcgtctgttaactgaccagtattcgtcttctccagagggtgggcagggcacagaaaccctagagtggtcatgaaggactaaccgcaaatcaacaactttcaagcaccacttccctcactccttactcaaaaggggctacttaatttctgtctagattatttgctttgaatttggtatcccgtgacctgtatgttgtttctcccttagcaaaacacacataagccacaaaactatatatataatcttcttgtttttatttttttttttgagacagattcttgctctgtcgcccaggctggagtgcagtggcatgatctcggctcattgcaacctccaactcctgggttcaagcgattctcctgcctcagcctcctgaatagctgggactacagacgcctgccaccatgcccggctaattttttgtatttttagtagagtcagggtttcgccatgttggccaggatggtcccaatctccagacctcgtgatccacctgccttggcctcccaaagtgctggaattacaggcatgagccactgcacccgacccttgtttttacatttaaatataaaaacactactctgttttgtgtgataaatagaggaccaagcaaaaagaacctcttcttcttttaaggtagggatatccatcagtttatactaagctttgtgttcagaggagagcatttcaccccaagctaggctagtcccacacaagcaggagaccaagggcattctcctccctgatccccaacccctaccttctctcctaatccctacttttgtagaaagttggttataatcttttaagaaacatttccaccacaaagggaaatcctaacctaaccagaataagtcaggtcttcccctctcaggtccctcaaagaaaaaatccccctccttcaaacatgcagtctgttccgatagctacgcttattgaacaggcacaccccgttaaatggaagcagtggttatgtttcaccacccagctccccactaatgtactaaaaagcttcagtgatagggaaagaaaaggagggtaaagatgtgaagaaattaataatttgaccccttatcccagccaaagaaagaaagcaagattaactgggcacaaggaatttaaaaagaccctcatattccatcctttcttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcctgatccgcccgcctcggcctcccaaagtgctgggattacaggcgtgagcatcctttcagttacaattaggacaactgggagaggggaagagttggagttggatgaagtactaggaggggcttgacagctggaggtctagttcacttagtttttgtactggaagggctcaactccggtttgagaagacacgggcagatgagggcttctgtcaccgaaaatgggtcacagtcggcagagaggcaatgatcttcaaagtaacccttcttctcctggccaacagtctggggaatgtgtatgctggcactatgatgggctataagagcagaaaagtcgttgatgttagaagtttcatgggaatgtggatgtggtactgctgttgcttgcttagtttcttgatggcctcctcaatgtatttcagaccattctcccgcatggccttggtgctaatgttggtatggcagcctgcaccattccagttcccaggaatgggcttaggatcaaaggttgctatcactccgaagtcttcacatacacgatgtaagatgaaacaggtcacccagagatgatcttccatgctgattccttcacagggtccgatttggaatttccactgggcaggcatgacctcagcattagtccctgcaatcttgactccagaatacaagcaggcccggtaatgagcctccacaatgtccctgccataggttttgtctgctcacatactacagttaagatggaccctggggctcagggaatccactggaaggccaaccaaaggggtgcccgtctgtccccatgagattatatattcctgctccatgccaaaccaggggtgctggttgctcaccatgtcccttatccgtttacaggtgtgcctcaaattggtctctgcaggctttcgattgcacttgaaaacttcacagaacaccagcttgtggaggtccttgtggaaggggtcccaaaacatggcagcaggcatgagatacatgtcactgttggaaccttcaaagtactagagccaccaaaattctactcaggtaactcttccacacgcttgggttcacttgcagcgcagtcttgcttgagtaccatcgattcagatatacatggcctggactttctcaccctgaggtagggacatgtacacctgcttgacgcctctgtttaagtgggagcttgctgagatggtcatggtggaaggtgttctgggcactgagcaggcgggtaggtaaaggtaggctgcgagagtgaggagaggagagaggaggggaggccactgtgcgctcagaaactctgctcttctcccattctcggctctgccttttaagatacttaaatcttttgctcattttcaagttaggttgtctttttgaaaaaatactgatttgtagggttttttcttttttaaagagatggggtcttgataagttgtctaggctggagttcagtggctattgataggcgcaattatagtgtactgcagcctaactcctgggctcatgtgattctcctatctcagctacctgagtagctgggactatagatgcacaccaccatgcctggcttatagttcttgtaatcggagcattaacctctctctctgaggtttatgttttccctctctctatggtatcttttaatgaacagaagttcttaattttaatgtagtcaaatttatcaatcttttcttttaacattggcactagttgtgactagtttaacaaatctttccctaccccaaattcatatggatatttcctgtattatgtttgaaaacttttaagctttatagattagctttttttggctcttcatatttaagtctttaatacatgtggaaatgattcttgtgtgtggtgggaggtatctatgcattttttgtatcaatggtatgttatgtgtacatgtcccagcactattaattgaactgctcatcttttcactgctggtgccaattttgccataaatcgtgtttccatatatgtgtgcatttgtttctgggctttctattttattctgttggtcaatttgtttataagtgtgccaattctacactgtcttaaataataataattattattattttttgagacggagtttcgctctttcacccaggctggagtgcagtggcacgatctcagctcactgcaacctccgccttctggtttcaagtgattctcctgcctcagcctcctgcgtagctgggattacaggcgcctgccatcaagcctggctaatttttgtatttttagtagagatggggtttcaccatgctggccaggctggttttggactcctgaccttgtagtctgcccacctcggcctcccaaagtgctgggattacaggcatgagccactgtgcctggccaaataatataatcttaaactaaatttttgatacctgacaaggtaaattgctgtgctttgttgtttttctttaggagtatattggtaattttaaggcttttattcttctgtttaaggttctgataggaattgcattgtctctgtagattgttttggggagaattgatatctttaacatattgagtcttccattccatacaaatgatacattttctcatttatttaggccttgtttctttcataaatttgattaattatatcctataattcttgctttccaatgtaccaatatttaacatgcatttatttactttgtctggagtcccacggatgatctttgaagtcttaatatttaattacatttccaccttgtgcaaaatgtttgagaaaggaactttacattacctctcaacagaatgccaatgtcatagactctctaacaagggaggcaggatgaggaaacaagattattagcttctcctaaattgtcctcactgttttgtgggaagtttgtttctgaaagatcatacacacattttgaagccaagtggaaattttgttgttgtgctttacaaacacaaagtacttaaatacttaattaagtaattcatttatcgtttggattatccaccattcattgtcctctgcttggacaactgaaaactgactgaaaagggctgatgtgactatagacattaagtaatatataactgaatgctttaaagatgacttttcattttcaaagaacttgcttatattacagaactagtaaaataatctagcattttcaaagagaaaacaaagaaagaacaaaaactcttaatatttatgccaagtaataaaaaagtatttgacagaaatgatagagatactgacgcttcatcctattagctgtggtaggctcaagaactgatatattggtaattacaaaatattctggaaaaatgaaaagtattctcaaataagaggaataatctgaaagaactacaaattacctgtagagtacaattcatcatccttattatgtagtcaaactgttgatggtctaatattgcccggttttgctggacatgcaaacccaattcatcagtgagacactgtcttgctgcctttcctttaagggctctgagtgcagcaggaagggtctgaggacaagagaggtacaaatgaccaaatggtaccactgggggaaacaacaactttcaaacaatcatcctgaaaattcaaacgcatcctataatttatttaacatagttattagtaaaattaaactcctagggaataggtgatttattattaagacaattataaaatagatttgtggttatttttatatgtaaaccagcaagaaatataagataattatgtgataaattgaaaaacatttaatttcactatttttcttcaagttaacaaaactttggttaccaaattgactgttgcttcagatcatgagtcaaagccatagatacgtaagacacctttctataactagtaaattttccatggcaagaacagaaagaaaaattaaaacaataagaaatacaagtgatttcatacttttaaactggttggctgcttaatcactattcagctttaaattatgactgaaaagttctacaatctcttctcatttaaatatcataaaaaaggaaagaaaaaggactcggagttgcaaaaacagatatctctaggtgtatgcattaaaactcttttcgctttacaacaggcacatccataaagatgcctccttcagttcaccatgtaggacttagttaatttacttcacatataataataataagcttatttagctaaaaaatcagaacaaaggagaaaacaagaagtaggagggcatgatatcactaaaggtgggtataagaaataggatgtgaaagttgaaagcaaaagaagtgaaagacttcaactctaagaaaacatagaaaccaaaaagcacaaaatgtaaagagcactgggtcagtcagtgtaaaggtaaacatttctacatgctttaaccaacccctgaaaatagatattcagaactatgacaatgagtcagtaagaaagggttacattatgttcagcatgtttcattgaagaaggcaagaaaacatgctctaaggaggcacatttaagttcaatactacagttcctataattcattacatattctaactagattctttgcaatacataaaattatattaaaatgttaagttttggccaagcatgttggctcatacatgtaatcccagcactttgggaggctgaggcggctggatcacttgagggcaggagttcaagaccagtctggccaacatggtgaaaccccatctttactaaaaatacaaaaatgaggcgggcgcagtggtgcgtgcctgtagtcccagctacttgggaggctgaggcaggagaatcgcttgaacttgggacgtagaggctgcagtgagccaagatcatgtcactgtactccagcctgggtgacagagcaagactctggctccaaaaataaaaataaaatgaaaaaaattttaagtttctaagtaatatcccaaaatagtgttttgtgaacaatgtttaaaagtttgacagaaaaaattactatgaatatatttctggtggtcatataattaagcttggcccaacagctttaaatcttagacactattcatttaaaatgatccaaacaatgagaggatactttattaggaaaagggatagaattaaagaagagagaagctggtaacctcagcacgtaaatctgaaagggaaatgataaatgcttacttgggaaagatcacattttattaccttttcagtttccaaaattttattttcaaatatgaatgagatacagtttctgacaacttctagtctttgtgcactgttgaaaactgtcgtcaccttgtccattatcgaaactagtaaaagaatataaagaaagcacaaataaattaaacttctttggtaattacaaaagcaaagagactactactttaagactgtaggttgggcgtggaggctcacacccgtaatcccagcaatttgggaggctgaggtgggatgatcccttgagcccagaggtttgagacaagcctgggcaacatagcaagacccttgtctacaaaaaatacaaaaattagccgggcatggtgtcttgcactgtaatcccagtgactcgggaggctgaggtcggaggatcacttgagcccaggagtccaagtctgcggtgagctaggacagcactactgaactgcagctgggtgacagagtgagaccacatctcttattagaaaacaaacaaaaactgttgatatgacctacaccttattttttcccttattacagagcattgaaagtattccatatcattattttgattacatgttccagtgttgaagtatcaggctagctgattaataatttcacagggtagattctaatgagacacttaacttttatgcaaactaattcacattgcaaagtaaaattatattaaacaaaggcaaacatctattttaaactttgtttacaactagtaatattgttaatatttctaagatattaccaaagaaaaactacattccacaaaatattagatattacacatttgagtagaggggacttgaaagaaagtagtgcaaacaaagagaaacgatcatgatcaatgaactgttacactggcttaggaaagtcactttttagtcatgcaaacctagcacctttcaccttttaccatagggttagaaaattctagtgtattacctaggctactaagctagttacctaaataaatttaacttattaaaataatattagaaggatataaatgaaagtagtatttatataaaatttatactttcacaaagaactatactatgccatttgtttaaatgaggtagtatcaatagtttttttttgcataaatttaaggggtacaagtgcagccttgtcacatggacatactgcatagtggtgaagtctgggcttttagtgtatccatcaaccaaaatgatgtatattgtagccattaagtaatttctcatccctcactcccttcccaccctcccagccttctgagtcaccagcgtcttattattccacacttgatgtccatgtgtacacattatttagctcccatttataagtgagaatagtatcaatggttctcaagccaaaaagactacttatattttatggctactctttggattctaaaggcacaatcccttcaccttctcccatacctaagaagaaagactatcatattttactcattagcattcctttcatctcatcaatacaaaacctatattcgtcaaataatgttttaaactttttttttttttttttttttgagacagagtttcactcttattgcccaggctggagtgcaatggcacgatctcggctgcctcccaggttcaagtgattctcctgcctcagcctcccaagtagctgggattacaggcatgcgccaccacacccggctaatttcgtatttttagtagagacagcggttctctatgttgctcaggctagtcttgaactcccgacctcaggtgatacgccgacctcggcctcccaaagtgctgggattacaggtatgagccaccgcgcccagccttaaactttttaataaaactaattatatgctcacaataagctgcaaatgtaatacaaagaagatctttgtactcatcacccagcttccccctatggtgacatctttcataattatgctttattaggatcaggaaaacaactggcataatacaatgaatgagactatagaccttacttgaattttaccagttttcttcaaatcatttttaatcatgtaacattaatttcctggttaaactgattatttcacgtgacttttctctctgaaatgctcattcataattgtgggctctggtgcttcccacacacataggttggtggcattaactgaaaatctatctatattagaatagaaaacttacaatctccaattaataacacactttattgagagagcaatgtgtttatgtttataaacttttaaatctaaaatatctttagcagtattttaaattttctttaggctgagttattagaaaaaaacatattttctttttctttttcttttttttttgtgagacagagtcttgctctgtcaccaaggctggagtacagtggtgcgatcttggctcactgcaacctctgcctcctgggttcaagtgattctcctcctgccttagcctcccaagtagctgggactacaggtgcataccaccacgcctggctaattttttgtatttttagtagagatggagtttcaccgtgttggccaggctggtcttgaactcctgacctcaagtgatccgcccaccttggcttcccaaagtgctgggattatgggcgtgagccaccacgcccagccagaaaacatattttcttgtaataaatatgtttactatctggaatttttttcctttggagaatccaacctaattcacattttatacatgcatctaattaaccaacttcaaaatatatcaagaaaaacaggaaaaactgaaaaatagggaattctgctattataatgggagactttaatatttcttcctcaatagctgaaaaaaagacaaaagttagtaaaggaagacaactcacagaatggggaaaaattagcaaataatatatctggtaggggacttatatatagaatatagagagtatgcttacaactcaataataaaaaggcaaatagcccaatttcaaaatgggcaaagagacagtgaaatgaccaatagcacatgaaaaaatgttcagtatcagtggctgaaattagaacgaaagaaatctaaaatggcacgaccgctttggaaaatggtttggcagctcctcaaaacattaaacatagaattaccatatgacccagcaattccaatcctaagtatacatccaagagaactgaaaacatatctacacaaaatcttgcacataaatgttcacagcagcattattcataatagccaaaatgtagaaccaactcaaatatccatcaattgatggataaataaccaatgtgatatatatccaaacaacggagtattattcagacatttaaaaataaatgaggcctggcacagaggctcacgcctgtaatcccaggactttgggaggccgaggagggcagatcacgaggtcaggaggtcaagaccatcctggctaacacagtgaaaccccgtctctactaaaaatacaaaaaaattagccgggcctggtggcgggcgcctggagtcccagctactcaagaggctgaggcaggagaacggtgtgagcccgggaggcggagcttgcagtgagccgagattgctccactgcactccagcctgggtgacagagcgagactccgtctcaaaaaaaaaaaaaaaagaaacgaaatgctgatacatgctacaacatagacgtacattggaaatattatgctaaatgaaagaagccagtcataaaagattacattttgtataattctatttatataaaatgtccagaatacgtaaagctatgaagacagaaagtagattactgtataaggctggggagaaggtggtttggggaggaaatggggagtgactgctaataggtgtgaggtttctatttaggttataaaaacattcttgccgggtgcagtggctcacgactgtaatcccaacactttgggaggccaaggtgggcggatcacctgaggtcgggagttcgagaccagcctgactaacatggagaaactctgtctctactaaaaatacaaaattagctgggcgaggtggcacatgcctgtaatcccagctactcaggaggttgaggcaagagaattgcttgaacccaggaggcagaagttacggtgagccgagatcacaccattgtactccagcctgggcaacaagggtgaaactcaatctgtctgtctgtctgtctgtctgtctgtctgtctgtctctctctctctctctctctctctatatatatatatatatataaaatatatatatattctcaaattaaatagtaataatggttgaatgagtctgtaaatatactaaaaatcatgggatcgcacattttacattggtgaatttacagtatgtaacatatctcaataaagctgttattaaaaaaagaaaagattctatagtggcagtggttgggttatgattaccctttttgggaggcagtgaatgaaacagtttctgagtattgataatgctctgattctagctacaggagtttgttcactttgtgaaaattcatcaaattgcacacttttcctttttgggtcttacatccttataaacagtttacttttaaaacagacagacaaatacataccaacaggtggacctgctggcacaacacatttcttttctattcgtgtggcaggaggtgcattctggttcttagcaacattttcctgtattaattcctgaacccgggcttcattaatctctgggaaaggaagaatatgaactcgcaaatgggatccttctgttggccgtggaactttctggaatgccatatgaggatttggattctcctgtaatatcagacataggtaaaattactccaagttaaaataacaatggcagatcaccaggaagggagtgggagcttacagggacacgagctgggtagttatacatacattcatatatacgccataaaacatgaagtaccaaaatcttacttcttcttacatgctctatcagcagcatctgatacagcttggcatctgtcttcctcttccatgaacactttctttacttggtttctaggtcttcttgctacatctttgtctatttctcatctccctaatcccttaacaatgtgaatatctcagggctcagtccttgggtcttttttctattaacattcattccttggtgatcacttccagtctcctatctttaaaccataaaaataccaacaattcacaagtttttttctttaaacaagttttctcctaaaccccatacccacatgtttaactctctatacaatattttcacttggattttttaaaaaattctaaacctatgtccagaatgcagctcttaatcttcacccacctctatccctgctttcttcagtcttcctcacatcagtaaatggcacatttattttttccaatcatttagacaaaaagcttagagttatctttaatgccattctctaacacccaactatccattcctctgcagatcttgtggacttgacctttaaaatgtttacaacttggccagtttcacaacactttggttcaagtcaacacctcacgttacagcaatacaacagtctcctagtctccctgcttccacctgtactccttcattcaacactgcagactatgtgatctagttaagagtatgtcagttcatcacataaccgttctgttcattccaatggcttgtcatctcactcacaataaaacccaaagttcttaaaacaacttacaacaccctacaagatctggcctttctatatgatgtgtcctgccatgatttctttcatttttttctgctctagacacacagaacttcttgttcctgactcaaagcctttgcacttaactgttctctctgcctggaatgcctgtgccccatgaatctgtacagcatcctccttcctttcttgcatttcttagctcaaaagccacctttcccaatcaccttatcttaaattatactctcttccccaacacactccctatccctgttatatttttctctatatcacttatcactctctcacatactttacattttatttaacttgtttattgtctatccttctctccataaaataaagctccatgagagtagacgtatacctactgcatctagaaactgcctggcacacagcaggcactctaaagctcttcccactgcatcttaatgagggggacacaatgctgaacacacataaggattgcaagaattgaattaaatgtgtcagctaatatttttgtagactctttgggttggcatgaactttttagtcatctagttaagcaggattagatctcaaacactccaggtagaatggaatccattctttcataaagttctctagggaaggctgctttacaactattcttgaccaattctaacacttattctttgcgaccagaaaattccttattcccactgaacttatgttattcatgctgtagattaaactcaatactatcccatatatcctatttttttttttttttagacgcagtcttgctctgtcgcccaggctggagggcagtggcgtgatctcggctcactgcaagctccacctcccgggttcacaccattctcctgcctcagtctcccgaggagctgggacaacagggcccaccaccacgcccggctaattttttgtatttttagtagagacagggtttcactgtgttagccaggacggtcttgatttcctgacctcgtgatccacccgcctcagcctcccatacatcctcttgacacttaaaatggccaactgccatcacttcttagggctgctccccacaattctttttggttatatggcccagacctagataaagaaaatgttgggctaaggcagatgatatagctagtatgcctcagcaatataatagaaacacactgcttcctcccactgccgtaagtgtcaaaacacatgggttccagttcttgctctagtccttattatgtgatgcagggaaaacaactttgcctaagttatataattaagcttatcttatataaggctcctcagaaggtgaaatcagatttaaaatctgttcttgccaaagcagctctcatacatgctctgtatttccccccatatctagcaaagacagggaaaaataagtaagtaaatccttagtccaactcttagtaatcactctttctaaaccaaatgttgaaaaagtgttttacaattctgtctggacttaacaccaatgtcactggcctgtagtgtctaaaactgcccttttcaaaaagtagtgtttttgttcttctctgttctttaggcatgactcttactcatatactgtcttcccaaaaataataaatatcaattctctaaaacatattgggtaggtatcttttttttcaggctggccaggtaattcatatggatcttgaggtctgaattatttaaagtatattcattactttggtttctatctatattttctttataataaaaattaaaactctaaatatatttcccatgaagtaaatatttataataaaatttaaaacttggaaaaataaaagtagaaataatcttagtaacaccagtattttttctagttatatatatatatttttctctattgttatattatctgtcttctgtctttttccaaaaatgacttggggtggtttagaaaaagcaggatgcattggccaggcacagtgtcttatgcttatgtaatctcagcactttgggagttcggagtgggcagatcactttagtccaggagttcaagaccagtctgggcaacatagtgagaccccatttctacaaaaaaataaaaaattagccaggcatggtggtgcctgcccatggtcccagctactcaggggactgagggaggaggatagtttaagcctgggagatggaggctgtggtgagctgtgattgcaccaccacactccagcctgggtgacagagtgagaccttgtctcaagaaaggaaaaagaaaaagaaaaagaaggatgcacatatcacttctagtcaaaatctctaaagagttggtcctataatttggtaagttcatcctaaacttcatagggacatacaaagaccaaaaatagtcaaggaaattctgaagaagagttaagtgggagagttaagatttccagatatcaaaacttacataaacctttaataattaatacagtacaacaactgttattagtgaagggttaaaaggatgaatggaatagaatagagagccccaaaacaggactatgtgagaaaatatgatagagataggtggcatgacaattcagggggaaaggttagacaattcaatgagaggtagtataacaaagtatttttagttcatgatctctgatttcagaacgcctcgtttcaaactctagcttggccacttactagtagtgtgacctggtgcagtgtcaattcacttaccccatgtgttgtagttttcacatctgtaaggaagataataatatagtacctacttcataaggttcttatgagtattgaacgagctgttacagtaaagctgttagaacacacaaacacacacacacacaccaccccagaatgaatctaaaggctgttttccaaaaattttggctacattcatttaaaaaatatgtattctcttattctctgcatattctatggcatggtaccatgcttctataactaaagccatctctttctcccaagatttccaacacattaccaactacttacattttagtaattatagtagtagtatccaatatgttttttgtttgtttgtttgtttttgagacagagtttcactttgttgtccaggctggggtgcagtggcgcgatctctgctcgctgcaacctctgcctcccgggttcaagtgattcttctgcctcagcctcccaagtagctgggattacaggtgtgcaccaccacgcctggctaattcttttgtatttttagtagagacggggtttcactatgttgttcaggctggtctcaaacttctgacctcgtgatccaccagcctcagcctcccaaagcgctgggattacaggcgtaagccaccacgcccagccctccaataagttttaaatagagtcttcccagaagcaattagaaatattgtaaaccaaatccatacacaatttagaattacaagcattaatttacaagcttgtaaaaaagatcatgttaaaacaaagttcaaagttgaatatctgtagttatatagatattctacaccaaaatgcagattagggattttgttaaattatgatatatttagctgtgtttagaagattcgaaaaagacttatgccccagaatacagtaatatttggttttctggctcctgagtctgtatactgctgccctctaacgggcagcatgataaatgtaaaggaccacatttgctaccttgaacctaacttggtcgcgaaatgacttttgagaagacaatagcaatgagaggaagtttagggtagggctcactgtattctgcatatacttaaaaacatctgcttttacttgtaacacaagatgtgtttggactggtcccttgaacgtcaccaagctcattaaaagctacagccaaattttgtgttgaatctccttgttgaaataaggaaatccgttattttccgacagtacaaagcagcagccaaattttcatctttgattccagagaaatgcaaatataaagtaataaacaagggctagacaactaaacacttacagtgaacctggcaacatttttttccaaagtaaccaaaataaactactgaaaagagtttggcagaatgcactgtcttttacattttgaatttggataatgattttcaaggaatggtctctataatcctgctttaagagtatactttagtaattcgaggtagaatgatttttctcagacatgaaaaagtgacatatacacacatcatctggtctgcagcacccctcccccctgcagcacgcccagctacccccagctttggtaggctaagtgagaatatgcctaggggttacagaatacaaggcttgaaactaatttcaaataaaagcaaagcaaggcacaacaaaagccccaaaccccaatggaaattcaaagtaggcaacagccaccttgggaaaaagaaaatttttcctatgtattggtctcagcactgaaagacaaatcaatatgatattgttagagcttatcaagtttcccagattaattcaagtatttgaaattatttaacgtgcacaaattatacttagagctatgtgggatagcaagtgacacaaattttttttctaatacagttgatggcaatactgtcactggagtaaattgttaaacattgtcaaaacgtaactggactctttagagttgcctggtagtgtacatgacattgatggaatgactcatcctcaattttccaacttcataggactttcaaggatcacatccttgtgagatgactgagacattcaactgaatgtcttatccttaatacaagtagatgactttaatatttgatatgctggttgccctaattcagggtttctcaacctatgcactaattgacatttgggcttgataattatttgcgataaagagtaggtgtcttgtgtattgtaagatgtttagaagtatctttggcctttatccactagatgacagtagcacagtccctccaactgtgaccaccaaaaatgtctccagaccaatttcatgaagtagggtgggagggttgctcctgttgagaaccactgctctaattcatgactccagatagagatttcctattctaagacaagtactcttgtcacaagtacgaaggcaacatacagtgaccagctaacagtcctatactctcactcacctgctgaaatacaaattagaatcacaatgagataccaccacatacctgttggaaaggctaaaacaagacacccccaacaccgcccaaaaaaaaaaaaaaaagaaaagaaagaaaccagccgggtgcagtagctcatgcctataatcccagcactttgcgaggccgaggcgggtggctcacgggagttcgagaccagcctgatcaacatggagaaaccccgcctctactaaaaatataaaattagccaggtgtggtggtgtatgcctataatcccagctacttgggaggctgaggcaggagaatcgcttgaacccaggaggcagaggttgtgatgagtcaagattgtgccatggcactccagcctgggcaacaacagcgaaactttgactcaaaaaaaaaaaaaaaaaaaaaaaaaaaagaaaaaaagaaaccaactgacaataccaagtgttagtaaagatgtggcacaaatggaatgctaatatactgctggtgaaaatgcaaaataacgtagacacttgagaaaacagtttggcagtttcctatacagttaaatattgtattaccatatattccagcctcccactcctaggtattcatacaagagaaatgaaaacttatatttatacaaaaacttatgcaaatgtttggggtggttttattcattattgctaaaattgtctttcagttggtcaacaggtaaataaaactttagtccatccataaagtggattaccactcagaaaaaggaataaacaactgtatgaagcaacatgattgaatctgaaatgcactgtgctaagtgaatgaagctaaactcaaaaaactacataatgccattatggaaaaggcaaaactatacagacaaaaaaattgatcagtggttgccaagtgtttgaggtggtgggaagatgtgactataaaggagaattaaggaactttgggggagtgatagaaatactctacctacttattgtgatgctagtggttgtatgacttcatgcatttgtcaaaactcgtaactgtagattaaaaagtatacattttactgtatataaaaattagatcatgataaacctgacttataagtgaacaaagaaatcagataggacgggaggggggttcaatttgaagcctatgctttgcgggcagggcttcatttcatcatcattatctatataagtcgtttatgtctatgtcttgactctctaaaggtaatcacaatattttacttccttcctataattaaaaaattcctttattcacagttggcaaacagtataaatatcatcagtgtagatgacatgtagtgaaattaacctggtagtgaaattaacattttgcggaaatgtaaagggcgtagattttatttgatttggactagttatttcttgtatttgagttttgttctcccattaggattctatttggttcaatgctgggcaatgaaatatccataaggcacaattataaatctcatattcttcttcttcttcttcttctttttttttttttttttttgagacgaagtcttgtcttgctgcccaggctggagtgcaatgacgtgatctcggctcactgcaacctttgcctcccaggttcaagcgattctcctgcctcagcctcccgagtagctgggattacaggcacatgccaccacacctggctaattttttgtatctttagtagagatgtgtttcaccatgttgggcaggctggtctccaactcctgacctcatgatctgcccgcctcggtcttccaaagtgctgggattacaggcgtgagccactgcgcctggcccagatatctgatattattttacacagaattttaagttctttaatatttcctttaactttttctaaaactgtcagacaaagccaggtatggtggtaagtgtctgtagtcccagctacttgggagcgtgaggtgggaggatcgcttgagcccagaagtttgaggctgtagtgcattatgtttatgcccgtgaatagccactgtacttcagcctgggcaacaaagcgagacaccacctccaaaataaaaagcaaaaaacaataaaacaaaaattgtcaaattacatatctagcaaatatttttatactattgcagatgcaaaacaaattacaaaaactgtactatgtaaaacaataaaacacatgtccaactgatttcttttctttttttttgttgttgttgttttttgtttttttttgagatggagtctcgctctgttgcccaggctggagtgcagtggcgtgatctcggctcactgcaacctccacctcccgggttcacgccattctcctgcctcagcctctccgagtagctgggactacacgcgcccaccaccatgcccagctaatttttttgtatttttagtagagacggggtttcaccgtggtctcgatttcctgacctcgtgatccacctgcctcagtctcccaaagtgctgggattacaagcgtgagccaccgcaccccacccaactgatttcttaatgccctgaagtagaagttttatgaagttcttgtcttggcctatctttttgtcttggcctatcttaatgttctcactttgtgaaaacatttattagtggtcctttatatgtgcatatcaagaatcatagaggccaggggcattggcttacccctgtaatcccaacattttaggaggctgaggtaggaggactgcttgaggctaggagttcaagaccatcctgggcaacatagtgagaccctatctctacaaaaaaattacaaaaaattagctaggcatggtgatgtgtgcctgtagtcccagctactaggaaggctgaagcaggaggattgcttgaacctaggaggtcaaggttgcaatgagctatgatcaagccactgcactcctttctgggtgacagggcatgaccctgtctctttaagaaaaaaaaaaaaaaagaatcatagggatagggcagggaagtagttacttgtgttctcatgcagacactgaagattctgaaagccaaaaaagtaggccaactcctacattatgaattgggaatggaaagaagctgcatagaggtgttgccgataatctctgttacaatatcttttttacaataatctttgttaccaatgcttacactgtttgtctctagtgggtttagtcatttccttctccttccttccacctaacccattcccccaaagtcaccaaatgcctttcttaattatttgggaagctccagaaagctaaaagagcagctaagctcagttacaattcatcctactcacattcctaaaatctcactaaaaagcaatataaaggagtggtgagaagagacaggaaaattaaggtgtatttttgaggtgcttcaaagggaaatgaaaagagggcctagatacacataccagacttcagtgcaataaagtatttacaaacatctgaatggaatcaccaggtctcaattccaacccaataacaaggaaagagtcaaattagatggctggttcttgcttatcaaaagggaattttagaaatgtgattaaaaaaacaacaactgactagttaaaaatagaaccatgtggattattttcctcgcattgataccatcctgcctcccttcccccaatttcctgcataacctaagaaagtaactttactatcatgttctgttttttaactttataaagtatttacttcatgaatgatgattttgtcatcacggacttcagaatcttagcactagaaggaatctcagacaatctaatgacaatccactgggacagtcacaaattcttacttgtcatgtctgtgtatccttttctgaaggatattaggagaattacgtacctagaatatgcctggcactaataagtacttaactaatagaatttattaaattaaatgaaatataattagattgtgaaaaaaatttccaataaggcctatgaaatgtagaagacatttgaagggctcttacctagtaatataatctcttaataataatacttcacgatgatcacttttaaagtgtcaattttaaagaatagggattgtccatgtttttgtttgtttgattgtttttgtttgtttgtttttgtttttgagacagggtctcactttatcacccatgctggagtgtggtggcaggacttcggctcaatgtagcctcaaccttctgggctcaagcctcgacctccttggccgaggcgagtggatcccttgagcccaggagttccagatcagcctgggcaacacggtgaaactccgtctccaccaaaaaatacaaaaaaagtagctgggtgtggtggcatacgcctgtagtcccagctactcaggaggctgaggtaggaggattgctggagcccaggaggtcgaggctgcagtaagccgagattgtgccactgcactccagcctgggcaacagagtgagatcttgtctcaaacaaacaaaaagaacaacatgtaaagtcaactactggaaacatcgttttttcctattggaggcgatccagccttatagtgaaagaacataggcttaggaaatgaatagatgaaaattcctaatttaaaatctggatttaatcacttaagagtcatatgattctgagccaattagccccactaaaatggggataatgacacctgccttacattgtcgttatgaggatgagagataattgtatgtaaagtgcttaattccatgcctggcacaatatagctaactgctctcatgcagacactgaagattctgaaagccaaagtgggccaactcctgcatcatcaactgagcatggaaagaaaagcagtatgtttatacatgaactcaatatttattattattataataggtcaaaagaaatttctcatatgatcatgctgtaattacttctacacagccactataagtggcaaagaccagcatacaacacaagttttccttctaacagaattctaccagatttcttttttaagttttagtatactaatcaggaaacacatttattatatcaggcatggttataaataactaaaaatgtgatcagtcaataaattaaagtaacagatcttggcatgcaagttgccagaaaaataatttatttatacttttgctaaaccagtattatgatttaatgtgtgatgtatttagaaatctgaaaatattgcttcttagtaaagaagctaataatctacaagtaacagtcaattaaagtacttctgtgttaagtaatttaaaattgaaattaaattcatctttttttttttttttttgagacagggtcttgctctgttgcccaggctggagtacggtggctcaatcatagcttactgcagcctcaaactccttggctgaactcctgggctcaagcaatcctcccacctcagtctcctgaacaggcaggactataggtgtccatcaccacatgtaatttttttttttttcaagacagagtcttgctctgtcatctaggctggatgcagtggtgtgatctcggctcactgcaacctctgcctcccgggttcaagcagttctcctgcctcagcctcccaaatggttaggattacaggcacgtgccaccatgcccggctaatttttgtatttttagtagagacgggatttcaccatgttggccaagctggtctcgaactcctgacctcaagtgatctgcccgcctcagcctcccaaatgctgggattacaggcatgagccaccatacccagcctcttgtaattaaaaaaaaaaaaaaaaaaaaaaaatttgtagagatggagtctcactatattacccaggctggtctcgaactcctagccccaagcaatcctcctgcctcggcctcccaaagtgctgagatcacaggcatgagccaccacactcagcctaaattcatcttttaacaggcacaagaaatgttatggctaatgatttctgcatgtgttagtaatattactgctcccttaatattactggcagaccatatctatttccagaatttataatgaaccactagcaattgataaaacagaacttaagaatttttttttttttttaagacggagtctcactctgttgcccaggctggagtgcagtggcgagatctcggcttactgcaagctccggttcacgccattctcctgcctcagcctccggagttactgggactacaggcgcctgacaccgcgcccggctaattttttgtattttttgtagagatggggtttcactgtggtctcgatctcctgactttgtgatctgcctgcctcggcctcccaaagtgctgggattacaggcatgagccactgcgcccagcaataattttctatttaccaaaatttagataagcataattcataaaagatggatttttttgttttaatatgaaacctctgaactttactttgttctctttcaaaaaagtatttattccctcaaagaaagatcacattctaaatgtagaacttaaaactcagaaataatggaataacataaagaaacaaatgttttagtatccctgcttgtatccaattggttctcaaatttcaaatgaatgtgacaaagcactgactaataatccagtgtccaaaaaggtccatctagtcaaatcactaaattaaacaatacctgttgtgagtcaagatactgaccctgaattcttcttcactatttccttaaaaatacatcttccccagaagctaaataagtggtactcattaaagctggcaacaatagacaccgaggactactagacaggggaggaaaggagtagggaaaggggtgaaaagtgactactgggtactctgctcagtgcctgggtgatggcatcaatcgtaccctaaacctcagcatcacacactaagcccagctaacaaatctgcacatgtgccccttaatctaaaataaaagttgaaattatttaaaaaacgtttgaaatcggcaaaaacaaaagtttacttgatttataatttcttttattttttcaagagatatacaaccaataaccaccatcttattagtaagattttaatgttcaattctatatttcccttatgaaaagactaatgagaaaatgtataaccattattatattttaatctttggatgccaatattatatttaaatcaatgatatggctttaaatttagatcggttgagttgtctttgcagaagttatttgctatacagataaagtatatgttagaaccacaaattaaaagaaaatttctactttgacaatgtttagattagaaacagtatcgaatgttacatttctgtcttccagaatatttttttgtttactaaagtcaggacctaatcgtaatgaaaaaaaatcacatcttccctcaacttttccctggaggactatagttccgacttactttacttttcttaggactcaaaacttcacagcagaagaaataaggaacactcattagcccaaatccatttttccatatgaatataatctctgtcattttatgctcttttctttcctggtgttcaaatagttatttcacactttatcacatccgagtccttttaacttactgcatttcctctatccatggaatattttcatccttgtgtttctgtggtcacttgtcaatttgctttttttctttcagcttttcgctccctctgttcaaaacaatgcaactcctgaccagctgacaaccgcagtgccaagccaaagcagaggacactggtcggttctgtctgaggtggttctggtctccagtgagtctaatctttatgtcttacaagagacccaaatgaaaaccataatgagggcaaatgactaactgaaaaaattgtgactaacatgttttcataacacactgactgacaggaaaattactttgaaaaatgtggtctattttgatatacagtaccaactgtaatatctcataatttacaatccagagcaaaaaaactatcacaggaagctttctagttctgtgaacaaaatactttatttaacagtatatttttaaaattaatgactgtctaaatagagtggatcatggcagatgggaggcaggactagattgcagctccagacagagaagcatgtggaggcttgcattgtgagtttcagctctagatcaactgcaagaacaaaccagcaatctggagaggaaccacagatcctcggaaggaagtgaactgctcctgcgggattcgggagacaccccaaatactgtgagtgccccaactgtctaagtgggaaagggagaccctcctctcccgaacacacaccggagaagctgaaggtctgtttgtgggagaagtttccgactttacctaaagctgagtcaagttagagagccaagcgaaatacaggggtagagaaagcagcagaaaggccctgggagcttgccgggtcccaaagcagcccattcctgcctggcaccacagggatccctcagaagggtggccagaggagcagcaggtaaaactccacagggagaaggaattctctagctgaactttttaactatttgaatggggtgagaagccccgggggtggtgggggctgcaaatccgggttgcagacttcacaggcaggggaagaactaaagcacttttctttcacagctgggaggcggatagcctcgggcaagttttcaagcccgtctggcagcccgtcttgccctctgcctggaaacagactcagggctactggggggcacagcgggagagaaactggcccttctgtttgcgtgggagctgggtgaggcctgtgactgccggctttcccccactttcctgacaacttgcatgactcagcagagggagccataatctccctaggtacacaactccagtgagctgggaatctcacccccatcccccacagcagctacatcaagacccgcccaaagagaatctgagctcagacaggcctagctccttcccaacctgatggtccttccctatccaccctggtagcagaagacaaagggcatattatcttgggagttcaagggccccgcccaccactggtccctctccacactactacacctgatgctttctggaaggcaccacctcctgacaggaggccaaccagcgcaaaaacagagcattaaaccaccaaagctaagggccctcatggagctcactgcaccctccgccacctccaccggaacaggcactggtatccacagctgagagacccatagacggttcacatcacaggactctgtgcagacaatcctcagtaccagcctggagccagggagactcgctgggtggctagatccaggagagacaacaatcactgcagttcggctcacagggagtcacatccataggaaaagagggagagtactacaccaagagaacactctgtgggacaaaataatctgaacaacagccttcagtcctagaccttccctctgacagagcttacccaaataagaaggaaccagaaaaccaaccctggtaatatgacaaaacaaggctcttcaacatccccccaaaaatcacactagttcactagtaatggatccaaaccaagaagaaatctctgattacctgaaaaagaactcaggaggttagttactaagctaatgagggagggagcagagaaaggcgaagcccaatgcaaggaaatccaaaaaatgatacaagaagtgaatggagaaatattcatagaaatagatagcttaaagagaaaacaataaaaaattcaagaaactttggacacacttttagaaatgggaaatgccctggaaagtcccagcaatagaactgaacaagtagaagaaagaaactcagagctggaagacaaggtctttgaattaacctaatccaacaaagacaaagaaaaaagggtaagaaaatatgaacaaagcctccaagaagtctgggattatgttaaatgaccaaacctaagaataatcgctgtatctgaggaagaagataattctaaaagcctggaaaacatatttgggggaataattgaggaaaacatccccggccttgcaagagacctagacatccaaatacaagcagcacaaagaacacctggaaattcattgcaaaaagatcttcgcctaggcacattgtcatcaggttattcaaagttaagacgaaggaaagaatcttaagagctatgagacagaagcaacaggtaacctataaagaaaaacctatcagattaacagcagatttctcagcagaaactctacaaactagaagagactggagccctatcttcagcctcctcaaacgaaacaattatcagccaagaattttgtatccagtgaaactaaacatcatatatgaaagaaagatacagtcatttttcagacaaacaaatgctgaaagaatttgccattaccaaaccaccactacaagaactgctaaaaggagctctaaatcttgaaacaaatcctggaaacatatcaaaacagaacctctttaaagcataaatcacacgggacctacaaaacaaaaatacaagttaaaaagcaataacaaaaaacaaaaccaaagcccacaggcaacgaagagcacgatgaaagcaacagtacctcacatttcaatactaacattgaatgtaaatgacctgaatgctccacttaaaagatacagaactgaagaatggataagaactcaccaatcaactatctgctgccttcaggagactcacctaacatacataacgactcacataaacttaaggtaaaggggtggaaaaaggcatttcatgcaaatgaacaccagaagcgagcaggggtagctattctttttagttgtttttttttgttttgttttgtttgagatagagtcctgctctgacattcaggctggcatacagtggtgctatcttggcttactgcaacctctgcctctcaggttcaagtgattttcctgcctcagcttcccaagtagctgggattacaggcactcgccaccatgcctggctaatttttgtatttttagtagagacagggtttcaccatgttggcaaggctggtctcaaactcctgacttcaggtgatcctcctgccttggcctcccaaagtgctgggattacaggtgtgcgacaccacgcctggctgggtagctattcttatatcaggcaaaacaaactgtaaagcaacagtggttaaaaaagacaaagaggcacagtatataatggtaaaaggccttctccagcaggaaaatatcacaatcctaaacatatatgcatctaatactggagctcccaaatttataaaacaattactaatagacctaagaaatgagatagacagcaacacaataatagtgggggacgtcaatactccactggcagcattagacaggtcatcaagacagaaagtcaacaaagaaacaatggatttaaactacatcttggaacaaatggacttaatggatatatacagaacatttcatccaactaccacagaatacccattctattcaacagcacatggaactttctccaagatagaccatatcataggacataaaacaagcctcaataaatttaagaaaactgaaattttatcaagcactctctcaaaccacagtggaataaaacaggaaattgacgccaaaaggaaccttcaaaacctgcaaatacatggaatttaaataacctgctcctgaatgagcattcagtcaaaaatgaaatcaagatggaaattaaaaaattcttcaagctgaatgacaataatgacacaacctatcaaaacctctgggatacagcaaaggcggtgctaagaggaaagttcacagccctaaatgcctacatcaaaaagtctgaaagagcacaaacagacaatctaaggtcatacctcaaggaactagagaaacaagaacaaaccaaatctaaacccagcagaagaaaggaaataaccaggatcagagcagaactaaatgaaattgaaacaaaaaaaaattacaaaagataaatgaaacaaaaagctggttctttgaaaagataaataaaattgatagaccattagcaagattaaccaagaaaagaagacagaaaatccaaataatctcactaagaaatgaaactggagatattacacctgacaccactgaaatacaaaggatcattcaaggcaacacctttacgcacataaactagaaaacctagaagagattgatacattcctggaaaaatacaaccctcctagcttaaatcaggaagaattagataccctgaacagaccgataacaagcagcaaaattgaaatggtaattaaaaaattaccaacaaaaaaaagtcgaggaccagatggattcacagcagaattctatcagacattcaatgaaacaccagtaccaatccttttgacactattccacaagatacagaaagaaggaactctccctaatttattctatgaagccagcatcaccctaatacccaaaccaggaaaggacataaccaaaaaagaaaactacagactaatatccttgatgaacacagatgctaaaatccttaacaaaatactagctaaccaaatccaacaacatatcagaaagataatccaccatgatcaagtgggtttcataccagggatgcagggataatttaacatacaagccaataaatgtgatacaccacataaacaaaataaaaaacagaaatcaaatgatcatttcaatagatgcagacaaagcactggacaaaatttagcatccctttatgattaaagctctcagcagaactggcatacgagggacataccttaatgtaataaaagccatctataacaaacccacagtcaccataatactgaattgggaaaagttgaaagcattccctctgagaactggaacaagtgcccactctcaccactccttttcaacatagtactggaagtcctagccagaacaatcagacaagagaaagaaataaagggcatctaaatcggtaaagaggaagtaaaactgtcactgtttgctgacggttataatcatttaccttgaaaaccccaaggactcctctagaaagctcctagaactgataaaagaattcagcaaagtttccggatctgagattaatgtacacaaatcagaagctcttcaataaaccaacagcgaccaagcagagaaccaaatcaagaactcaacccctttacaatagctgcaaaaaagttaaaatccttagtaatatatttaacaaaggagtccaaagaccgctacatggaaaactacaaaacactgctgaaaaaaatcacagacaatgcaaacaaatggaaacacatcccatgctcatggatgggtagaaccagtattgtgaaaatgaccataccactgaaagcaatctacaaattcaatgcaatcctcatcggaataccatcatcattcttcacagaattagaaaaaacaattctaaaattcatatggaactaaaaaagagcccgcatagccaaagcaagactaagcaaaaagaacaaatttagaggcatcacactacctgatttcaaactatactataaggccatagtcaccaaaacagcatggtactggtataaaaacatagaccaatggaacagaatagagaacccagaaatagacctaaatacttacagccaactgatctttgacaaagcaaacaaaaacataaagtggggaaaggacatccttttcaacaaatggtgctgggataattggttagccacatgtaggagaatgaaactggatcctcatctctcaccttatacaaaaatcaactcaatatggattaaggacttaaaacctaggacctgaaactataagaattctagaacattggaaaaacccttctagacattggcttaggcaaggatttcatgaccaagaacccaaaagcaaatgcaataaaaacaaagatgaataactgggacctaattaatgagcttttgcacagcaaaaggaacagtcagcagagtaaacagacaacccacagagtgggagaaaatcttcacaatctatatacatctgacaaaagacgactatccagaatctacaacaaactcaaacaaatcagtaagaaaaaaacaatcccatccaaaagtgggctaaggacacgaatagacaattctcaaaagaaggtatacaaatagccaataaacatatgaaaaaatgctcaacatcactaatgatcagggaaatgcagatcaaagccacagcgcgataccatcttacttctgcaagaatggccataatcaaaagataaaaaaacagtagatgttggagtggatgtggtaacagggaacacttctacactgctgttgggaatgtaaactagtacagctactatggaaaatgatgtggagattccttaaagaactaaaagtagaattaccatttgatccagcaatcacactacggggtttcacccagaggaaaagaagtcattcttcgaaaaagatacttgcacatgcatgtttacagcagcacaattcacaattgcaaaatcacggaagtaacccaaatgcccatcaatgagtggataaagaaactgtgccaaatatatatatatatatacatatgcatacatacacatacacacacacacgtacacgatggaatactgtgcagccatgaaaaggaatgaattaacagcatttgcagtaacctggatgagataggagactattattctaagtgatgtaactcagggatggaaaaccaaacattgtatgttctcactgatacgtgggagctaagctatgaggacgcaaagacataagaatgatacaataaattttggggacttggggtgaagagtgggagggaggcgagggataaaagactacaaatatggtgcagtatatactgcttgggtgatgagtgcaccaaaatctcacaaatcaacactaaagagctcactcacgtaaccacgtaacacccgtaccccaataacttacggaaaaataaataaataaataaaattaatgactgtctaaataaatatacttacttacatttttgaatagttgctcagcaagttccctgacatgctttatcatcttcactgggttattttcttcaactttaattctctctacttcaaaggctaccaactaggaaaaagaatcaaatggcaaaacatcaattccaaaatatgccaaattcaaaaactgtgataatttcatacaatttgcaagccaaaaaaatccaacatatacattatttttaaaacaaaatatttcaggttttggggtttcacctccattctggggttacagggtcaatcaaacccttgaattgtctagtggttcctccctgaggatttagggccctatttcttctagggaaaagtcatttctggaactcagagagaccctgtcattccacaggcctcagtcagagaaattcagacagtcagaaagtgtctaaacatttccttaactcacaaaacatgaaccaaatgttcaagtcaggatgctcagactctagtcctagctctgctgacagtgtgtgatctgggacaaggcacttaaactcctaagcttcagttttctcatctctaaaataagatggaagaacaagatgacccttagactccttctagttctcaaactatctctttattaactaatttactgggagaactgtgtgagtctgtatacttaggggtaaagaaaagaaggctgacagaaaaaaaaaattgtgggggggtaaatagatggatgacaaaaataaaaaggtacaatacaggattcttctaggaactaatagactcactgcataggcatataaaactatggcttacctattctaggctaggataaagaaagactgtcaagggcaaacattcttttcattctaagacatctatctgatggaagtgtgaggacaaggccatgcacaatgcaagctgcctctcaaagcccccataacaccccattgtggtaggctgcctcaggctaagtgaaaacaaggatcactttcccaggagcaaatgctatttttctaccaaagcattcccatgcaaacggccaaagagggtagaatgagaaattatttagttctgatggctcatttttcttaggctcttgactgatacatacatatgattagctggcagtcaagtaacataagtaagacacccaaagtcaccactgtaggccaaacagagaactggatgaacactaaggggtgactcagtaggaaccttggacagagtccttgccttatcattgtttccaatctagactatatttgtacaaacaataaataaataaaaaataagttaccatataaagttagagacaaaatgaagcctaacgcagtcgagtggctctcagagtcaacgactttgggagagtttggaagagatggtgagataagagcagagtatgaagaacagaggagggcactccaagcaagggaaagacctacaaaaatagaggctgtggcaagcaagttttctgcaagtaactaatctcactttttagttgtgatgaagctgtcagaggaagataaatttgaatagaaaagaaagagtatataaaccaatgttactattcataaagcttcaaagactaacaaaatgtaggtgctagaaaagaccttggagagcatctattttaatcccataaaatattatgttatgaattacttagtacagaatctaaaggctgatatgttagtagaatcaataaccaatcatattagatggtaatattagagaatcaatgaccaataattgattagaaaaacttgtccacctcaggatgtttcctaaatcttcatatgctttgtgtttttaattaaagcatctgatgcagtaaacatattctacacagaactaaaatatgtgcctcttctttaaaaattcttacctgtgaatacttcactatctttacaaaaaataaaagatccttctcctctgaaccaaagatatttaagaccttgattcctaccttctctatataaaagaaaatcaccagaagcaaaacatgatcactgccacgattctccaatatcttgggttctaggagtgttgttcttttatagatttcaagaaactttttacatttttggttctaatatagtactctttcaaaaattgaaatgagaataatattcttgttctatccaccagagtgggctgctgtgaatatagagttaaatgataaaaggaaagatgcttttaaaaaagagcacaataaatgcaaaacagcatccttattttgagtcacatctgccctatttctccctttatatggctaattccttgaagatagagacaaaaatttgtcttccatatatttaatgtctcctaagacaggtagagaaatgttgataattgattagtgagaatgccacaaacttaaactatggctctatgattttgatagactaaatgtaactccagtttgaagtaatttcagctatcttagcttcaaattagacctttctccctaaaacactgacaaaagaattactgtattagggcctttaaaaataagacttctatttatacaatcactattaaattttcaaaaatattttaaacaaccattttttaaaatgtaatattttaaaatatgagtagcttttggagtatgagtggttttcggttacatggatgaattacatagtggcgaattctgagattttagtgcactcatcacctgagtagtatacattgttcaattatttaaaattcagttgttcaaaaattatatgtatttccaaggcatcttataattttttgtaatttttataatccacattaaaatatcgagatttgataagcataataaataacattgggattatttaatacctaatttatatttgactatataaatatggaaaatgttactttttacttttaactactagtctaattatgtctataaataatgccttcatttaataagagctatacctcatcaaagagatcacaagatctataaggaggacctctttctgaaacaaaacctgcaaatgccattccactgagtactttagtgaggaaatcattctcgaccaaaccacgctgccccaagaatgctgtctgtgaaaaaagaaaatgtgaaataataatttatcacttggtaacggacaaatggtcaaaacagaaatacaataaaaagatcaaagcctatataaatcccttcatgtataaatatatgctgtcataaaatatatttctctcaaagagagttattctgaaatactacatatattgaaaagaataaaaatgaatctgtctacatgtcaggagaagaaatcagaaattaacattcaattttaaaagaaaaattgatttaaagttaacatattctaagatattatgagttccatattattattaagaactgatatctaaccacacagagattttaaataatcacatttgataaatcaaggtcaaaataaatggctcggaaaaaaaaccaagtagttttattaaattagaatatattttttggacagatacaatatagtactctatcttaccttgtggaaatgtattactggctctgcatgaattcttataagttgcaggcaggatctatatccttggaagagttgtgcaaataatctaaggaaaacggctcgcacctctttatcctaaaaatataagaagaaatgttaggtaatttaactttttaaaaacaaatgaaatatcaagtcaaaaaggtgaaaagggcatatattccaagtcctttgatttttatatccaccaaaacaattacagtcacaaccaaacataagaagaaaaaactctcaagattgtatttaatccagcttttattggaatcacagtttagaactgtaaggaaacttacagattctgttagtcaatgccttacttaattgatcaggaaatgaaggtcaagaatgcttaagtatatgtgttcagctccctgaggttccttattggctacaaagcccactgctaagaaatgcactgagcaaaataaaaaaggggcctctgttatatacgtaaccttttatggcttctaattgaaactattttcatccacagactcttcaaacttgattctctcctataaccaacattctttatatccattcttgtaagcatctcttttgttttgaatccttgtgtggccatttcaatttgatgcttggcacagttttccaggctataatctaggctctgattttctgtcctacacttaactcatgcctcctcagggcaacagtcttagccctagtggcctcttgcccagtgaacttccctgtggctcctccttgagcaggacataaggacagtcagcggcaagtatcctaatttctaatttggggcactttttactctgctgtccatctaactctaacttcacttagcttctttaacaaccctataaataaaaatacagctctctttaacagcattaaatttaaatattaaacttcttaccagcatttttgagtgggataaagctgttcgtggaggaggaaaagcatgatctgctacttccaaatctgggtgtaaaatctaaagcaaaaaagttttgttatgtaaaatatcataatatcaatgaaatctattattgagacattaagatgaaaatgtcagcatatgaattataatatattccctccatgaatacaattcaattagctggggtagttctatatgtactattgtagaaagatctccaagacaaaatattcagttgaaacatgttcggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccgggcgtggtggtgggcgcctgtagtcccagctacttgggaggctgaggcaggagaatggcgtgaacccgggaggcggagcttgcagtgagccgagattgcgccactgcactccagcctgggcgacagagcgagactccatctcaaaaaaaaaaaaagaaaagaaaacatgttctagaaaaatacacatagtatggcctaatttatttgaaaataaaacaaaataaaccctaaatctatatatgtacatatatatatatatatgaaaatgaaaagttctgaaaaaaatacactaaactataaaatagtagtcatttctggtaagggaataatctaggccagagctatttgtctatatagttgaatttttaaaaacagctgcttgtttttatgtttctaagtgtaattaaaaattactgaggagaggccaggtgcagtggctcacgcctgtaatcccaacactttgggagggcaacgtgggtggatcacttcaggtcaggaatttgaaaccagcctggccaacatggtaaaaccctgtctctactcaaaatacaaaaattagccaggcatggtggcacatgcctgtagtcccagctacttgggagtctgaggcaggagaatagcttgaccctgggaggcagaggttgcagtgagctgagatcgcaccactgcactccagcctgggcgacagttataacaagactctgtctcaaaaaaaaaaaaataaaaattactgaggagacagaaaataagattttgaactttgcagtctagacaggtgaaagtataaaactatgtcacagaagtgcaaaaatatataaagtgcaatacatgaaatgtgtaattaattcaacttagggaagactaaacaaaaaacaaagtaacatttgagttaggctttgaaggaaagcaggttggggagcatctgggaaagaaggacctgtgaaggacttgcacagagaagatgaaattatatcagtatgtagcaaattttcttcttgcagaatcattttcaactactaagatttttgatgctatgctgagaatagaccaaaagactcaaagcaacacttaaaggcaacactaaaatattggcagttcaagtcactgaatcactaccacagtacaaaatatcttagtgtctacaaaataatccatattacacagtttaagtacagtgttgccatttgattataattatttacgaatgaaacaaagcttatatacttgtgtgtcaatgctcccaatcatccatgaaatttagtctctttttggtctagtttgacaatacattatgctcctatttctttttttcttttctttttttttttttattttgagacagagttttgctgttgttgtccaggctggagtgcaacggcgtgatctcggctcactgcgacctccgcctcctgggttcaagtgagcctcctgtctcacctcctgagtagctgggattacaggtgtgcaccaccacacccggctaattttttgtcttttttttttttttggtagagacggggtttcaccatgttggtcaggctggtctcgaactcctgacctcagatgatccgcccgcctcagtcttccaaagtgttgggattacacgcatgagccaccgcacccggccgtatgctcctatttcttattcacagtacattaagtagtatctaatccaccactgtgcttagtaactataacaatacgtatactcagttttaccaaaaaggaattttacacattgatcaaatttggtggcacgggtgttgcaggtttaggtatacgagtatgcagcagaacccttaccaggagccattggcttaagaagtacaatcttaatctttgttaattttgctacttaacccctaaataactattcatatcactagtaagtaaccacacataagatttaatcactgtaggaattctagaaacattaaactttcttcagtcattcaaatactaccttctcagcttttgctatatccatataccatctatgcaattatgtagttaatatttttctttaaattgtctttaaatcaactcaccttctttttttgtttattttgttttttgagatggagtcgagctctgtcacccaggctggagtgcagtggcgcagtcttggctcactgcaacctccgcctcccaggttcatgctattctcctgcctcagcctcctgagtagctgggattacaggcgtgcgccaccacgcccagctaatttttgtatttttagtagagatgggggtttcaccatgttggacaggctggtctcgaactcctgacctcgtgatctgcctgcctcggcctcccaaagtgctgggattacaggcgtgagccaccgcaccctgccaaactcgccttcttaaacccagtattttcttagatgatagttgagcaatgacaggttctatatgctattttaagtacacattataataaaaacataattattaaaataaaaaaggttgaccacatattaccccaaatcatcaccatgcttcattttggcaaacaatcacctagtcatctctgtaaaaacattcaacctacaggtaaagaccaggagacagcctagagataaaaatgtgattctcaataataccaagtggcagaacacagactggaattcaggtatcctgtatcccacactagtgtcttttgcactctatcacatcttgcatttcagattacaaattatataaggaaaagtcagtcttctctaactgttcccatttcatagataccaccatgataacaaaaagactaacacaaatttgaaagttttctgagaataaaatccctcctggtaatcctaggcttctaagtttctatttaagaggggaaaaaatgttttaaatagcccagaataaaatattcttaaagtagactattaaggccttagttctagtgatatcttgaaaagcaatgcagaatttctacagttcaattttctgatcataagcacctaaaaggctatcagtaaaacaaaatactgttttcaaaatttggctaaggtaaaataactgcaaaaaaatttaaatttgtttcaatgagaaaaacccaagccacaagattttttaaagctttatttggcttgaatgtagcatatacttcttctttggtatttctattcatatggcattaagaatggaatgttgggccgggcgcggtggctcacgcctgtaatcccagcactttgggaggccaaagcgggcagatcacgagatcaggagatcgagaccatcctgactaacacagtgaaaccctgtctctactaaaaatacaaaaaattagccgggcgtggtggcgggcgcctgcagtcccagctactcgggaggctgaggcaggagaatggtgtgaacccgggaggcggagcttgcagtgagcccagatcgtgccactgcactccagcctgggcgacagagcaagactccgtctcaaaaaaaaagaatgaattttggacactttatgtatcaatatgacacatctttctgtaataacctgaaagtattggcaagacaatattacagtgttttgtaggtaccaaagaggaatgagatgccaatagggaggttagagaagagaagccaacatctaatgggggatcttaggggaatcagggatttcaaggcagagccttgttttcaaaggtgaatttccaatacctaggacagtactaggtcctgtatgctgaatgaaggaaggaatgtagaacaaatattcagttaggatccaaaatatatgctttagataactacctagtaaatgaagaattctaaatactgtatgagattatgttcatgtttcaaatatatagctctctttaaattaaagtaacaaactgcattgacaaacatttttaattttagctatcttagcttcagatttaaataaagagaaagttactattacaaaaatatgtcataccaaagaaagagctgattgagtctgatgtagaagtggttctgggagggaagagaggtgaatacattcgggaattttaatagtgcctccatccaaatctgctatgattacatctaactgaaagagataaaaaaattaacctataattaccaaaatacatttgttgttaagcaaattatttttcccttgactaattcaaaacgagaagaatcagatgtggaagagactcttgtttgtccatagtagtagaattctgggctaacaagttcccacctaccctgtatttcccaggttcctttgaaattaagtgtggcatgtggctaagattctgccaataaaacatgagaagtgacatgtgttttcctgtccttcaagacaggggatatgtaaagctctcctatgctgtctttccttttcccttagactgaaattattaactggcagcaaaccagccttcagcatacacatgatgacaatgcctgggaggattctgttggagaaacaagaaggaaggaaacttggatcttgagtgacttcatagagcaaactggtctggcataatggaacatctctatggactgctgcatgaatgttcgataacactttattttgtttgagccattgcattttgttctgattttactatatatgctgctgcagcaagcacagaggattgcatttgagacactttattcaagtagtttagtaatattctaaaaaaattagtatttattataagaattaacaattagtatacatcaaaagggtgctgtttagccacttagaaaaagctgatctttagcattttacaaaagtctatttaaaaataacttacataaaagtgtaagagaaaacaaccaagatgagtgaagttgttatattgacaatattatacttcattctaatttattcattacgattttaagaaatttgcatttggcaacacttggtttgtcctacctccagcgactgtttttatttatttggcaacacttggttggtcctacctccagtgactgtatgtatgtatgtatgtatgtatgtatgtatgtatgtatgtatgtatgtatttatttttgagacagagtcttactctcgcccaggctggagtatagtggtgcaatcttgactcactgcaacctccacctcccaggttcaagtgattctcctgcctcaccctcctgagtagctgggattacaggcatgcaccaccacacccagctaattttttgtagttttagtagagacagggtttctccatgttggccagggtggtctcaaactcctgacctcaggtgatccgcctgccttggcctcccgaagtgctaggattacaggtgtgggccaccgtgcctggcctccagtgactgtttatatttagcagaaataaaattatgtacaaaccaggtggatatgcttctaactagtattaattaggttttattaaatgtttattgatttacacatatttttatacagtgataccaaaattaaataggaactaagtatcaacatataaagttagaaagaatgatgactatacgaatgaaagtcctgcttataattataatgttaaataatattttgttagtttaaatgacacctctgatttggttacaactataattacttctttgctggcatttaaaactaaaacagaagaagaattacaaaatcttagggatctgtggatcatagatgctatgcagcctaactttacagtgaagaatttttctcaggctctctgaaaagtgtcacataatcttttccttacactctacttacagtgcttgagagtacactcctcatctcacataaggaaatccattccataaccaggcagttctaattgttggaaacacttttactgggcagaaatctgtttctatagccacttcatccactgattttatttcagccttttagagttacaaaaaatgaatctcaacccttcttctatgacagtaacttaaatacttacttttacctatcaaatagtatcagattattacctgagaaaatttccttaggcccttacagaacatagtttctaaatacttgataatcctggatgtccttttctgatgtgctttattttgttacagtccctcataaagtgtgatacacagaactaaatgaattattccagaactggcttgaatatagagtatacttttgcttcttctattcatatggcattaagaatacaaaaatttcgtggaagctcataccaaacttctgttccactaaaactcttcactcttttgcatatgctttctgctttgttagttatcaggaatttggtatcaagacacgtctcacttcaaaatataaaacaattatgcactaatatcaaaagtataaatagaattttatcttttgtcatatgtaagatgaataataaagataaacaatgtaccaaaagagggatatttaaaaatattaataaattcctttataaaacctcctatacttgctatatggcaaaattaatatacagacttttcaatgatatttttcttctatccaatcttttctactggaaatgctacagatctgaaaatagtgatgagttgaaatgttataggacccaaagaaatatgataaacttctggactcaataactggaaactttaaagatgaatacttacaagttcatggacatcagttttaaagacagaatgtactccaataatgaaaggcgttggggaacttagaacttccagtagctgagccgggagaatagggatataaggataactggaaataataaaaatatgcgtcaaatatatttttctttaacataaacatatcttctttcatctttatgctgtgttaagttttatattacctatgtttagaaattatcaataatgttttcatgctttttaatactaaaattttggaaaaaatgatttaaaaatcttcatgtgaaagatacaatcagatataagacataaaataaatggaatccaagcctgcttccttaacctttgtttcttctaggcaagcagtctctttaggtcttctagtactgtttgaaagcatttttccttacatagaaacccgacattagacagtaacactgactctctgatagggcctcccctctcagtatgaggcaatgatttatctatacaaaacaagcattcaaattccactttctatacttgatttttgcattcaataagaatggcaaaaaaaaggggggggccaataattaccttatctaaaaagttaagaaaagcacctaaattaaaaataaattttttttttttttgagatggagtctcacgctgtcgcccaggctggagtgtagtggtgcgatctcggctcactgcaagctccgcctccagggttcacaccattctcctgccttagcctccccagtagctgggactacaggcgcctgccaccatgcccggctagctttttctatttttttagtacagacggggtttcaccgtgttagccaggatggtatggatctcttgacctcgtgatccacccgcctcggcctaccaaagtgctgggattacaggtgtgagccactgcgcctggccaaaaaaatttttttaaagaaattctggagtctaaaattttatctagtttatatgaactaatttcccagatgttatgattatcaattgattaaacagtatattagaggtataatattctagttacagcactattagtcatcactgtttagattttattttgttttttagtttttattaggaaaaaaattttaacatatcccataaaaaaaacagaggaaaaaattacaacgaagccctgcagtaattgtcaactttgagaattaccagtgcacggctacatatatatttctacccactttttttctctctactgtattattctcaagcaaataccagatgtcatattgtttacccatataatacacttcagtgggtatctaagagagataagagctttttattaatagaatctctatcattataacttctaaaaattaataattctttaatatcaaatagcattgactagacatttatgccaattgtgttaaaagttgctgacaatactattcaaattaaatatttttacactaatcaacattcagtaatggacaacttggaaagtctcaaattctagactagattttatcagaactatgactcatataacagcataactttgtaaaatatccctatgtggttcaaaaccattgtgccataacattatgacttatcaacgataagtgatatgtagtttaggaataaataaaattaacaaatgaaaacctcacctatatttaagaggaaacattaaagattccagggctctacaagcatcactaagtctctggaaacttgcagaatggaagagaaccttattttctgtgaggactgcacaaaagaggctgaggacattttgaattcctgaaaacataagagcaaggacttacaaatgcatttaattttatatgtgttgtcaacaatcatagacagtatacacggaaagaaaaagccagtaattttggactctctgaaggaaaatacttggttaaactgtaaattccatataatctatgagtatttgttttcccaaactttcagttttgcctttattcttcaaatcaggtaacactcattgaacatattagttgtttggaaacactattaccttcttttcaatttcatctctaaggcctgtatttaggttcctgttttagaatgctagcattgttctaaaaactaacccctgcagagtctgtttgtctgacgttaataataccacaccagctttgttgttgaaatttgcctactatatcttttctcatcttttaatttcaacctttctctacttcttgtaaacagcatacacaaatgctccgcaatttaatgatagggttacgtcctaataaacccattgtaaagttgaaaaatcttaaattgaacataaatcagagactgtaactgaaatatttttaatccagtctgacaacttttgtcttttaactatttcatttaatccatctatacttattgtaattattgagatatacactatatatagagataaatgtggtatcttattttatgctttttctttttcttttttctttttttttttttgagacggagccttgctctgtcatcgaggttggagtgcagtggcacgatctcagctcactgcaagctctgcctcccgggttcatgacattctcctgcctcagcctcctgagtagctgggattacaggcgcccgccaccatgcccagctaattttttctatttttagtagagacggggtttcaccgtgttaagcaggatggtcttgctctcctgacttggtgatacacctgcctcggcctcccaaagtgctgggattacaggtgtgagccaccgcgcctggcctggtttttattttttctatcttctcttttttccttcttttcaatttctcctgtctcttctttcatcccctctgttagtatggtatttataaactctttttctatttttttagtggcaactctagaaaatacgatatacatacttatgaaattgaagttatatatatcatttcttattttctcctgtttattactgaaccaaattatctttctttatatcacttcaactttaatcatacacacccggtaaagcaagagtccccatttgttttctcaaggtaaaatactatattttccctttatcatagcttatttcttcatgtgacatgcaaatttccttagtctattattaattgctattccctcttatcacttccaacttatcccatgtgatacatcagaatttttagttcagattttaatcttcattcattttcactaatgtaatagtttcgtaagtgattttcctaatccagtccttattcccttcaaatctaccctccagatagtttctagaataatggaaaaaaactaaataatgattaaagaaatctaaatacaattttcaagtggtttttaaaattcatattaaatccacaagaataaatgctacaaattttgcaaaaaatattcttttggctttaacatgaattttaaaaacccactaaggttttggtacacttaaacaacagtggaaatgaatgagctagtattgtatgtattatcatgactaactctcccaagtataatattgagtgagggtagtaaggtgcacaatgattatatagctgtgaaaagaaaataaatctcaggacccccaaaccaccaagccaaagggaagtcaagctaggaactgcaccaggaaaaccaacctccattttattcctaagtaagatagctacaaaaattaaaaaaaaaaaaaaaaaaaaacaaactacatacctcccatacctccctcacaacctgcccacaaggaaattccttgtggacaaaggacagacaaaactcaaagtcatccctgtactcctgtgagacaaatgcatatctgatttcttcctctgccctattgtttcactaagccagactaaagcttaagtgactattcctctatcttcctctcacatgtaaattgtgtattcagtaaaaggctaatcagagactcaaaagaatgcaaccttttgtctcttatatacctatgacctggaagccccctcccctgctttgagctgtcccgtctttccagacccaaccaatgtacatcttatgcatattgactgatgtctcactgttacagcaggtagctagccagacatgagcagggaaggagaggatcccccacccccatgccaccaccaggaatgtcaggcaaccatcaggtgatggtcaggtgattattaaactgtctctctaaaataataattggtcatagctgatgccacagaaaggcagtcttccaacagacagaaacatcagaaactggtgatcagcagcttcctgataaaatctcaggagttggcgagcgggctcatgcctgtgtagttaagaggcaaaatggcagagtttaactggtatatgaccctctaggaacatttggactggtaaaggaagaaagcctccagtgagcatgcgtacaattccagtaaacacactgcacatgtgccccctaccaaatgctgacaggcctttgtgcatgcggagtgcccaccccaagggaagaatctggggaggagagatgcaagaccccggacacatgacaacatataaaatcccgagtcaaagctcaaacagtgcacttgatctctcaagttgtctgcttggccctcttccaagtgtactttacttcctttcattcctgctctaatactttaaaataaactttcactcctgctctaaaatttgccttggtctctcactctgccttatgctccttggttgaattctttcttctgaagaagcaagaattgagattgctgcagacctctatggatttgctgtcggtaacatactttggtgctgtgatttggatacattccctaatgttaacatactttggtgccacgtgactcaaatatgcttcctcagtggtaagacatctctatgcctcaacttctttggctggaggtgtttaacccctgtacacagtttcgtttgctcttttcattcttctgcttactaaccaacccccagaacaattcttctcggccacagtggctctgttcctcaagctcatctctcagctcctgctgatgtacggtagctcacaggggtaggaaggaccttggagtccttcccaggtaagatcattgacctgagacacaatggctctcctagacaagaggttcatgagagtggtagggctaaagcctaaaaccatgcaatgtctggggtttcctctgctttttcaactcaaattggctcttttccaaaaacccacaccacctattctcctgttttctctgtatgtattctgaaatggccttgtacaccctccggaccgtccacctcgaggcaagtcagcctcttttgctttcactttgcatgccatgtaactgttatttgtacaccctcagctcttgctgaatttgtgcagcagcaaaaacatgggctcccttgtggctatctagagacttaacactagtttttaccttaccagctcagatgacctctaatcctgcctctgtctgttggtacattgccaggacagacactaattggatccccagtcagctccttatgacttaccatatgctttttgttcctgttacggtccagggctgagttttccggtggcttttgaagtagttttccacccacatagggcctcattctagccctttaaggaccccacttacttgctttttttgagttagcaccccttcgggaggaggggaaattcttcctttcccatttgtgagttcctacatcaagccctaagtcctccagaggttaccactttatgttaagaagacaaataaatgttaccctctcaaatccaagggatgctgtttttggaagcataagaaggctttccatgattattcctctggcttcctcccacttcctcctggagcttccatttctctaatcacttccatgcccttctcaatattgatcaaaatcttcaaggtcatatttgaagggagggaagttcagcccccttgcagcagttagctgaaaatcaagcttcttgtctagttagagaacaaaggaaatgggaatctgagaaaagggataatcattttgttgcaagaatgctccaagttgagagtcactggaaggtcatggaggcaagaatataggatggcccaaggccgtcggcacaagagacccatacgacagacatgaaggctggtctcgggttaacagattatcattataacagagatgaaggcaaggttaagggtacgtggtaagaccagttcattctggaaccgcacggatgaacaggagagggctctctgttctctctggtatctcctctgtgaaaagggcgtaccgaagttaagggtacatggtaagatcagctcattccagaaccctaaggacaaataggggatgccctattcaggataataggaagagaagacgctttcttttttctttttttctcatctattctctcttcacagatgggtaactgcatcttcataccacagaacacgcccctcagatgcattctcaagaactgggaaaagtttgactccaaaaccctaaaaagggaaaggctaatatttttctgtaacacagactgaattgaatacaagctccacgaccaggaatcttggacagaaaaccaaaattttaatatgatctatcaactagatttactttgccgccagcagggaatatggatagaaatcccctatgtacaggccttcatagccctatgaaacaaccctgacctttgttgggcttgtaaaatggatctagtgatgatagctgccatagtcaggcagccccctctggctggttcgggacactccttattgggtttaccctggtttcaagccccagaggagcaaaagatgacggctcaaaccccactgccccttctacctcattatattcaagtctcccaggcccggagcccctccatatccagggctatcctctggacaccaccctcttaggtcacgcccccttcaagaggtcagtagccccagtggacccactagaaaccagactccattcactatgtaaggcctgagccaaattacaacagaactatgggactttatggaggaccctgacaaatacatcaaagggttctgtaaactgggattaacatttgaactcacttggagggatttctcagtcatactagggcaaattctgtctaagggagaaagtgattccattatggaggtggcccaacaatttgcaaatccaatgcatatgactgacccgggtggctaccctgtaggagccatcacagttcctccggttgactccaattgggattacaatacccagggaggtatatggggaagaaaccgcatgttcctctggtagaagggataaaagctagcagaacaaaggctgtgaactataatacaatggccttaatagatcaaggccctcttgaaaaccccatcactttcacagagaggctacaagaggccctagtgaaacatactaacctagacccagagacatcagaagggcaactggtcctacaggaccgtttcctaactcaggcagccccagatattcagaggaaactccaaaagctagcactgggccccaatacccctatgcctgatgttctcaaaacagttgccttggtcttttacatcaaggaccagaaggaagaagaaagggctcaggaaaaggagaggcaaacggaaaagtggcagctccaactattggctgtcttacaagtccaccagctccctccaatttgccctaggaatatcttcccaaataattgcattggtatgagaagccaggccactggaaggccaactgcatcaatgggacagatgggaaaaagccttgcatggcttgccccctccaccacaagcttggcaactggaaataggactgccctgagggctggagggctcctgggagagaatcctttgtcttgagctgaggggggcctacagtccagctggctcccagatcaaacatcactattgaagggacagagccaaggaatgctttgcatgtggcaggtaggactataagttttcttttggacactggagcagccttctcaatgcttacctcttttcctgggcaattatcctccaaatcctgccagataatggggataaatgcggtgcacataaccaggaggtttactcctcctttgtgctgcctatctgggggaactgtcttttctcactcatttttagtgttgctagaatgtcccatagcccttttgggtagagatattttatttagactagaggctccagggcagacatcccctttttgaactgcgatcttatgcctcaaggaaaccacacacaagggtgaactgcccatggactgtctcattaatccagaggtctggatatgttcctattgtcatatataacatttaaatatgttacaacggcaaaacagttaaacttattgctttctatatatttttatttattatactttaagttctgggatacatgtgcagaacgtgaaggtttgccaaataggtatacctgtgccatggtggtttgctgcacccatcaacctgtcatctacattaggtatttctcctaatgctgtcccttccctaccctccccaccccctgacaggccctggtgtgtgatgttcccctccctgtgtccatgtgttctcattgttcaactcccacttatgagtgagaacatgcggtgtttggttttctgttcctgtattagtttgctgagaatgatggtttccagcttcatccatgtctctgcaaaggacatgaactcatccttttttatagctgcatagtattccatggtgtatatgtgccacattttctttatccagtctatcattgatggacatttgggtgggttccaagtctttgctattgtgaacagtgctgcaataaacatacgtgtgcatgtgtctttacagaatgatttataatcctttggctatatacccagtaatgggattgctgggtcaaatggtatttctggttctagatactggaggatcatcacactgtcttccacaatggttgaactaatttacactcccaacaagagtgtaaaagaattcctatttttccacatcctctccagcatctgttgtttcctttttaatgactgccattgtagctggcatgacatggtatctcattgtggttttgatttgcgtttctctgatgatcagtgatgatgagctttttttcatgtttcttggacacataaatgccttcctttgagaagtgtctgttcatatctttcacccactttttgatgaggttgtttttttcttgtaaatttgagttccttgtagattctggatattagccctttgtcagatggatagattggaaatattttctcgcattctgtaggttgcctgtcactctgctgatagtttcttttgctgtgaagaagctctttagtttaattagatcccatttgtctattttggtttttgttgccattgcttttggtgttttagacatgaagtctttgcccatgcctatgtattggtattgcctagatcttcttctagggttttaatggttttaagtcttacatttaagtttttaaggcatcttgagttaatttttttaaaaggtttaagaaaggggttgagtttcagttttttgcatatggctagccagttttcccaacaccatttattaaatagggaatccttcctccattgcttgtttttgtcaggtttgtcaaagatcagatggttgtagatgtatggtgttatttctgaggcctctgttctgtcccattggtctatgtatctgttttggtaccagtaccatgctgttttggttactgtagtcttgtagtatagtttgaggtcaggtagcatgatgtctccagctttgttctttttgcttaggactgtcttggctatacaggctcttctttggtttcatttgaaatttaaagtagttttttctaattttctgaaaaaagtcaatggtagcttgatggggatagcattgaatctataaattactttgggcagtatggccattttcacgatattgattcttcctatccattagcatggaatgtttttccatttgtttttgtcctctcctatgtccttgagcagtggtttgtagttctccttgaagaggtccttcacatcccttgtaagttgtattcctaggtattttattctctttgtaacaattgtgaatgggagttcactcatgatttggctgtttgtctattagtggtgtataggaatgcttgagattcctttatgcttttttaaaaactaagagaagaaataaaaaaatacacatatagtctatttacccacagatttcccatttctagtgttgtttgttcgtgtgaaatcgaattattaactagtctctttttcctgcagtcttaaggatttccttttgtttttattttttattgtttttttgagacatagtctcactccatcacccaggctggagtatagtggtgcgatcttggctcactgcaacctctgcctcccaggtttaaatgatccttccaccttagcctctcaagtagctgggaccataggtgtacaccaccacatctggataatttttgtatttctctgtaaacatggggtttcgccatgttggttgtgaactcctgggctcaagtgatccacccacctcagcctcccaaagtgttaggatttcaggcgtgagccaccacgcctggccttccttttgtatttcttatagagcaggtctactagcgataaatctgtttttgtttacttggaaatgtcttcattttatctttgtttctgaaagacagttttgccagtgacagaattcttgtttggtatttttttctttcagtgcttttaatatgtcacatcaatgccttctggctcccgttctttctgttgagagacccgctgcaataatattatagttctattgattcatatagatgaattattttctcttgctgttctcaagggtttgcctttcaccagtttcacaatcatgctgtgtctacatggggatttttttactgttaacttgggcttcattgtgcttcttgggtctacaggttaatgatttcaacaaattttgctaagtttttgagcattatttcttcaaatacgtttttctaatcacccccatatgcatccaatggagatgctctgtacctaaaaggtattattgtctcaaaggtctctgagaatctgttatttttatttcaatctttttctctatgttttttatattggatcatttctattggtctttcaccaaattttattgatttttatttctgacatctcaaatgtgctgttaagctcagctagtgaattttttgtttcagttatttattttgagaaagggtcttactctgttgctcaggctgtagtgcagtggcataatcacagctcactgcagccccagccttctgggctcaagcgatcctcctacctcagcttcctgcatagctgggactaaggggtgcaccatcacacctggctagttttttattttgtagagatgagttctcactatgtttctcaggccggtcctgaacttctgggcttaagagctcctcctgcctcagcctcccaaagtactgggattacaggtatgagccacgatgcctggcctgtttcagttatcatactgttcaatctataatatctatttggctctttttcagtttttacttcactactgaaattgcctaggtttttgaccactgtcattatattttgtcttaattctttcaatatggctaccattaattcttttagcatatttataacagctgatttaaagtccttatctgctaaatccagtatgtgcgctcaaagtcagttaatactatttttttttcccctgagtatgggttacacttcactgtttgaatgcctcttgctttttggtaaaaattggacattataaataatatactgcactaaatttgaattatatttttttcctgaaagcttttttttttctttgagagggtgctcactgctttaagctgcaaaatctgcttgtaatgttaggctgctgatgtctggtttaaaattttttatttttatggtttagcttggcttcctaggggttatccctgtgtttgcatggttcacttggtcagtccataatttgggcagaggttgtactcaaataccttgagccaataaagcttctacgtactgctgaccaattttgcatgggttggagcacgttcatagtttagccagattttaagtatgctttcagtttcagacatgtgcatagtttcccaggcagccaggcatgtatagagacattgtctagttcttctaagactttctcctcttcacaatttctctgttaaatttctggctgatgtgccactagccccaactatgactgtaattcagacaggcatctgacgtttttctcctttcatctcctactggtttcaatacttttaccgataatgatgccatgggttttagccctccatcccaaataaattccactccatctggtagcaaagctggttttctacccagccctactctgccactaccagtctcactgacaaagctgggatgtaggggagagggggcaaccaccagataagaatgctgcagactcctgctgtttttacacaaagttctagcatgaataaatgtttccaaatttgtcatttgcttttggtcaatttccagagccctgaaattgttgtattcaacaactttgtctagtttatactggttctttgggggaaaggatttgctaaactctttgtactgtctttggtgatgttaattttgtctcctaaattttgtccaatgctgtccaatttctccaatgaatacttattatttttcctgcaactaaaaagcaatctgtatcaagacactttaagaccacgtaaatatctcatctctcaccaaaatgcctggctagatttagcatctactgataatttctgcctgaatagatctttactataatgattataattttccaaatgcagcactcactctgtatttcccagtcagcacttggcattctacatagcagagtcctccttttcctctacttacttgctcattcattcattcattcattatcagtgtggactcataaatatctactttttcctaacagtctgtaagtcactactgtccttaatttttctggtgctaaacatgtcctagatttatgcagtaggagccctttaacttagttcctgtgtccttgagacagagctcttttatttttccaggctcatattgtacttaccctgtcctagccctagtccaaccatttctcctaagagtcctggttctctttggtgagaaatggtatcaaagaccaaaattttaggtgttagggcatgtgttagatcatttctactggggtgactttgcttctaggccacttttgcctatagatggagctaggaaatatatgcatgtacatatatacatacacatacatacatgagaacatatacatgcatatgtatttgagaaatcctgagtctatgccattacttttaattccattccatccccacagggtatccctcactatcccaattcatatttgtatgttccttcttccactgagaatgctggaacctaataacatcaacatacttattcatttgctaaatcctgtattacacataaaagagcttcagaattgtttcagccatttcaactaaaaaaaaaaaaaaaaaaaaaaacgaaaatggagttcactatttgtttgcaattctcttcccaaaactgtccaaagctgagtttgtacagtcaaatactcataagttactaaagtaacttagttttttttccctcttcagtgtggttacattatttgaatgacagtagagtttgtttacatatgcttttaattttaaggtaatattttctttcctttcttcttatcctaattgaattttttaatatatgtaagacacaaatatgctaccagaagtcaaaataatacaagaagatacacttagggaagtgtcattccctccctcaattaatagtactgtaccaggcctggtgcagtggctcatgcctgtaatcccagcactttgggaggctgaggtaggtagatcgcttgagcccaggagtttgagaccagcctgggtaacacagtgaaatcccgtctttactaaaaaatacaaaaattagccaggcatggtggtgtgtgcccatagtttcagctacttgggtggacgctgacgtaggaggactgcctgagcccaggaggtcgaggctacagtgagctgagtttgcaccactgcactccagcctgggcaacaaagcaagacgcaccctgtctcaataataataataataaaataataatactgtatcaatgtcagttcctggtatccataatgtactatgattatgtaaaatattgttataggaaggtgggtactgcatacatagggactccggatgaatttagttatttcttgtgagtcaaactatttaaaataaagagtgatactttttaaagtctgtggatgtattagttttctatggttgctataacaaagtaccacaaatttggtggcttaaaacaagacaaatttattattttactgttgtggaagtcctgtgatcaaattttccagcttctggtgacttctcacgttccttgtcttgtggtttccttctatcttcaaagttgactatgagcagtcatactatattactctgaaggtaaatcttttgccaccctattaatgactcctgaggttatcgtggtccacctggggtgggagcttcctaaagggactgacccttgaggtagattttgacagagatgcattagttaaggagaaaagaaaagcatagcattcaaagctgacagaagagtgaggaagcaaatggcattaacagacctacaagtaatttggccaaagacaaatttatgaagaatctgtatgtcatgtcaagtctagtctttttaaatgaagactctggggaaaaacttgtccctctttgcttttttttttgagacggagtctcactctgtcaccaggctgtagtgcaatggcacgatttcggctcactgcaacctctgcctcccgggttcagcaattctcctgcctcaggtgccccccatcactccagctaatttttgtatttttagtagagatggggtcccaccttgttgtccaggctggtcttgaactcctgatctcaggtgatcgacccgcctcggcctcccaaagtgctgagattacaggcatgagccaccatgcctggcccccaccttgctcttatctgaacactctgccctatcccacaaaaaaaggataaccgatttacaagtagttcatcagaaaataatattcataatcagtatcatttagtatcagataaattgtgaagaagggaggcctgcagttgtaaggaactttacgttactcatattagtaaaaacaatcagttgatattgtcaagggaggcaatgctatactatatttactgagaggatatatgtctcataatgtagaaatgagataggaacaatattctagtgcttaaagggtaagtttttcattatccagaaaattaatagtataatacaaaacaatttacccaagcctaattgaaatactacttaaattctttattcttaaatgtcacatgctttcttaagttttacattattattattattattattgtttttgagatggagtctcgctctgtcgcccagtctggagtgtagtggtgcgatctcagctcactgcaagctccgcctcttgggttcacgccattctcctgcctcagcctcccgagtagctgggactgcagacacgggccaccatgcccggctaattttttgtatttttagtagagatgggatttcaccgtgttagccaggatggtctcgatctcctgacctcgtgagctgcccgcctcggcctcccaaagtgctgagattacaggcgtgagccaccgtgcctggcaagttttacataattaataatctcaaatattttaaattacattaatgatttttattcctatgtagcagtgtttgttgctgtgttcacagttacatagctattgagaaatccagtttcttttaattttgtaagtcaaaatcagttttctatataactgaattgtctcaccttctgtagcccaacatccattcaaagctgcacaataacacgggagaagaaaatatgaaaaacagacatgccagtgataattactagcgatttcactacaatgatacatatacatcctgttgattattcaaagagtaaaacattctgaaagatggcttcctgatctcaattttcttgaaaggttagagttctaaaattcattgcaccacatgttaacaaatgtatttgtttcttttttggggaaagaaaaaaagaactttctccagactcctgcattctctgaataataatgatatgttacacaaatagaagactatgtctcagctttcaaatggataaacagtggaactgaagaccatgtttcaaaacagaatatagttcaaaaagccctgcacaatttattatagttctttctggccaacccacaacggggaaaacagtatagttctggtcacagcttaatgtaagtcatgaaaaaggaggtttctcattcactgaaccagtatttattgtgtactatactccagacactagaatatagcagtgaataaagacaatatccttaacttcatggattaactaaaactttatataaagtttcaaatttatcactgagaggtaatgtttactatctgttacaaatttagcattatttccacatatgatagatatggcaagtattctaagtaaaaaagtaaaaagtgtggtaaattgggcatctgaaaggaggtgtagtttagtccttatgaacacagactcaaccccctgagtatgacatgaattaaatatattttacacacacaaatagagcttagcaatgtgggagactaaatataagaagtcaattaccaaacacatatgactaaaaataattcaaatacataaaaggccaattcaaccaaaactgtgtaaaaaggtgcagcatctttacttccttcttgaacattctaattgtttttctagctctgaggtaataacatcagatttttccaaccttcaatgacccaaattcctagactatgtctgttctgcttgacttggtttttatctacttttaattctaaatttaagaattaggaagcaaaaggagccttgtgagtagagcagcaagcagtggggaagaagaacagagaataactggagaattatgcaaggaacaaataagagggaactgtcctggcagaaacaactcttttaattcaaacttcctcctttcttttcccctttcttcccttctgccactattacattattactgaactactgagatatatcatcaatcataaaattctagggatggatataaagaaatatgagacaggctcttaggagctcacagttcagtgaagacgaaagactggtaaataaacggttaaaacataaaataatagagctatgtatcaaatgttacagagcacaggaaaaaaaaaggtacttcatcctgccaccatttggaagctatgtacttaaatgttggagtagccatattttataaaaatattaaccactaaaatgctgaaagagcaaacagaaattttagacaagagaactttgtgacaaggaagaacgatacctaatgactctcttgccttagagcatttacattctttatagataattcaatgcaaagatagagctatttaatattagcatctacgtgccaaaaaaggacaatgggcaggacagttttgaaccaggatccttctgaactttcctcagattatatcatgtagcaactactttcttcacatgtgatttgagcaagcatagtacaccagtcaacaaggactcaattggtcaatgactgtcagtctttgatatttttacaacggtttctttatagaactagcataaatatttaatttttaattttgaaatgaaaagcaatcagtttcttaataacattctgactatttcctaaaaccctgttctcaggcttcaccaaacatcttactattccatgagggcctttcataatttcctataatgctaaatatgcttcttcttctagaatgcccttattttacttttctagcaagtaagagtttgctcttggtatctctattattgtgctaattatattctactatagttttaaaacgatacctgtttttccattaggctaaaagtacatctggggtaagagctgtgatttgttcatctttatatccccagtgactaactcaggagctggcacataataatggctttgtaaacattttgtgaaaaaaaacatacttctaccatcatataagcagaagggcattacgggaactttcttatagactcccatgccatttattagaaagaaattacattggaacagttttcgttagagatccttaggcctctgaaggtaagcacatggtacacgtggtaagcagttccttcagaaaagtgccccagagtgggctagcaaggagatttaatttgcttcaaatccccaaagaacatagctgatattcaactgtcaaaaaataattaatcatagatacagtaaaatagggcacaagatgccattattagtaatagtttaaaatcttgtgtactcaaatttgcaaactatgtttttatgataggagaggaaatatattttctttaaatttttttttaaccctgataagtttgttgttgggacagacccttatgacaaaagacagattaatatgagaaaactaagcaagcttccttcaaggtcaaacattgaaaaaaaaaagacgacttcattttttccccttataagtgagaataagattaaaacaagtaataatgctatatgaataagctgagaaaactaagacagaaacatgatctgaggccctagatgctgatcatttcagtaaaaaggataaaaatcatcctacaattgatgcattaattggatggttcagcaatttaccaatcagtattttcttttaaagaaaacatttttacacatcctaagctttcatttttacctctggcatcttttcatctttatgttttaggaacgtaagttatttttaaggctcctacaaatgttcttattgttatagtagatattcagacagacataagcagagcaggagaacctccttcccctgcccaaccccaaccaggaatgtcaggcgaccatcaggtgatggtcaggtaagttgttaaactctctctctaaaataataattggtcacagtggtgccagggaagggcagtttcccaagatagaaatacctgaaattggtgatcggcagcttcctgataagagctcaggagttgggtgagtgagctcacgcaggtgcagtaagaggcaaaatggcagagtttaactgctatatgaccttcctctaggaacactggattggtaaagaaaaaatgcctaaagtgagcatgtgtacaactccagtaaacacactgcacgtgaagcccctcccaggtgctagcaggccactgtgtatgcagagagcctacctcaagggaagaatcaggggaggagaaatgcaaccacccagaagcatgccaacctataaaatcccaagtcgaaaagccaaactgtgcacttgctctctcaagttgcccgcttggcccaattccaagtgtactttacttccttttgttctagctctaaagctttttaataaactttcactcctgctctaaaacttgccttggtctctcactctgccttaggccccttggctgaattttttcttctgaggaggcaacaatttttgctgcagactcctatgggttcactgccagtaacattatcacttcaaaaataatcacatagtatcacagagagaagtttttccagggaaagacaaaagtgagactaccaaaggttttccattaaagcattttaaaactgaaacaacttgctgaatagcaaggaatggctacagtcaacattttaataacttttatgtacaaagtaagaataatatttgtaagacaaactgaacaaaaacttttttaagaactttaaaaaaaaaccctatatttaatatcagagatcatcgatggagacatactgacccatcaatagctaataaaaaactggccaaagttaaccatggacaagtaaaaagaaagcatgcatagaaaaaggtacaaacacaaatgatacaagattaatgtggtttaactgtggaaacaaagtgttgatagctgatggcccaggatcattttagtcagttttcaaaaatgcctattaaagagtatactgtgaaaactgttggatacattttctaaaactagtacatgttctagtaaaatccaaattacaggtgaacagacatgacaaaagatgtcaagagcattttacaagattatttggggcagggagggacacccaagtttaaacgggtatggattagattaaaatatcacagggtctataaaaaccagttcctgtgaatacaaacttattaacattaaaaatcccagcattgttagtacacttaaaacactaatcctcaggtaaacaaaaatagttcacataggctgccaaaaaaacaaaaaaaacaaaaaaaccaaaaaccaaataaacacaagacagtaaacaagagatgaaggcgatcaagaggaaattgtagggagtgaagcttggaatggcagagtccatataattatttcagaaaaacacagagaccttttaaactgtgaaaaacaaattcattatcataacaattcttagagagaagaacaaaggaaatgctatcattacatttagacctttcacaggaaaactagtcaaggttacaaaaggatcttatagtcttatctgcttcctgtctgtgctttgtaaaatccgctaccaccactacccccaacccagctcgtgaactctgataatggcctaatattggcctttgacaaagtccaaacaaaatgacaggtgataagagaatgcctttatatagaattatcaccaccatgtgctttggaaacaacaactctgcacactgcactgcatctttctttctgctttgcttccttatcttttccccattctttcccagaaaaaagtgaatttagaacatgcaagcaaaagataatgaagctgaaaatactagagtaaaataaaataataaaatttgatcttcaaatgaccaattattatgtattccggcacacttcatcagtacacagaaaaatctacaatatggttaccacttcctcatagctagtgcattctttcatttattcaataaacattgatgccttttgtacctgaggcattatgccagatatagagtacacaagaataataagacatgtaagttttaggaaaaacttcttataaacaaacaggggaaaaaagcataggatagaatttctgtaacgtccctgaagatattccagaatcaatacacatcagccctggactgcctacctgtatgtagactttttgttatgtgagaaggataaaatctgtattttgcttaaatacatatttttaaggttttaaaaatatattagttatgcacataaaggacataaataattttacaagttaaaaaaatctttttattataaaacacagatatagaaaaccacacaaatcaaatgtatggcttaataaattatcttaaaaataccacccacatcaagaaagagaactttcccagcaaaagtaaaagcccctggaagccccttttatgtacccacccccccatcataatctcctctctactgccaagagtaaccatgcttttatttaatatttatccactttcctgatttttttctataggcagtttttatcacccaaaagtacatccgtagacactatagtttagtctcactctattaaaaagttggatgtcttttaaatctctttcaatctcgaggttgaggaacctctagattgttaaagaacctgggacatttgactaagagagtttccaacagcctgcattttggtaattacattctcttggtgcagtttaatgtgttcctctattttctacattttctgtgatcagactcaggtttaatccctttggcaaaacaataagtagtgtttggtaaggttataacggcacataatacttgcttgtttttctttctgtggtaacagctgttgatacttagatcttggttcattgaggattgcaaaatgatactctatttccatcatttctttcatctttattaattagaagactttctaaaaaagataattgccctcaactactattggttatcatttttttctttattgataaattttcaagataaattgttctttatcatattctgaggtaggtgacaatccctttttaatattatgaattcatggatcttaaaatatttgctgggtttcaaccaactgcaattattgtaatttttgaagctcaaattctatcatcttagatcagttgtgagcctcttcaagatggctcctgagttcttttaacaagcctctaacagtaacattttttcttaattctcataccataaattccccattttaaagtatacaattcagtggtttttagtgtagtcacgaggttgtacaagcatcattagtatccaattgcagaagaatttcattcctcaaaagaaaccccacacccactggcagttatttctcacggccctatccctcgagccccttataatcactaatctgttttgcccctatgtgtttgcctattttggacattccacataaacacaatcatataatatacggtttttgtgcctggtttcttttacttagcatgtttccaagattcacccaggttgtagcacgtatcaatacttcattccattttacggctgaataattttccattgtgcggatatatcaaaatttgtttatccattcatcagctgaatgacatttggattgcttccactttctgactcttataaataatgctgctatgaacattcacatacaagttttggtgtgaatatatgtttttctttttttttaagaatctgatacattttgacttatgtacatacttataaaaccatcaccacaatcaagactgtatacacaaatatcatccagaaagtttcctcatgtccctttgtaatctcgctcttcctatccatgaaacaaccagtgacctgtttccatcaccatagattagaccacattttttagaactttagagaaaccgaatcatgccgtatataatttttctgacatttttcattcaaaataattattttcaggttaatctatgttgcgtgtatcagccattcatttttcatttagcttagtagtattacattgtatgaacataccacagatgctttatccatttccataatcaattatcctttaccactggtggacactgagtttgtctccagtttttcactaccataaataaaatggctatgaacattcatatacaaatatttttatgaacatttttaaacttaaaatagtcaaactgtgttccaagatagtggtaccatttcatattcctattagccatgaataagaggtctaattcattcacatttttaccagtactcagggaagcactctgaagtctcaacacaaaatgctcctcccacttctcgccaaggttgataagcctcaagttgtgtgccttcttccaatcacaccaagctgtgcaggtcacagcaagcatctccccaaaccccttctttgttctcagccccccagacatccaaactatgtcagctcctgcttgtgcttccaaagaggcaacacagaaacaagtcccttaggcagcttcctcaacagccagaatttgggatgcaagctccactcttccctcctccctgtacccccaagcctgagagagttgaggaaggggctgatacaggtaacataaaattgctctatttacacatttcaatgctgctattctctgctttgtgcaagtctgaggtactgtaatttcttgactagaatctggaattgtcatgcagggatttttgtcagtaaatctttgttaaatcagtgtttctgtcacggagggagggctggaatttcctattcctctatctgattaatgtcactcccaaattctcagtcttgactatttatttccttcactatttcaaatatagttattttaataactgcatctgataactctatttgctagagcccctgtggttctttcatattgtctatggtttcttttgcatttctttcatatagttttggtcctcacgtttctggttatttttgattgagtacagggcaggtatataaaaattcatagacaaattggaggtctagaatgtagttatcttgtttcagagaggatatacttttacttctatgagatggatagacagtagcatcaagaattaccttaatccaactcaagaaactgaaatgatttcaagctgtattgtaattcccgagggagccagtctacttctgatttacccactcccaggctgtggccttttatggtctcaactcaaattatgagagctttatataaaaaaaaaatccaccttggtaaaacttaaattccaattttccctcttccccataagatatcgatagtactgatcagcttctcagccatttcttccaaaatcaacaagggcccttaggaaaaaatggtcccaaatgtctggctcacttcattttctcctggatcatggcttggcaattatttactggctctgatgccttcaagcagatgttatttttattttatttgtttattttgggacagggtttcactctgtcgcccaggctggagtgaagtggcatgatcttggctcactgcaacctcctcctcccgggttcaagcgattctcatgcctcagcctcctgagtagctggcactacaggcacctgccaccatgctccgctactgttttctatttttagtagagatggggtgtcagcgtgttggccaggctggtctcgaacacctgccctaaagtgatccacctgccttggcctcctaaagtgctgggattacaggcatgagccactgtgcctggtctagcggatgttctttatatttgtgtatcttttcaagttgtcattgttaagaggattattctgaattacacaggccaccattactggaagagagctttgggttttagaaatttatactttatctacagtagttttttttttttttccagtgggaatgctaattgtattgggggtaaaaatgcttctggcacctaaacatcacacaaactgcaggatgtttaatatccctggtccttgacgctaaatgctggttacaacctcctcctctcctcccccctcacaactcatggtaaaactaagaccacagaggtttataaggtactcattaagttcacatttggaaatgtgaaataatttcatttgtgtcatatccttctataccttttcatagtaaacctctgctctgattgaccctttagaggtatacaaccttttttaaagtaaaaaaggtcaggtgaatggttcttggctaaaatcaattaagtcaatggttagtagggaccacagacaagctgcaggtagtccatgaatctactaaatttacttccaggctgcatgcagtggctcatgcctataatcccagctctttgggaggccaaagcaggaggactgcttgagcccaggagtctgagaacagcctgggcaacatggcgagaccctgtctctataaaacaaaaaaattaaaaaaattaactgggtatgattgcatgtgcctatcatcccagctactcaagaggctaaggagggaagactgcttgagcccagggtgttgggggctgtagtaagctgtgttcatgccactgcattccagccttggtgatgactaagatcctgtctccaaaaaaattttttttgttaatttccaaaagtttatggagggagaatgtaatcaacaagatgttctttggagacatgccaccaggaagggattatgtacgtcatattagatagatatgcattaaatatctatttaatatgaaattaaagaaaatagctttaaatattttaaggcttaactatgctcagtgagtaaaaacttgcactagaagagaagggagatgtaattttttaattgacaaaaactatatatttacagtgtacaacacgatgttttgaaatatgtacacattgcagataggctaaattgaactaattaatacatgcattacttcacatactttttttttgtggtaagaacacttaaaatccattctcttaatgatgttcaagtatacaatacattgttattaactgtagtcaccatgttgcatagtagatatcttgaacttatttctcctaattgaaattttgtatcttttgaccaaagggagatattattttagagttggcatgagaagaggcaaatgtagctggaaagaattactttgaaattgatatcaccactcattttaattcagatattagaagactctatttatatttatactaatctcctctaaggctttctaactttcactgattgaagttaaagcagaagtatatggatagggacactgatgaaaagggtggtaagatacagagcaaaactacaagcaaaattcaacaagagacaggagggaagcaagagggtagaatttctgtgcaagaaattaagaattccatgaagaggcagggtatggaccttagggaagggaagatttcagcataactaggaaaagacaaacacagatggagagcaatgagagtgggacactcataggcaggatatataaaggacaagtcagaggtaacgtaaatgggaatctttgggcagccctggtttgaaatatcctcatttttaagttatatatttcttaaataatgtaaaagctgtccaaggtacagtggacactttctagaatcctcccaatctttcatcctaaccattgccgaaaaattggagataaagtcctcagatagatggtgggatgagaagaatgagactcagagtcccatctgacaaggcttccacaaaagcagttcatctatggaaatgcaaaatatatcatctattcatcttttagcataaagaaaatatgtccactttccttctatgttagagtacagtggcaccatcatagctcattgcagtcttgaatttttgggctcaagtgatacatctacctcagcctccctagtagctgagatttcaggtgtgcaccaacatgcccagctaatgttttaaaattttttctgtagatatggggtctcactatgttgtccaggttgatctcaaattcctgggctcaaacaatcctcctgcctcggcctcccaaagtactgtgattacaggcatgagctaccacacccgtcccatccactttctaaaagtctaactgacctaaggaaaaaaggggcctgagttaaaatttttaaaaagaatgaacagtaggtaagatcaggacccacaaaattatatatctcctatatataaaatatttaatggtttaaaaaacattttcttgattcatgtgaggtgatgtcgacttaaaataaatcctttaatcataggcttctacaagatgacattgaaaatgggagaaaagacatacccaattgctggaacaggagagccacactagtgcccgtgataggaagactatcatgtaaaggagtctggatcaactgtctatctcctgcacccaaagaaaacagcttctgcagaatgggagaaacacaaacacacacacacacgatttcagccattttttaaaaaataaaaataccttcgatgttcatttttagagcaaacgaccatgtaagatccaattaacagatacaaaaggcaacaatgtatatcccaaaacatttaagttctttgtatacttaagtggcataagaaaattcagtggctgaaagttgaaaatctagtagagataagacacaaaaatcattgataatcataactggctaaaaaataatgaaatgttaaagtcaacaactttaataaaggctcataaagcaattcaagtttagacccatctgtgaccaaactcacatttaatattctgccctttgagcagaggtagaagaatgaaggaggagagagcaagagagacagagaaaaaaggaggataaaaatttaagacaaaagacaatgagaaagatagaagagaagtaaaaaggcgaagggcaagaaaaagaaatgccaatcccactataagcaggatctttgtcagactgaagacaatgtgatttttagaaggctgtcctctttcccaatattatataagaataagcaaaataaattatcacctattcatttttaaggtttaaggaaaaaatctatccttttaaaagtatggttgaccaagaaacaataaataaatcatagcagcagagattcttatttttctactttagagacaaatatgaaaatctcaagacatacagaataaatgaatctattaataagtagttacaatgtaacaaagaactgtgttgagagttttcttaatgtcatcttctaatttttatcactccaacatgtttcaatttaggttaataaaaatgagatgtaactatatacaggagtgagaaaggtaaaagagaacatttaaaagttcaacttaatatatttccaagaaaatacaaactgcagttcaagttacacaaaatatgacttctaattatgctatgtgaaagatgaaccctgtgttaaaattaacctcatgacctaagaaaagaatggaatcttgagtgtctagaaagcagaccatggggacaatgcttaactaaagtaggatcttccttaaaacaaaaatatttaaagaattatttctttccctttctccataaattaaattaactggaggagaggggaagaggaacaatccttctccacctctctttctattctatttacctgagaccctccagccgctgggacaaggcaggcacaaaggtttgcaattagactttccaaggagacattcaggctgtccacatacacggtatagatcaaacccaggcaagcctgcaaaaagataaatacatgtaattatttcatggaaaaagcattaaaaataaattgttatgacatctgctctaggacgatttctctttgaacccagtaaagtatattatacagtgaacatggaatacattttaaacagcaaaaattaagtttattaaattttccttagaaccagaacccccaaatgagcttctgagatgagtttatagaaagcagaaatccataatttgtaaaacagatgtttgtgctctgataactactctagcaaatctgtagggctaatactgtttttgcctcaacttaagtctgttaaactctaaatctcaagacaaaaacttagaaattttatcttgtttggtggttcttataaatccggaatgcttattctacagaaaaatttaacatgtgaattgtaagaaaggattgcaaaacagagacaagattgtaagattaacactgagttcagaaggaggtaggtggtaaaacagacataatgcaatctttatgaatctttcagtatagcaaaatttgtgactctgaaaacttagtatttgcttggagttacgcattgtcattgaaatcttgacactaatttaattcttttataacacaaataatctcaatttctagaaaagttttacagaaattgtatcttagcacaaatatttacaaatgaataaaaatttcctcttatgtttgaaaattctgtgtttctaaaacaagaaaatacctggaagcaatattttaagactattttgacagaagtatgatcagaattgtttgaaatctcaaacacccaccctatttacttgaacctgattcctcacaaggtgaatatacatacacgaatttgttaaatcactcatgcatttacatttactacaggtaatcaaattatttctttaggatgtatacattctggattcaataaatgtgggacctattttaaaacaaacactacatccttagaagttttagtagtcacattaacttattcaggtatttatttcacccaacatgaaaatatttcttctgttcatgctaactgtatttcatagatgaattcctaaatcaatctaacaatattttcaatccaaagaacttgtaccatggttcattcaagagactcacacaataatacaaattaataatgataactatgtgttctttaccctaaaaatttctggataatataatctggataccaacaccaggcttttgggagcaaacacttctgcaggctgaattaaaccagacacttttgcttcaccttcaatctcttccttctttgttccctagaaaaagagacactgaaatcaacaaacagaagggatttcctaggttcataattcacaaaagatgaatatcaccttaaatataacttatgcaaattcaaaattaattataatataattttaaaaatcaaactacaaataaagaatagactttaagagcattctaaaagtaaagtagacaaattatgaagccgggaatacttatttcatttttgaaaagctccttaagctccagacatataacacaactttatttgagcatttcctttctgagtgaatcaagggcaaataagacatgctcaaattattttaaatagtgacccaattaaaaattatactcacttagatgaaaagttaaaaaatgatatttaaatgaagtcagttttcaaaagaagatgttttgcaaatatgacactaattttcatgttggtttttctacttgtctcaatgtctcaaacaaggattctaaggcttgcagaatgcttggtgctcaatgctcttggcagtaaagcacaatcggctctaaattgcttttgttcataagcaacaatgctgatattttgagaaaagagaactctgtttccgtttttgaaacaaggtcttgctctgttgcccaggctggagggcagtggcacaatcacagtgcactgcagcctcaactttctgggcgttagggatcctcccacctcagcctcccaagtggttggaatcataggcacactccaccacgccaggttaattttttgttttttgtagaggcagggtctccctatgttgcccagctggtttcaaactactgagctcaagtgatgctcctgccttatgcttccaaagtgctggattataggtgtgagccatcatgcttggctgagagaacatttttacatacaaaactgaatttcagaaagtacttaatgccactgaactgaatacttaaaaatggctaaatggcaaatcttatacatatatattttaccacaataaaaaacgcttaaaacaatacataagtttcaataactaaacactggttaataaacttgacaaaatatgattctcccgcttaacaaacccaaaatcgtgattcccctctttttaataacctatatcccactgtcaacaaaccctgatttcttacctcctctattgctaccataacgctgtgagctactataatctcttgtgtggattactctaacagcctcccttcatctcctttattcttctttagccccactttgcttccttgctgctctttaaacacactgggcatgctcccatccactgctctatgcgcttctgtgttattcctttgcctaaatactctttccacagatattctaatgacttagttcctcatcacttttaagttttcattcaagcatcttctgctctaataagcttttgctgacaatgttatttaaaactgcaatgccctaacactctctacccactttctctgctttatttttctccatggcatttgttactatccaacatatttatctatttcacttatcttgttttttagtttgtctgtcaactgcactagcacatgctcccataaaggccaggatttctgttttgttcaacggtgatttcccagttcctaaaataagggctaggcccatagctgatacttaatatttattcattgcatacatgcatgaatacattttcttggcatagttttttgagcattttatcaagggaagtcttttcccccctattcatagaggccaataattatattttctacttcctttagagctcatttagtttctagtacaatgcaatataaccaagtattagatgtctgtggaatgtgcacatccaaagggaactatctgtttagtttttgtatgtatgatagagtccatatgctcttgaaagattttcatttattacaaagcaaaaacaaaaattaggttggttggtttctggaatccttagaaataataaaaatgtgatgaatatgaattcaccaaagatttccacacttaatgaatcatattcttcatggattactaactaattcaaaatgacaaaagaatgactaaaattcttggaagagataaagctatccacattttatgagattgtgataaatgccctagagtaccattagaagccagctagagtaagtagataaccatttcaaatatatgaccatttactaactttgaccaaaacacaaaatagaatgcattggtcatttcttaaagctgctcttcaattaaacactcaccaaaaggaatagttattaacgagaaagaaaaaggtccaatagagtgaaaatcagtattaagtaaaaaataattttaatttatatcactttttattacgatgttgacttttcctttgtaaatgtgctacaaatcctaaaatattcttagttcttaatttcaatatctctcctataagaatgcaatgtcctaagtttagagaaaaaattcttatttctgcttttaaagcaaaatgtactgctgtgattaaacacacacacacacacacacacacacaacaaataaaccccaaatttattaggtaaaataaagtttgttctagaatggtaatgtgacatttttgataaaatttttctagaaataatttatcatgtcagaggaatactccctcttctatatagctgctagatgtattctatgtaataattataaaatgacactagttttatttggtgtgtgttttacaatgacagattttcacccattggaaagatgtgaaaaacttaaaaataagcaggaaattcaaaacatagtctatgaatatgagatattctaataatgctaaatttaatattttatactacaaaagtttcacatattttatccagctgaacaatattttaaaggctttgccaacttaagattatttcttctcattaaattggccacttaaagattattccttgcttttagtaggtctcattaaagatacaaatttatcttaaacactgtttactaaatatctcacattgacttacaaggtcaatacatataataatcacatgccacaacttgcccatttgtagatatctttgcctaccaattactactatggattacatctgctagtgattcccagcttctgtgtaacttatgtgtagttcatcatctctgtgcttcaataatatgggataaattagtactcaccatatcaatctggcctaaaagtgctactgctcttaaaacatatcctgagacaaaaagtactagattgctgattgcacgcaataacttgatgtagcagatcagcacaagctttaaggaagtttatcctaccattcaggttgaacacttcagcctcatctttgttgtatcttgatgcttaattttaatatcaaaataactgtcaagtcctgacccttttatccttaaagaactgttgcatccaacatcttctctgtgctatgttcatttttaacaatactgtatcacactaaaaatcttcccgcagcatttcttaaataatcagttataaaaggaggataaaattaattccacaagtaaaaaattttcagtcctaaatttcctttctgaaatgtaatatatagcaagtataccattatatagaattgtctcagtaaagcaatttaagaacttaaaaattttccagaattggaaataatggagcctaagtagttgcaaaattctgtaagttctaaaattcctcctgaacccttcatttcttgccaaataatcttttaatcaagttgacatgtctacatgatcaaaccaggtttgccctttcattggtctgggaaataatgaatgcataagaaatacacattttaggataacaagccttcaaacaaactaggcctctagtcttcagttcagaatctccgctcgctgcaagctccacctcctgggttcatgccattctcctgcctcagcctcctgagaggctgggactagaggcacccgccaccacgcctggctaattttttctttttttttgtatttttagtagagatggggtttcaccgtgttagccaggatagtctcgatctcctgacctcgtgatctgcccacctcggcctcccaaagtgctgggattacaggtatgagccaccacgcccagcctaaagtcttaaacgtaagacctaaaaccataaaaaccctagaagaaaacctagccaataccattcaagacataagcatgggcaaagacttcacgtctaaaacaccaaaagcaatggcaacaaaagccaaaattgacaaatgggatctaattaaactaaagagcttctgcacagcaaaagaaactatcagcagagtgaacaggcaacctacagaatgggagaaaaattttgcaatctacccatctgacaaagggctaatatccagaatctacaaaggacttaaacaaatttaaaagaaaaaaacaaacaaccccatcaacaagtgggcacaggatatgaacagacacttctcaaaagaagacatttatgcagccaaaagacatgaaaaaaatgctcatcatcactggtcatcagagaaatgcaaatcaaaatcacaatgagataccatctcacaccagttagaatggtgatcattaaaaagtcaggaaacaacagatgctggagaggatgtggagaaacaggaatgcttttacactgttgggagtgaaaactagttcaaccattgtggtagacagtgtggcgattccttgaggatctagaactagaaatgccatttcacccagccaccacattactgggtgtatacccaaaggattataaatcattctactataaagacacatgcacacgtatgcttattgtgacactattcacaataggaaagacttagaatgaacccatatgtccaccaataatagatcggattaagcaaatgtggcacatatacaccatggaatactatgcagccataaaaaaggatgagttcatgtcctttgtagggacatggatgaagctggaaaccataattctcggcaaactaacacaagaacagaaaaccaaacaccgcatgttctcactcataagtgggagttgaacaatgagaacacatggacacagggcggggaacatcacacactggggcctgtcagtgggtagtggggttaggggagcgatagcattaggagaaatatttaatgtagatgacaggttgatgggtgcagcaaaccaccatggcacatgtatacctatgtaacaaaactgcatgttctgcacatgtaccccagaacttaaagtatacttaaaaaaaataaaagtatactttattcagaagatgacttgcaatagtattctgcgggacataatttaaagtatatctgctatgaacaatattaaaatatatctttaaaatcagatatagttaacatgacagaataagaaaaataatacagtagtggaagatatttaaaatctatgctacctacttcattttataaatcagtaatcacatgcccagagggatgaaatgacttgccaaggtcatacagatcattaaaggcataagtgggattaacaagccaagtcttctcttaagctacttctctttccagtatcctatactcttatatgtaacctttataagaaataacatattagttaaaataagctgtttaggaaagataacatctgagacgccaaactgtcaatttgaaaagatgttcaggtttgttttcctttaattatatttgaatgtagtaatttttgttttaaaatgaaatagtaacaatacacagttctcactgcagcccttcctagcctgaaatagttgtcaaaatttaagaaaaggtatttgatgttgaaggattctggaaacttaatcccaaaagtttctcctgttgttttaaagtcttatatcattttaagcatgttgcaccaattaatcatagttaatccagtgacagtttttccctacaaaatacatctgtgagggacatcaaggggactgttaagattcagcattctgtccatttgccaattctcattttcaaaaggggaggagaagacagattctttggtaaaagacataatcttcagcatcgatactctaaggagaatcccatgtggatacttgcaaagttgtaaattatcaaactatagaataaactcagaatacacaagtctcccaattttttctctgtgtgaattatgttacgcatgctagttttcaccagactctaacaaagtctagtcttgttgaataagacctaagaattagtctctagaatgctaccaagtgtaaagttgattacaatatcagcaagcccaattcccaaatactgctatttcgaatttttagttcaaagagttggattacctgggactaaacccttcttgaaggaactaaggtttttccaatgagatattcatcacagttattcataatattgacaaaacaggaaatacatgtccatcaggggattaattaaacctacctatatggtcaactagtgtacagcaacttttgttaaaaaaaaaaaatccttattattggaagaaaatatgtcaaaccatctttttctgttctctcaaattttttcctgcatgttctctctatgtcttctacaatgagcatagtttactatgataaagagcgggatggtgggggtgggggagtaccaaaaatgattgggttgtagtacttcagctaaatctatacactgttttgtgtgtggttttctccactgttttataccatctagagacgaatttataaattcctttttattactccattttccaggtaattacttaactgcttggaattaattatatgatactatgtttaaatttttttcttttctcaaatagctcatcaactgtttaaataatatttgttgaaatacacacattccattgatttataaagcttctattgttggacactgatctcctatacacaatagggtctgcttctggagtattggttttgttcccataattgtttttacccttgacacttaattcttgaacctatagcacactgatacaatttttgcagctttgtagtatatgtggttattatttggtccttggagacagaatcaatcaagcactttaacttggtactgaatgtccctaagtaagcctcatctgtaaaatggaaatgttaaaacctatcaaatggtgttttgtgagaataaactatatgtgagttaaataaaatagaatgaaataaagtgttgtaaaacttttagcacagtacccagaacataagactttaatttatcataagcactacaatcttttttcctttgcacaagctttttgtttgaattgtcctttttctttcccttactctaggtgttagctcttattaaaatgtccactgagtcttttaaactctgtatgatttattccagttgcctagtctgcaattattatctgtttcactgaatgatacttagcatatgatactttggaatggttttgtacttaagttttggttctgcttcccaagctagatttgaagcccactgtgatggagaaacgtatcttatgtcttctatgtctctccctcttttttcctcctcttatctctcgaaattacaaaattcattccctctctctttctttgatgacaatttgatgacacaccaaatgttctcactgagaactgcataattaccactgattcagagacaagtatataaacatatgaaataactttaaaaagatatagaactaaatttaaattttagatatttaaaattttatacttttaacatattttaagataatcaaatgattatttagataagtaataaaagtcaatgtaaatctatcatattttgctgattacttaaaaaaatttaggatcacattacctagttgagtaattttgggaacatattatcaaaagtttaatgccaagttttgcttatgattactgacagtgttactgtatcttggaaagataacagagctaacatttttaaagttgcacaatcacattctggatggtgtatgtccctaagttccccctctttaggcttccaaataatgtgtcatagtatatttggtatgaagtaattcacaccaaaaaagaattaaaagatctattttgaactgatgatatgatccaaaaagaaaagaaaaacacatttttaaagggacataaacagttcatgccaaaaatgaaaacaactttactgatgacaagaaagaaacatcttctgggttctatttttttttcaaattctgcttcattgtttatccctcttttccaccaagcccaaaagacattaacttatgtttccagaaaagtggtcttacaattctggctagtacctaagtacaattatatagaatccggaattctcacaacctatccgcattttcaaaatcttggaaaaactgatatgaagcagactgtaaccttttgtaaggtgatcgtaacaaataaattatgatttctgggcccacttaaaatggcaagtaggaaaatatctaagctaaaaagagaaataacttcttgacatatggattcaaactatacaagaacccagatcttagcttctaatattattccctattcaaaggagtcagactccttgaagaaatggctgatttcaaggcagaggcagggaaggaataaaatgatcctagatcaacttgttatgatgaaaagttaaaaagtactttttctaaaaggagatctgtgaaaagaacacaggaatctgtctgagtggtgcacgctggtcaaatatgggataatttgtgcattaaaataataaaaaccattaatgatttacatattattgacaaaaaaaaaacctgaatccatgtatctgtagctcaaacagacaggaagagagagttcctgcttatagtaaaaggtcgactgctgactgctaaaaatagagggagtatggagttagaaaataatcattttttgttatcagaatcaaaattgctataggcaagaatcattagtaaatgctgaaatctaggggaacatgattgatgaacagtaggatatttgcatagtgttagagtgtcttctagtagactgattattaattgcaaacataaaaatcgccactatgaagtggagaaatctgacaatcatctgaccaagttaccaaaattaacatcatcagtgagggacagacaggcattgtggacttccggatgtgtactcttagaaggatgcccttagaaggaacacaggtaatattccaactgttgacacagcctgaaactaacaatgagagatactggaaaacagaaaataagaaacattgtattaaaaatggggggtgagaagttacattatttaaaaatgtcaacattatagacaaaggcagcacaagtattccagatgaaaagagacgaaagagaaataaaaactaaatgcaatatatgtagtatgtactagatcctgtactggaagaaaaaagggatgggggggtgctataaaggacactattagatcaaatgacaaaactggaatatggatagtaggttttattatattgatgttaaatttcctgaggttgataactgtactgtttacgtactgttcatgtacctctgaagcatatactaaagaatttaggtgtgtgtgtgtatgggggagatggggagaggagagaggggaagagggaagaagggataaagagaggaaagaagggtagggaagaaagacctcaaataaaacgatggggcaaaatattaacaacaggtgaatatgggtaaaggctatatacatgtttgcattattcttgcaacttttctgtaagtttaaaattatttccaaattaaaagtttgaaaaatacccaagaattcctagaacctatttataaacatctgccattaatataatgtcaatatattgcctttctgtcagtttgtctagaagaagaggggtgaatagtgaagagggagaatctaaataattatagttagtttcattagataattccaaagagttgtgaagcgataccctcaagaatatggaaataacagaatatactgaattctcagcattaacttaaatgctaaagatcaacagagaaacgaaaggccaataaaagagacagagtggttcttgggctagagaacactctctaacttattcagattgaactgataaaaatgagaatttgattagctatttgttggcaacatatatccaaacattatccaggggagaggagacttaaagtcacagactgaaagttttctgtccccattgataacatacagtaatctctaacttcaaatagaagcaacaggctatgttagtctgatagtctttaagtatttaacatcaaatatcggtttgattccataatcaaaactccggactttgatatggctttctactaagatctggtgacaggaagacaatgtgctgataatgcatgttttgttctatatgcattttcagcacttttcacatttcctataaattagtagtctagcatgttagttttaacacatcagtctaatgaacttgaataatgagtctgcatcatgaaaggtaatttgtctcttcttgtactcaaaaatcagatttctgcatccagaaaattcagatcttagagtttaataaacataatcaaaactaccaaatactcctttgttaagccatttcagaaagcaggccaatcttttcccccaagtgatgatactctatacgtagcagaaactacagtagattatgcaaactggcttactcaatatcttcgaagtcccctttatggtttccttcttgtattatagagcctggaaagaaaaaccaccaccaccagcaccaacaaaaaaaaccctacactttttggggcaaaatgggctctgtatacaatcttaacttccaccaaagaaacaactcatgtaaaacttaaaagcagaagtcagcagtatgagactaaagcagaagtcagcagtgtgaatatctgcaggagaatggatattctagcacaactatggtgaaggttataatgtctgatatatacccagcattgtaagtgccaagtggtaaaaggtggaaggaatatggtttctatgagaatagcaccaagctgggctgttcctagtacccagaattggttccctgcttgtccctcacccctaaaatttcacaagttgccaaatactttgttatgactcctttctgcttagagaaagtagagccagtaatgtgaaactaagaacctcaaccaatagtctgaaagagcaattattttatatgtcttcatagttctagcttatgaatttctgcctgatcatgttgataataccacccctaagaagaatgagttaacatttgggtgcttaaacaataatgtcaagcattgtaataatgatttgcaaacattgtgagtaaatgttccacattctatgaaagacctcccaggagaagggctggcagggaaaatcacaggttcaccaagagaagaaattaatattcttaataaaccaattcaaggatgcactatttttagaaatattcagattatgatcaatgttttgaaaaaggacaattaaatctggaaagtaattttaacatgttgctctcctctccaaccttaaacataaaaatttcttcatgcttcttatgctagcccataaaactcaaacttgcagttgtaacaaaaatatggcatataaaaaacattcctaaatgttgtaccttcgactgtactttagctagtaaaggtttttgtacctgaagattgatctctgcctcatagaaggttaggcatgagcagtaatgtcgatctgagtcaatgtctgtcaggacaaccacaaagaacgttggctgcttcctctctctggacagctgccacccgccaggctgacaaaactaaatgaaatagaaaaaaaaatgtaacatttaaaaacaataaaagttaattattaatctctgagaaattttaaatgtttgcccattttaacaaattcctacctgatgtggtatgagtctaaagccaacatttaaaaaaaagttaatgtacagattcataatggtgaaaactttcaccaatgtgcatatatatttcatgaagatagcctcgatttcccacagttgccactctgggtgccatttctgagacccaggtaggcctatgtaggaataccgcatcaaaattaaagacatcccccaactatgagaacaaatcatggaatacattagaaatcaagggcaaaatatgtatcattgagggaaaatagaattatttttaaatttccatatgaatctgagagtcttcaattcattacaaaaaaagagatatcttgttcagcaagacagaccacattcttgtccataaaacatacttcaacaaatttaaaaaagaggaatcatagaatgtctgctgttagaccatgacagaattaaactagaaatcaataacaggcagatagctggaaaatccagaaatacttgcaggttaaacaacactttcttttttttttgagatagggtcttgtttcatcacccaggctgcagtgcagtggcatgatcacagctcactttaaccccaaccccctgggctcaggcgattctcccatctcagcctcctgagtagctgggactacaggtgcctaccagtatatctggctaatattttttattttgtagagaaagggtctttccatgttgtccaggctggtctcgaactcctgggctcaagcaattctcctgtgtcagtctcccaaagtgccaggattataggcataagctactgcacccagccaaacaatactttttaaataacatgagtcaaagatgaaatctcaagagaaatttaaaaaatattttgagctaactgaaaatgaaaataaaacatcaaaatttgtgtgatgtgatgaaagcagtgcttatagaaaaatttctatcattgaatgcacatattagaaaagaagaaagatctaaagtcagtaaactaagctttgacctttggaaactagaaaagaagagcaaattacatccagagtaagcaaataaagaaaataaaagttagaattgaaatcaatgatactgaaaacagaaaatcagtagagaaaaatcaataaaataaaaggctgcttctttgaaaagctcaataagcctctagccaggctaattaagaaaaaaaaaaaaaggcacaaattactaacaaatgaaatgaaagacgggatatcagtacagattgttctgggcgggagacccgcaagaggagaagaaaaggcacacacacaatacctttaaaggtaaacaagctttatcccatgtaaatggcaatgtagatataataagcaaattatataataagcaaagtaataaaataagcaaatgatataataagcaaattgcaacgcaaaggggagaagggaaaagagataaatgtctctacactcaccagactatggaggattcaccaccagactgggaagcaacagtctgggctccagagttggacactgcactcaccagactatggaggattcaccatgccagaggtggtgaattcctcttcaaagggtttaattgtgtaatgtccttggttcaaaggccccaccttcttgtactttctcatttttagcctgcaagcagccctcctgctcttgctgtgccctaacttgcccagacatgtccagacacgtcttgtgccatagcagaagaaccacttctacccgctcccttgcgaattgtgcatctaccctatttgttcagtgtgctcttgtgatcgtggctgatgcagggagcacccttctgcagaagtaaattgccttgctgagaacgctttttgcctgagtgctggtttcactttgcagcaccaagcacttgtttctaacaaccactagactgggaagcaacagcctgggctctatagtcagccacttgtctgtgcacagacaaagagaggtctcatgaagcttcagcacagtgtgggaccctagctgtttttgtaacgagttgtttggcaggaggtccagtcatgaaggcccttcgtgactggactcaaggaacacaaaaaggtcaacttgtttttgtgactatctattgcttttctttttttttttttttgagatgagtcctgctctgtcgcccaggctggagtgcagtggcacgatcttggctcactgcaacctccgcctcctgggttcaagtgattctcctgcttcagcctcctgagtagctgggattacaggtgcccgccatcatgcccaggtaattcatgtattttagtagcgatggggttttgcaatgttggccaggctggtcttgaactcctgacttcaagtgatccacccgccttggcctcccaaagtggtgggattacaggcatgagccactgcacccggcctattgcttttcaaaaaccaaggtataggaatagattgaaatagagatttctctgaaacagtgctggacgaacgcctgaaggggctcacacaacctgtgccaggacttggtgaccattgtttgtgtccacgttcaattgagttcaaatttaatatttaacttttcctccacacaaaagttcccatgaacttttaaaggataatcaatgaatattatgcacaagtctatgcccacagctttgacaatgtagagaaatgtaccaatttcttgaaagacacaatctaccaaaactcacacaagaaatggacaatcagcatagtcctatattgttaaagaaactgaatcaataattaataactttccaaaacagaaagcaccaggcccagatggattgactggtggattcttttaaacatttaaggaagaagttacagtcagccctctgtatctgtgggttctacatctgtggattcaaccaaccacggatcaaaaatatttgaaaaaaaaagaaaaataacaatacaactataaaaatagcatatataaaaatccaggatagtagctatttacataacatttacattgtcttaggtataagtaatctagagatgatttacaatatacaggaggatatgcatgggttatatgcacataccacaccatttaacataaaacatttgaacatcctcggattttggtatgtgtgggggattcttggaaccaatcccctgcagattccaaaggacaactgtataccaattatctgcaacctctttcagaaaacagaagcaaagggaataccttcttcattctatgaggccagcactatactaataccaaaaccagataaagacatttacagaaataaaaattattgaccaatattgctcataaacataaaagcaaaaatattagcaagttgaattcaacaatgaataaaaataatatcatgaccaagtggaattcatcccaggcatgcaaggctggttaaccattcaaaaatcaattaaagcattatatcgtatcaacaggctaaagaataataatcatgtgatcataccaatagatgcagaaaatgcatttgacaaaatccaatacctattgatgataaacagcctcagtacactagaagtagagggaaacttcctcaacttgataaagaatatcttttaaaaaaaaaaaactcctatggctagtaccatacttaatgctgaaaaactcaaagctttccaagaatgatcaggggaataaagtaaggatgcccctttcaccactgcttctcaatattatcctacaagtcctagttaacgcaataaaatgaaaaaaataaaaagtatatatattgggaggaaagaaacaaaactgcttttgttcacagatgacatgattgtgtaaacagataatctgaaaggacaaaaaaaaaaaaaaaacccatccctggaactaataagcaattaaaaacaagttctaagatacaaagttaatatacaaaaatcaaccacttttcctttatgtcagaagtaagtggaatttgaggcaaaaatataataccatttacattagcactccactaaaccaaataattaggtataaatctaacaagatacgcaaaagatctatataaggaaaactataacactctgatgaaagaaatcaaagaactaaataaatgaagagagattctatgttcatggataggaagactcaatactgacaaaatgtcagtttgtcccactttgacccaaggattcaacataattccaacaaaaatcccagcaagttattttatggatattaacaaaatgatcctaaagtttataaagagaggcaaaagatccaggatagccaatacaatattggagaaaaacagctggaggactgacactaccaaactttgagacctaccaggaagctatagtagacaagacagtgtgatactggcaaaagaataggcaaagagatcaacaaaacagaatagagagcccgaagtagactacacaaataccttcaactgatcttatatacacatgcaaagtgctcagagaagcccctggcatataatccagtggacgtaaatgttaggtattatgaccattaccccctttgatccaacccatgtttctatccccatctctttgacattttcctcttttgtacagacgttttccaaaactagctcctcctttcactgtctcattgcctaccttgtatgagtctagagatatcagaaaagtaagatcgacatgatttcctacatttggagagggatgttaatcatgttcacagtttctctagagaaaggcttaactgtaccttaattagcaaatcagtaaaaacatttctattacatatttagtttaaaatagcaatttattcaaaatattattgataacttaagaatcatttattctatgaagtcttctttgaaacttcctagcttctctcgccctctccaaaccaaagaatcaggccacgctgttcctctactatactccaaaaccatctttattatgaataacaacaacaataataacctatcctcctctatatttccctagaactttttatctattaatactaatctggtaaagaaaagccgacatcattatctttatgtgtcccttggtatctgtggaggattggttccaggtcccctcactaatatcaaaatctgcagataatcaagtcccacagtcagccctcaggaagctgcagatatgaaaaactggcccttgatatccacatatttttctctcaacaacccatctatactaaattccataaccctatatctcaggcttatttgtgactgcaataagcctttttattctagaatagcagctatcaaaagagtccccaatgtcaaaattattttcataataaacctaagatattggttgtttctttactgtgagtaaaactgcttgtgtcttaataggaatcaaagcagtggcaccaaactatactagtaattgctgtattctttatagctgcacatttgcaataaaaaagtcagttttaattgaaaaggcccttgatgaggcaataaacattttaatttcattataactggcattatatatgccaaacatattttggcagacatgtatttggcagacattttctcaacataaatcaactgggcctgtcacttcaagataaagatctaagacaatttgttatcaatgataaaatatgagctttcaagcacctgagagttttgtaatattttaagacttctatgacaaatattatcatactattagttaatttatattttaagtattatatagtgacatgtgtcaatatttggaagctgtatataactcactaaacccatatttgtcaaatgaccagtgcatgatattataaaatcatgcatgtgaaagatccattcaaagtgcccagtagaccaacagattttaatgtaaccataagaaaagttcacagatgtggttacaaattccacactgtaactaacctttaagaaactactattcattggatattggagcagtatataaagaaaagtatccgtaattatctgaaaaagctactaaatactccttcctcttccaatgacatatttttgagatttgattttcttcatatacttcaaccaaaaaaatcaaatcacaagagcttgaatgcaaaagcaggtatgagaatccagctgcttctatgaagccaaatatcaaagacatttacaaaaatgtaacacagtatcactcttttctgtatttttttgttttggaaaagatggttatttttcataaaaacatggtatttttgttaacatggaatgggattttgttatttaaaagtgggtaaatttaaaaaaaaattttattttagttgtggctgggtgcgatggctcacgcctgtaaccccagcactttgggaggctgaagtgagtggatcacttgaggtcagaagtttgagaccagcctggccaacatggtgaaaccccacttctactgaaaatataaaaattagctgggtgtggtggcacatatctgcaatgtcagctacttgggaggctgagacagaagaatcgcttgaacctgggaggcggatgttgcagtgagcaaagatcgcgctattgcactccagcctgggcaacaagagagagactccatcttaaaaaaaaaaattagttgtaatttctaatatataaatgaattgataaaaccacataaaactcttttagaattctcaataatttgtgacagtataaagggtactgagactaaaagtatgggaactgctattttaatgagaatgggtgttaacatgtaactatccttggcttaaactacttgggtagcagaacggtataatccttggtagaactggaaagttttatcaggctacaataaaagccaaaaatatctttcaaaatccttttactttctctcaacaaacttctttcgtgaataaggtacatcattttctaaaatgagcctcagaatcaggaaggaagtatgtgagcttaggttataacataatgtaacgatacagcctgcatcatcagttctaccaccaccacaaactgcccctctgataaaaagtgaatcagttctgtgaattaacagcaaataatcccattctcatagaagtctgtcattcatatcattagctaatcactaggcttggtaaatggtactaaaaaacatacactagagaatgatgactgcatattttcacatctttaaagaaactacaggttttcaataaggacaaacaaaatcccttcattttagttctaattctaccaaatatatttgacttctcaaattgaagttacctaacagaaataacaatgcaactttttataaccatatacatataggcatataagtcccctcttatccatggaggatatgttcaagatcccacagtggttacctaaaactgtggataataccgaaccctgtatgtactatgtatgtatgtatatggaaccctatatgtactatgttttttcctatacatacataacaatgatgtttagtttataagttatacatagtaagagatgaacaataactaataataaaatataacaattatgatattagactataataaaagttatatgaatggggtctctctcaaaatgtattattgtattatacttgcccttcttatgataatgtgagatgatttaatgcctctgtgatgagatgaaaggtgaatgacataaacattgtgacatagctataggctactattgaccttctgatggtaaatcagataagatggctactaagtgactaatgggtgcatagtgtatacagtgtggataagctggacaaagggatgatgcatatcccaggtgggatggtgtgagatttcatcatactactcagatggtgcataatttaaaaccaatgaattgtttctggaattttccatttaatatttttggacctcagttgaccatgggtaaataaaaccacagaaagcaaaaccatgggtaagggggaaactacagcagatctattaaatgagcagtcagatattttgctgcctgaaactagaaaaaataactattaatgtgcccatttttctcaaatgctttgcacatatagacaatataagagaaatataccagaataacaaaaatgtccatagcactgtgattaaattgaatgatctcttgaaggtgaaatattataggtttcaatatttcccaagaccttcatctgcatccataaatgtttagctattgagccatgttttaatgtataacatttaaattaaatgtgtctctttttaaaaagcctgtaagaaaattccttctcctaatagaaaataataaacatataacatcgagaaaaagaatgtgagagtttagatagtaagaccaccttagttacttaaatagcctcataaatatgttagtttacactataagaataattctgtgattaaaaaagtattacccttaaaacttttgggaaattccaaggatcaattttcaaatccaatagacttcttcaaaactcagcttaatgtgaccacagctcaaatagtatagtaattaatggttggcctggtcagattttttttactaaatttttcacaaagaggttgttaagatagttaactagacactggttacgtatgagatcctctatttcacacgtaaatgacattaaatatattgtgcatttaaaaataccattagaatcatagtttataggaaattttgaattctatattctcaaataaaatacagtaacatagacatagtctatgttacacagtttacaaaaattctttctcaaaggatgaaaagaaatgaccctaacctgcagttaaatgagtctttttcaaattcactgtatcataagattaagcaataatagatttgggagtatcagaatacaaactcacaatttaatgagaagtactcctcatagaatttggatttcaaatataacaatgctagctggtttagtcttttccattcttaactaaaaatgtgttagagaaataaacaatgaggatgtggacattacaattcttgaacctgggtttaagtcacacttctgacaggaatgtgaggaaaatgtttagacagctggagagtagtcactaaaagatagtaagcaggatgataagcattatacaaacaggataaaaatcaggatttttctctccccagtgtctttataggcaaacaggaaaaaaaaaaagctatcacaggtgcaaaacccaaaatgtttagaatcgactgtcataacagactgacctaacactgtgccctccttttttcaagtcactgagaaaacacatatatttgtaatggcaaaacataccacataatctcacaataccgttttgatacctgcatgagtgtatgagcaacgacttgtttttgacaactcccttctaccttgacttcaccatttcacacataccatgcccataaaaatgttaacaacgtatctgggaacaggcaatgtgggaatccttttcaggatgttcttctgtctttgtttatctctagttttctttaagaacttagtataacctataagcaaattatacttcaagtttgcaaggctggaattgttagacattgctaaactctatatgttaatgcattacaaacacccgctttgtttacttgcttgtttgtttaattgcccaaatgtatgaagtagataacttgcaaataggccatccatctgcaaataaaaggtacgtgctaatataataatctctcaggtttgtaagatattttatatataaccatatctcacaagactcattctacaaacaatgaaaccaagactgttagacattaaggtcataaagagtttgtggcactggcaggactagaatccaagtctctgcatttctataaaccgtgttctttcacttctaaattaccttcataaatcaccttatgcatattgttttatgctaatataaatacatggcagaaaaacttaagaaataaaatgaaagtgaaataaattttgtaacatgtaacatttcctagcaaccatttatctctgaaggtatgcatgtatgtatgtatgtgtgtgtgtgtatttatccaaaggagggcatattgtatatatagttatgaatcctgtttttctccccttcctataacatgtattttcccatgtatttatatatttttaacataattatttttaataactgaatattataccatcatgtagatatagataaaatatcataaccaattccctattgttggttaagatgtttataattttttataattaatgctgaaataagcatagtactatataaatatttccagatatgtctttttattttctcagggaaatagaactggttttctagagcatgcacaagttgagcacaaaaatgtttaattatccttgaattcctttttaaaggttaagcaaccccaaaattgttttgtttttcctgatacatttctaaagaggacagaaaagaagtgataacaaagaactgttattataaactatattctgaccaaagaagaactgatttgtgaataaagtaacagaagctttaggagactgaagtctgtgccaagccaggccagggcagtgtcagatgtgtgctctgaacattatatagatattcttcaaaagtttgaaaaaagacccagcctggtggctcatgcctgtaatcccagcaatttgggaggctgaggccagaggaccacttgagcctaggcataagaggctgcaatgagctgagatcgcaccaccacacttcagccttggtgaagagtgagaccttgtctcggaaaaaaaaaaaaaaattaaccaagagtagtggcatgcacctgtagtaccaactactcagaaggctggggtaggaggattgcttgagcctgggaggttgagggtgcagagagctgtgatcatgacactgcacttgagcctgggtgacagagtgagattctgttcttccaccaaaaaaaaaaaaagttcagagaaaatatagtgggcagaagactttggaagagaagtcaatttaagagtttgtgacatctcaaacattttgtttttacagaataatgcatgtcacatataggcccaattttaataagcagcttttgataaagtatatacttaaaagggactatccaaaattatttgcttaaaatggaaacttaactgaaatgggtcacctatattgcttttggtaaaaatttacatccagatattttattactactatacaacatttgcattgtcctcaccacaataaaactttcattacgtgtaagataatatgattgtctgcctagagaatacatacaaactgactaaacactgtttcaactagtaagagtttacttaggtaggcagatatacaaacatacacaaatcaaaagttttctttgacatcagcaataagcaattagaaaaaagatcctatttgtaatcttaatatgttctcaaagacaaaggataagctaacctaacttctaagttttgaatattttggtatatcagtctcatgaacagattaaggctttacatttaaaaatttcatgactaaggccccgaaagtaaatgcaacaaaaacaaaaataaatgaagcagacctaattgaactaaaaaagcttctgcaaaacaaaagaaataatcaacggagtgaacagacaacttatagaatgggaggaaaatattgttaaactatggatctgacaaggactaatatccaaaatctataagaaacttaaatcagcaagaagaaaacaaataatcgtattaaaaagtggacaaatgacatgaacagatatttcttaaaagaagatatacaaacggccaggaaacatgaaaaaatgctcaacatcactaatcattaggaaaatgcaaactaaaaccacaacgagataccaccatgagaatgcccattatttttatttgtttgcatgttttttttttgtttttttgtttgttgtttgttttgagacagtcttgccctgtcacccaagctggagtgcggtggcaagatctcggctcactgcaacctccacctcccaggttcaagcaattatcttgcctcagtctcctggaactataggcgtgcaccaccatgcctggttaattttcgtatttttagtaaagacggggttttaccatgctggccaggctggtctggaactcctgacctcaggtgatccacccacctcagcctccccaagtgctgagattacaggtgtgagccaccaagcccggtcagaatggctattattaaaaagtcaaaaaaacaaaagatgttggcatggatgtggtaaaaagggaacacttatatgctgctgctgggaatgtaaattagaattgcctctagagtaaacagtaaagaaatttctctaagaactaaaagtagatctaccatttgatccagcaatcccactactgggtgtcttaccaaaaggaaaagaattcagtatatgaaaaagacacctgcatgaattatgtttatcacagcacaattcacaattgcaaagataaagaatcaacttaagtgcccaccaacagatgagtaaataaagaaaatgatacacacacacacacacacacacacacacacacacacacacacacacaccatggaatactactaactcataaaaaagaacaaaataatgttttttgcagcaacttggattaaactggagggttattacctaagaaaaacaactcaggaatggaaaaccaaataccacattttttacttttaagtaagagctaagctatgattatgcaagggcatacagtggtataacggacaatagagtcccagaagtggggaaatggggaaggtagatggggtaagaaatgaaaaactacctattgggtacatagtacactatcttggtaatgggtatactaaaatcccagactttaccatgatataatctttccatgtaaccaaaaaccacttataccccactaaagttattgaaataaaaaaatttaaaatgaagtaaatataaaaatttcaagaagaaaattaaagagaaaaataaacacttggaatagttttgaacattcaagttttgaaaaaacaaaacagaaaaaataccctgcaaactaattataagtttaaaataattccaagatgaagaccacagaagaaaagtttttgtaccaatgccatgctgttttggtcactgtagccttgcactatagtttgaagtcaggtaacatgatttttccagctttgctctttttgctgaggtttgccttggctattcaagttcctttttggttccatataaattttaaaataattttttctagtcctgtgaagaatgtcgttggtagtttgttaggaatagcattgaatctgtacattgctttgggcagtgtagccattttaatgatactgattcttcctatatatgagcatgggatgtctttccattcatttgtgtcttctctgatttctttgagcagtgatttgtaattctcattgtagagatctttcaccttcctggttagctgtattcctaggtaattatttttgtgtgtcacagttgtgaatggggttgcctttctgatttggctctcagtttggttgttgttggtgtataggaatcctagtgattttcgtatattgattttgtatcctgcaactttgctgaagatgtttattagctgaagaagcagttctaacaaaaagtggccacactgctgctttacatgagtgggtaatcctgttcctcatcactgagcaggacctcccaaccagggcctccagccaccctcgcctgaggtttccagccaacagagaactgaatttcccctgggatggtgctccagagggaggggctggccaccatctttgctgtttgggtgacttaaccgttctagtctttgggctttggagtgtctgaggcaactgggggctgaaatggaccccagcacagcacaactgctctattaaaatgtggccagactgtttttttaagcagttccaatcccgttcctcctcactgggtgggacctcccaaaaagggtctccagcaacttcctacaggtgcctttgggccagcaacaggtctgtacctccctgggacaaagctcccagagggagaaacacgctcccatctttgctgtttcacagccttcactggtgacacttctaggttctggaaaatctgaggtgactagagactgcagcgggccccaagcatactgtagcagccctatggaaaagtggccagactgttacatgggtgcctgttcccatatctcctcactgtgcaggtcctccaggcctgagcctccagccaccccctgccagaactatcaagccagtaccaactcagcaacaccctggacacagcctctctgccactacctctgcaatgtaactgcccttgtcacccttggactaacaaaggagcaaagaccctaagtaccttatccacacctccaacaagtggcagctgacccaaggagaggaggccagtctttctcccatgggtcccacaaaccccccatatcttgtcatcagacagggaacccctggcttgggcccacagcgcaaactctctatcctgggatgattgcactgagtgattgctgacctgcatctctctggggtggagcctccaggagtcaagcaaatgacccttggccacaaccactactaagatttcttcctctgctgcctctaagctgaggaaggaacataaacacagagattgccccaaagttgcagtgggcagcccaggagtaccaagtcatgaactacagccagtactcaagtgggagaggagcccatactttcaaagcactgagagggaacatggctacaactgtgaggaaacatagggaagccacacaaccaagcaagaatcaaccaactgaccaataagcctaagtgtcacctgctggatcacaccccaaagccttaacaccaaaaatacctcactaacatatccccctctaaaaccagagacaagaagtcagcttcaaataaagaccctacacaaagtcctggcctgatgaaaacatccagaaaagaagtctattgagtgtactcaatctacactgcaattaaagaaacacccacacacagagatgagaaagaacagtgcgagaactctgttaactccaatggtccagagagtctgtcatatgtcctccaaatgactgcaccagttctccaacaagagttcttaactaggccaaactggatggattgacgaatagaattcagaatatggataggaacaaagatcagtaagattcaggaggatggcaaaacccaatccaaggaaaataagaatcacaataaagtgatatgggagccaaaggacaaaatagctagtatgaaaaagaacctaacaggtctgatagagctgaaaaacacaatataagaatttgacaatgcaatcacaagtattaagagtagaataaatcaaactgaggaaagaatctcagaacttgaagactggttctctcaaaaaagatggtcagacaaaaataaggaaaaaagaataaaaaggaatgaacaaaactttcaagaagtatgagattatgtaaacagaaatctatgaatcactggcatctctgaaatggagggggagaaagcaaacaacgtggaacatatatttcaggatgttgtccatgaaaacttccccaaccttgttagagaggccaatcagtcaaattaaggaaatacagagaactcctgcaacattctacacaagaagatcatccccaagacacataatcatcagattttcaaaatgaaagaaagaatgtgaaaggcaactagagagaaagggcaggtcacctacaaagggaactccatcaggctgacagtagaccattcagttgaaatcctacaagccagaagagattgggggcctatattcaacattaataaagaaaaaaaccttcaaccaagaatttcatatccagccaaactaagcttcctatatgatggagaaatacgatccttttcagataagcaaatactgagggacttcattaccatcagacctgccttacaagagatcttgaaaggaacattaaatatagaaaggaaagacttctaccagctaatacaaaaacacacttaaacacacagaccagtgtcactgtaaagcaaccacacaaacatgacaacataataaccagctaacagtacaatgacaggatcaaatccacacataacaatattaacctcaaatataaacaggctaaatgacccacttaaaaggcacaaagtagcaagctggataaagctggataaaaacaagactcaatgatatgttgtcttcaagagacccatctcatgtgtaatgacattcataggctcaaaataaaagcatagagaaagatctaccaagccaataaaaaagcaggggttgcaatactaatttgagatagaaaaagtttcaaaccaacaaagataaaaaaaagacaagaaatagcaatacataatgataaagggttcaattcaacaagaagacctaactatcctaaattaaacaagaaaattaaccaaaatattcaggacctaaactcagcattggaccaaatggatctcatagacctttacagaagtttccacccaaaaacaacagaatatacattcttctcatcaccatatggcacatactctaaaattgaccacataattggacataaaacaatcctcaacaaatgtaaaagaaccgacatcataccaaacacactcttggaccacagtgcaataaaaatagaagtcaacacaatgaaaattgctcaaaaccatacaattatttggaaaataaacaacatgctcctgagtgattttggggtaaataatgaaattgaggcagaaataaagaagttctttaaaattaatgacaacaataatacaacataccagaatctctgggacacagctaaagcagtgttaagagaagaatacatagcactaaatgtccacatcaaaaagttaggaatatctcaaattaacaacctaacttcacaaagcaaaagaattagagaagcaagaacaaatcaaccccaaagctagcagaagacgagaaataacaaaaatcagagctaaactgaaggacactgagacacaaaaagtcattcagaggatcaataatccaggaattggctttttgaaaacaattaataaaacaggccaatagctagactaattacgaagaaaagagagaaaacccaaataaacagaattagaaatggcaaaggggatgttactactgaacccacagaaacaaaaataaccatcagaaactactatgaacacccctccgcacacaaaaactagaaaaccttgaagagattaataaattcctggacacatataccctcccaagactaagccaggaagaaactgaatctctgaacagactactaacaagctccgaaactgaatcagtaataaatagcctaccaaccaaagaaaagcccaggaactgacggattcacagctgaattctaccaggtgtacaaagaagagctagtaatattcctatagaaactattcccaaaaattgaggaggaaggacttcttcttaactcattctaggaggccagcatcatcctgatacctaaacttggcagagacacaacagagaaagaaaacctcaggccaatacccttgatgaacatcaatgcaaaaatcctcaacaaaatacttgcaaactgagtccagcagcacatcaaaaagctaacccaccatgaccaagtaggcttcatccctgggatgcaaagttggttcaacatataaaaatctgtaaacgtggccaggtgcggtggctcatgcctgtaatcccagcactttgggaggccgaggcaggaggatcacgaggttaggcgatcgagaccatcctggctaacacggttaaaccctgtctctactaaaaatacaaaaaattagccaggcgtggtagtgggcacctgtagtcccagctactccggaggctgaggcaggagaatagtgtgaacctggaaggtggagcttgcagtaggctgagatcgtgccactacattccagcctgagcaacagagcgagactccatctcaaaaaaaaataaataaataaacaaataaatctgtaaatgtgattcataatataaacagaactaaagacaaaaaccacataattatatcactagatgcagaaagggcctttgataaaattaaatatcccttcacgttaagaactcttaacaaactacatattgaaggaacatacctcaaaataataagagccatctatgacaaactcacagcccacattatacagaatggtcaaaatctggaagcactccccttgaaaactggcacaagacaaggatgccctctctcaccacttaatattggaattcccagccagagcaatcaggcaagagaaagaaataaaggacatccaaataggaagagaggaagtcaaactatatctgtttgcagatgacatgattctatatctagaaaaccccaggctcagcccaaaagctccttcagctgataaacaacttcagcaaagttgcaggatacaaaatcaatatacgaaaatcactagcattcctatacaccaacaacaacgaaaccgagagccaaatcagaaaggcaacccattcacaattcccacacataaaataataaaatacacaggaatacagttaaccaggaaggtgaaagatctctacaatgagaattacaaaacactgctcgaagaaatcagagtagacacaaacaaatggaaaaacatcccatgctcatgtataggaagaatcaatatcattaaaatggctaccttgcccaaagccatttacagactcaatgctattcctatcaaactaccaatgacattcttcacaggactagaaaaaactattttaaaatttatatggaaccaaaaaagagtctgtatagccaaggcaaatctcagcaaaaagagcaaagctggaggaatcatgttacctgacttcaaactatagtgcaaggctacagtaaccaaaaatagcatggtactggtacaagcacagacacacagaccaatggaagagaccaatagagagcccagaaataaggccacacatctatggccatctgatctttgacaacgctgacaaaaactagcaatggagaaaagactccctaaatggtactgggataactggctagccatatgcagaatactgaagctggaccccttcctcacaccatatacaaaaatcaactcatgatgaattaaagacttaaatgtaaaacccaaaactataaataccctggaagacaacctaggtaataccctcatggatctaggaataggcaaagatttcatgacgaagtcaccaaaaccaattgtaacagaaccaaaaattgacaaatggggtctaatttaacttaggaacttccgcacagcaaaagaaactatcaacagagtaaagagaagcctacagactgggagaaaatttatgcaaactatgcatctgacaaaggtccaatatccagaatctataaggaacttaaacaaatttataagagaagaacaaacaacctcattaaaaagtgggcaaaggacatgaacagaccattttaaaaaaagacatacatgtggccaataagcatatggaaacaagctcaatatcactgatcattagagaaatgcaaatcaaaaccacaatgagataccatttcacaccagtcagaacggctatattaaaaattcaaaaaataacagatgctggcaaggttgtggagaaaagagaacccttatacactgttggtgggagtgtaaattagttcaaccattttggaaagcagtacggtgattcctcaaagagctaaaagcagaactaccatttgactcagcaatctcgttactgagtatatacccaaaggaatataaagcattctaccataaagacccagacacgtgaatgttcactgcagcactgttcacaacagcaaagacatggaatcaacctaaatgctcatcaatgacagacaggataaagaaaatgtggtacatatacacatggaatatcatgcagccataaaaaagaaagagatcatgtcttttgccggaccatggatggagctacaggctatcatccttagcaaactaatgcaggaacagaaaggcaaataccgcatgttctcacttataagaacatatgaacacaaagaaggaaataacagacactggggtctacttgacaggggagggtggaagaagggagaagaacagaaaagataactattgggtacttggcttaataacttggtaatgtaataatatgtacaacaaacccccgacacatgtttatctatgtaacaaaccttcacatgtaccctctaacctaaagtaaaaaaaatatatatatatatatatttttttaatttttttattttatttttttttgagacagagtcttgctctgtcgcccaggctggagtgcagtggcgtgatctcggctcactgcaagccctgcctcctaggttcacgccattctcctgcctcagcctcccgagtagctgggactacagatgccctgcaccacgcccagctatttctttgtattttttagtagagacgggtttcatcatgttagccaggatggtctcgatctcctgacctcatgatctgcctgagtcggcctcccaaagtgctgggattacagacgtgagccaccgcgcctggccaaaaattttttaaaagttagaaattataatataaaaaaactcaaactactgaagacaaaaaccataatgtctgagataaaagacaaatcaaatgatattcacaacagattagatgctatggaagaaaagactagtaaacttaagtttacaccaataaaaattatctaaaataaaacacacacacacacacacacacacacacagagagagagagagagagagagaaaacgaaaagagaatcagtgagctgtaagagaacttcaagtggcctaaaatataagtaacaggaattaaggcgtcggggggagcaaaaatattttaagaaataatggcaaaactaataccagatgcaaatatgactgcataaaacaatgaagaataccagatggagtaactacatgggtaaatgcataagattttttttattatttaaatatcttttaaagatgattgactatataaataaaaataacactgcagcatggggtttatagcatatataaaactacaatatatgtcaacaatagcacaaaatttgggaagggagaaatgaaagagtactcttgctgtatagttcttatactataggaaaagtgatacagtatcacttgaaagtagaatatacaaattaaagattgcataagttaaacaaggattgtttaagcccaaaagtaaccactaaaatgaaaatacagtgagttgtaactaataagccaacaaaggacttaacctaaaagaaggctgaaaaataaagggtaaaaaggaccaatggaatgaacagaaaacagtaaaataatagattccagcctaaccatattagtcatcacattaaatagattttaagaccacgtaaaaaagcaagacccaactacatactgtgtacaagaaacattttaaatacaaagactcgaaaaggttaaaagaaaaaggaggggaaacagatatattatgctaccattaaataaataaagctaaagtggctacattaatatcaacgtagatttcagaaattttttttaaacaggaagaagacattttataatgatatatgggccaattaatcaagagaacataaaatcctaaacatttttgtacataataaagatctttgaactatgtgaaacaaatctgatagaacagcaagagggaagaggcaaatatcctctatttcagtcaaagatttcaaaaccccctctcaataacagatagaacgaatagaaaaatagtgaggatatagacgatctgaacaatctgtcaatcaacttgacctatttgatgtttatagaacactccacacagcagcagcagaatatgcattcttctcaagtacatctgaattagttgccaaaccagaccatatactgggccactaagtaagccacaataaaattaaaatgatttaaacaatataaaatatgttctcatgtcaaagggaattaaattagaaatgaaaaacagaaatatctcttgaaaaatcataaatttaaaaactaaatgcatacctaaataactcataaaccaaagaagaagtcaaaagaaaaaatggaaattattcagaactaaatgaaaatgaaaacaacctataaaaatttgtaggatgctactaaagtagtatgtaaggggaaatttatagcactaaacacttaaaatgttatagaaagcttcaatcgatgaactcagtttccaccttaagaaatcagatgaagagaaagttaaatcaaagtaaataaacaagaaaagataatagggataaaaacagaaatcaataaaataaaaagtagacacagtaataaaaaatcaactaaagcaaaagtttgttctttgagataaaaaaaactttagccacactgatcacacacagagaaaaaaatgttaatatttggaataagatgatatcactagaatttctatagctattaaaaggatcataagggaatattatgaaaaacatcctataaataaacttgacaacttagacgaaataaagaaattctctaaaagacacaaactactggccaggcacagtgacgcacgcctgtaatcccagcactttgggaggccaaggcaggtggatcacttgaggtcaggagttcgagaccagcttaacatggtgaaaccccgtctctactaaaaatacaaaaactagccaggtgtgacggtgcatgtctgtaatcccagctactcaggaggctgaggcaggagaatccttgaacccagggggtggaagttgcagtgagccaagatcgcgccattgcactccagcctgggcaagaagaacaaaactccttctcaaacaacaaacaaacaaacaaacaaaaaaccagacaaactaccaaacctcactcatgaagacataacctgaataaccctatatccattgaagaaaataaaactatagttaaaaaactttccacaaaaacaaaaacaaaaaaccctacagttccagatggcttcactggtaaattctactaaacattaaaggttttttccttaaaaaaataacagcaattctacccaaactcttctaaaaaaacggaaaaatatagaatactttccaacccattttataaggccgacattaccaataccaaaacttgataaagacattacaagaaaactacagttcaatatccctcatgaacacagttgtaaaaatactaaatatctatatatctatatatctatatctatatatatatatcttttattttagcaaattgaatccaaccatgtaataaaaggctaacatatcatgaccaagcggggtttaacacaggaatacagggttgatttacatttgaaaagcaatcaacagaattcattttaacatgtttacataaaaaagaaacaaactaagaaaaatgatatgatcatttcaatacaaacagaaaacgcatttgacaaaagtgagcaaacacttctgttaaaaactctgagtacactaggagaaaaaccagatttccttaacctaataaagagcattgatgtgaaatccacagctaacatcatacttaatgttgaaaaaccgaatgcttttccactaagatcagaaacaagataggcacgtcttctatcaccacttgtattcaactttgtgctccaggttctagcctgggcaatcaagcaaaaaaaaggaaggaacccgattgctgaaaatctacagagaaaaatctacaaagagtggactctacaaagagtgtctagaacaaataagtttagcaaggtagtagaacacatgatcaatatataaaaatcaattacatttcttcctattagcaatgagcaaaccagaaatttaaattaaaatgtcatttataaaagcatcaagaatatgaactaggctaggtatggtggctcacacctgtaatcccagcattttgggagtgtgaaatgggaagactgcttgaggccaggagattgagaccagcctgggcaacacagtgggaccctgactctgttttttttaaaatgaattacttagggatacatatgtcaaaagatgtgaaagagctggacaatgaaaattacaaaacactgctgaggaaaactaaataagacccaaacaaataggaagatgtatattgttgaagggctggccaacttgatattgtcaagatgtcaattcttctacaagtcaatctatgtttgaataaatctacagatttgatgcaatcccagtccaagtgtcaccaggttttttggttgtgtgtttgtttttttgagggggagggggaaagtgaggacagtagaagttgtaaaactgagtttgaaattccagtgaaaatgtaaaggacctagaatgccaaaacaactctgaaacagactaaattggagaagtaacactacctgattccaagaattgtggtaaagcaacattaaccaaaaaaacaaaaacaaaaacaaaaacaaaacaaaaaaatgcccagcatagtactagagtaaagaaatggaaataaggtctggtgtggtgactcacacctataatctcagcaccatgggaggccaaggcagaaggattgcttgagtccagtagtttgagaccaacctgggcaacatagggagaccctgtctctataaaaaataacgacaaccaaaaaacaaaaacttagctgtctgtgcatccagctcgagaggctgaggtgggaggatcaattgagcccaaaaggttgaagctgcagtaagctattatcatgccactgaactccagcctggcaacaaaatgatacccctcccccgaataaaaaaaagaaatgcaaacagacaaataaaacaaaacacagaaacccacacatagaaggacaactgatccctttccattaataagaaactttaacacttgctcaagaaaagtgtaactattgttaggtgttcttaaagcaggggataatgaaatcatgaaatgaagcaatgtgttaatggagaaggtccctctgctgcaggcagcagaaattctccctgcaaattggattacctgatctattgctgcttgcaaactgccagctgcaaacctagcatagcacccacatggttaaattttactttacatgtatttatacagtattaagtgcttccttaagtgattttttaaaataaatcataggcaattgagttctgattacaactcaccctttcctgaatcctcattttggtcagtttgagaaacaaggtgcttttctgtttgaatccaaggtctagccctctggctaagggtcctacataccactgacctgaccattttaaccactttcagagctgtgactttagaaatactgttttcctatttcttacccattctcattattcagactctagcactgtgtttaagacttgggattctagaataaaagacatattcaaatttcagacttgctatttacttagctgtgtgggctctccacaatcctttaattaataaaatcttaatgaaaatactgtgatataccttacgtagcttttataaaaaactattttatgcacctaaaatgtttaacatagtacctagcaaagagtaaatatttaataaatagtagctattgtattatcattattactaatattattaccgactcagcccccgtcacccctttcaaaataatgtcaacttgattcttctctacctcaaaacttgaatcaattcacagcattgttgccctcaaggagctgatgaatgaaaatacatactgattattttgaattctttaaacaattaaaatatgaatatatttttattgccgaaagcccaaacaatacagaaatttgtagagaaatcattcaaattcttgctgcccaaccaaatgatgtggggcactctacccctcacttccagccatattaatcattattaattgctttatgtgtttccttccaaatatttttgtatgcatttacctacatatgtatgtgtgcatataaatattcaggcataatttgaatagtacaatgaaacccatttacccttatttagatacactaattgtcaataattcaccacataaaaataactaattttgatttttttatattctactttaagttctagggtacatgtgcacaacgtgcaggtttgttacataggtatacatgtgccatgttggtttgctgcacccatcaactcatcatttatattaggtatttctcctaatgctatcctcccctccccccaccccccaacaggccccagggtgtgatgttccccaccctattccaagtgttctcattgttcaattcccacctatgagtgagaacatgtggtgtttggttttctgtctttgttacagtttgctaagaacgatggtttctaacttcatccatgtacctgcaaaggacatgaactcatccttttttatggctgcatagtattctatggtgtatatgtgccacattttctttatccagtctatcattgatgggcatttgggttggctccaagactttgctgctgtgaacagtgctgcaataaacatacatgtgcatgtgtctttatattagaatgattgataatcctttgggtatatacccagtaatgggattgctgggtcaaatggtatttctagttctagatccttgaggaatcaccaaactgtcttccacaatggctgaactaatttatactcccaccaacagtgtaaaagcattcctatttctccacatcctctccagcatctgttgtttcctgactttttaatgatcgccattctaactggtgtgagatggtatctcattgtggttttgatttgcatttctctgatgaccaatgatgatgagcattttttcatgtgtctgttggctgcataaatgtcttcttttgagaagtgtctgttcatatcctttgcccacttgttgatggggttgtttttttcttgtaaatttgtttaagttctttgtagattctggatattagccctttgtcagatgggtagactgcaaaatttttctcccattctgtaggttgcctgttcactctgatggtagtttcttttgctgggcagaagctctttagtttaattagatcccatttgtcaattttggcttttgttgccattgcttttggtgttttagccatgaagtcctcgcccatgcctatgtcgtaaatggtactgcctaggtttttcttctagggtttttatggttttatgtctaacatttaagtctttaatccatcttgaattaatttttgttataagatgtaaggaagggatccagtttcagttttctacatatggctagccagttttcccaacaccatttattaaatagggaatcctttccccacttcttgtttttgccaggtttgtcacagatcagatggttgtaggtgtgtggtgttatttctgaaggctttgttctgttccattggtgtatatatgtggtttggtaccagcaccatgctgttttggttactatagccttgtagtatagtttgaagtcaggtagcatgatgcctccagctttgttcattttgcttagaattgtcttggcaatgtgggctcttttttggttccatatgaactttaaaatagtttttttccaattctgtgaagaaagtcattggtagcttgatggggatggaattgaatctatagattactttgggccatatggccattttcacggtattgattcttcctatccatgagcatggaatgtttttccatttgtttgtgtcctcttttatttcgttgagcagtggtttgtagttctccctgaagaagtccttcacatcccttgtaaactggattcccaggtattttattctctttgtagcaattgtgaatgggggttcactcatggtttggctctctgtttgtctgttattggtgtataggaatgcttgtgatttttgcacactgattttgtttcctgagacactgctgaagctgcctatcagcttaaggaggttttgggctgagacgatggtgttttctaaatatacaatattgtaatccacaaacagagacaatttgacttcctctcttccaaattgaataccctttatttctttctcttgcctgattgccctggctggaacctccaacactaagttgaatagaagtggtgagagagggcatccttgtcttgtgccggttttctctttttttctctctctctctttttttttttttttttttgagagggagtctcactctgtcacccaggctggagtgtggtggcgtgatctgagctcacggcaagctctgcctcccaggttcacaccattctcctgcttcagcctccagagtacctgggactacaagcgcccgcaaccacgcctggctaattttttgtatttttcatagagatggggtttcaccatgttagccaggatggtcttgatttcccaacctcgtgatccacctgcctcggcctcccaaagtgctgggattacaggtgtgagccgccgtgcccggccattgtgccagttttcaaagggaatgcttccagtttttgcccattcagtatgatattggctgtgggtttgtcataaacagctcttattattttgagatacattccatcaatatctagtttattgagagtttttagcatgaagggctgttgaattttgctgaaggccttttttgcatctattgagataatcatgtggtttttctcactgggtctgtttatgttatggattacgtttattgatttgcatatgttgaaccagccttgcatctcagggatgaagctgacttgatcatggtggataagctttttgatgtgctgctggatttggtttgccagtattttattgaggattttcgcatcaatacagaaatttgtagggaaatcattcaagtttttgccgcccaacccaatgatgtggggcactccacccttcacctccagccatattaatcattattaattgctttatgtgtttccttccaaatattttttgtatgcatttacatacacatgtatgtgtgcatataaatattcaggcataatttgaatagtacaatgaaacccatttacccttacctagattcactaattgccaaataagtcaccacataaaaatacctaattttgacttttaaccaaaatatcttttatatcttatatagcctttaaggtagatattaagactatagttcctaaagccaaaacttcacaaacggtttctaagaaaacatgactcatatcaaggatttgtatattttaagggaaatttaagattctagtcagcacaaagtgttgacatttcaaaatctctcaggcccaacaacctactcacttcttgaagctcactaccttttaagagtcagaaatcttatgtataatgactcaggaaacagttgaagatatacttctattttttttttcaattaaaattgacaaatagtaataattctttgatttttaagaataaatgtaaaagtacttaaatagaggaaataaggtgagttccatttcaattccttttcctttcttgtaaattataaacgttggaattttactaatttcctggacaacaaatagaaggaatgctatcatttggggcttttccactaatggctgcattactatgttctcaaaaaacaaaaaaatccagtggaatcttttttttttttcttttttttttttttggagacagggtctcattctgttgcccaggctggagtgcagtggcaccatctcagatcactgctgcctcgccctcccagggtcaagcaatcatgatcctgtcaagtagctaggactacagatgcatgacaccacatatggctaattattattattattattattatcatcatcatcatcatcattatttttggtaaagacaggtttcacttttttgcccagtctggttttgaacccccgggctcaagcaatccgcctgccttggcatcccaaagtgctgggattccaggtgtgagtcatcgcacccagtggttatcttgctttcaattgactccttcaaaaggccaatatataatgtgatctgagtaatgggatgtattgcaatatgggatctacagggttgctgtgaatatgaagtgcttagaattctgcctagcaggtaagtaatcaataaaggcttatctgaagagaaataaagtaagcttttacttacaatgagttatagttatgtgtttcctatatcccttgtaaagttgaagtaaaaattattaaaattattttcattttaaaattattaaaattttcaaattccttattaaattgaaattaaggaagagcaatttccttaacaaattatatggaagaaaatcaaagaagaaactatagattaagaaagatttaagtggcccagcacagtggcttgcacctgtaatctcagcactttggaagggccaggcgggcagatcacttgaggtcaggagtttgagaccagcctggcctacatggcgaaacactgtctgtctctactaataatacaaaaactagctgggtgtggtggcatgcacctgtagtcccagctactcaggaggctgaggcatgagaattgcctgaaactgggaggcagaggttgcagtgagccaagattgtgagatcgcactactgcactctagcctgggagacagagtgcggctccaactcaaaaaaacaaaaaaaaagatttaggagacctatcaaccaaatgcatatgtagaccttgtttggatgtgaattcaaacaaaccaactgtgaaaagatagtaaatgagcaatatacacacttacatactacaagtggggaaatataaagactgcagatggttggtgatattattacttatgttttaggtatgataaatgacactgtggttgtgttaagaaaaaagaggtcttttagaagtactctaatatttatgaacaaagtgatatgaagttgaatcaaatgtaattatcattttataggtgaaaataaatggatgtagacaatttcgtatgattcaattaatacaatatttgtagtttgcttcacaataatccaattagaagggtttgaggccagtaggtagacaggtataatagagcgggaaagaaagagtgacccagagttaacgattgctgtagttgtatgatgagtacatgggagttcattgttctctatttttatcttttaatttttctatgtttttaacaagaaaaccaagagaaccctaccttatacaactgtgccttgcctaatgcttattagcactatatttgataaataataaataccaaaaacatagatgttgaacatgtttgaatcaatattctcagaaaggtccatttataagaaatgatgaattcacaaaaactcagccagcaaaggaagatcaaatggaaagacaaaaattagaaacaaaatgttcttcgaattttataaaactctcacatgtgactgactgacttttcattctgcagattttattatctctcaaagttatctctcaaagtctgtgatagctatatattcatcttttgcttattttaagtgttttatattattttacttaggctgattaaaaaatatttgcactgaactccattacctatctctgtttattaagtttagatgtagttatagactagggagaacagagaaaattgaaaatgtgtacattagattccccagagtaattttgtttttggtttttacatcagacacacacaattttaaatacaagtttatccatctgaaaagagatttcttgcttatagccaggtcaattttgtttacacatatattaaatacaatttgctaaatatagccaatgttaataagaatagattcattttaccctctgtatgtctggaatggttaagatataatagtttaaaagttacagaaaaatatattaatgtttccttaatattagggagaacgtgttaacatttaaagctgtcaaacaatggaataaactatgtcctagagaatgagaaccccttacttcacaaattaaaccagaagttggatggcaatttatcagatatactgaaaaagagattcacagagaaggctaaaacttgataatctcatggcctgtgccaccagacagacaagaatcttgatctgactcttaacttaggttataattttggtaaattacctaatttctctaaacctcagttttccttgaacacaaaatacatcattactgtcaagattaagtgatatcatgcatgtaaactggttagcattctgcctcagacattgtaagtgattaataaacactgttatagaattatgaccagtcacacaatcagtactcaagtaatgagtaacatcttcactactactgctattgctatgtaagagaataataggtagttgatatggtttggttctgtgtccccacccaaatcttatgttgaatcgtgatcccaagtgttgaaggtggggcctggtgaaaggtgattggatcatcggggcagatttcccccttgctgttcttatgatagtgaatgagttctcatgaaatctggtagtttaaaagtgtatagcactttccccttcatttgctgtctctcctgccaccatgtgaaaacatgcttgcttcctctttgcccttctgccatgattgtaagtttcctgaggcctctctgccatgcctcctgtacagccagactgtggaactgtgagtcaattaaacctcttttctttataaattaccggtcttgggtagttctttatagcagtgtgagaacagactaacacagtaattgatgaatgcaacagaggacacctctagcctgagacataaaggatgggatcgtagaggaaacagaaaaccatttctggtagtttttttttttttctgcgagttggcaaattagaggctttgttaccatagctcacccactcagaaatagcaaaatagcatgtacagattcacatggtgaactttcatccaagaagaaacatgagagctaaatataaaagcaaaagaataattgaatactttgaaaaatacagtgggcattaggctacgctgtggatctgtggtggaaaactgtgagtgaatcaccagtgtatgacgggggagagagtatcttacaatacatatttctactaaggaacgaggcaatccaggccactggggagctccgtgaccctactgagagctagatcttaagttggagaacagggagactgtaagaaggaatggcagtagaaagtgctccatatgcactcccgtctccaactactgacagaaggccattcttgatccaactaagggggctgcacgaaaaccagccagccagcacaggtggcagacactggtttggagaatcttcagatcaggacttgcaatccagtctctagtgggacaggagcccctatggccagaactgagaggtgagaatatgtgggctccagctttgggtacaggagttgggcactacccgtttgcagcatgggaccaggaggggtgtggcctgggagccatgtttttgtctcagggagggagctttgagacctggggcgatgttacaatctgaagaaagactgcttataacttggctggctgtattagcataccactggcagcaggccatgggagggagccctgccaggctgaaagcatggacttcaggcaggtcccactactgcctgctaggctgtggaaccaaaactacccttctgtccctgtattggctctttgacacagcaccagttgctctgctcctccctcgagcattgccccaggggcctgagaactgctttctgatcctccttggggacagcacttgtgcttggtgttggggatgccggagcatgggactgtccagcctagccccatttggccttgcctccatcaacctgcatctgaggaagagcttgggaacagggcccctgggagttccacagcctagtccatcacctaagacatcagagtacctctggttaacaaaggtcaagcatattgccaccacctcagctggatctcgcatgctagcgccacctactggctgcaaggccaacctgcagagcttattacattatctgttgataaaattgcatggggtttgaccactgctcaaggaaataaaagaggacacaaacaaatggaagaacattccatgctcatggataggaagaaccaatatcgtgaaaatggccatacggctcaaagtaatttatagattcaatgccatccccatcaagctaccaatgactttcttcacagaattggaaaaaactactttaaagttcatatggaccccaaaaagggcccatattgccaatacaatcctaagcaaaaagaacaaagctggaggcatcatgctacctgacttcaaactatactacaaggctacagtaaccaaaataatatggtactggtaccaaaccacatctatacaccaatggaataacaaacaccacacatctacaaccatctcatctttgacaagcctgacaaaaacaagcaatggggaaaggattccctatttaataaacggtgttgggaaaactggcaagccatatgcagaaagctgaaactggatcccttccttaaaccttatacaaaaattaactcaagatggattaaagacttaaatgttagacataaaaccattaaaaatcctagaagaaaacgtaggcaataccatgtagcacataggcatgggcaaagacttcatgactaaaacaccaaaagcaatggcaacaaagccaaaatagacaaatgggatctaattaaactaaagagcttctgcacagcaaaagaaactatcagcagagtgaacaggcaacctacaggataggagaaaatttctgcaaactatccatctgacaaagggctaatatccagaatctacaaagaacttaaacaaatttacaagaaaaaaacaaacaacctcatcaacaagtgggcaaaggatatgaacagacacttctcaaaagaagacatttatgcagccaacaaacttatgaaaaaatgctcatcatcactggtcattagagaaatgcaaatcaaaaccacaatgagataccatctcatgccatttagaatggcgatcattaaaaattcaggaaacaaaagatgctggagaggatatggagaaatagaaacgcttttacactagtgtaaactagttcaaccattgtggaagacagtgtggtgactcctcaaggatctagagctagtaataccatttgatccagtgatcccattactgggtatatacccaaaggattatcaatcattctaatataaagacacatgaacacatatgtttactgtagcactgttcacaatagcaaagacttggaaccaacccaaatgcccatcaatgatagagtggataaagaaaatgtggcacatatacaccatggaatactatgcagccataaaaaaggatgagttcatgtcctttgtagggacatggatgaaactggaaaccatcattctcagcaaagtaacacaaggacagaaaaccaaacaccacatgttctcattcataagtgggagttgaacaatgagaacacatggacacagggaggggaatatcacacatcagggcctatcgggggtttgggggctgggggagggatagcattaggagaaatacctaatgtaaatgacgagttgatgggtgcagcaaaccaacatggcacacgtatacctacgtaacaaacctgcaggttgtgcacatgtaccccagaacttaaagtataataataaaaaacaaatttaaaaaaattgcatgaggtttgaagaacagacaagctctgtgtgacctctactaccaacaccacaccctggctactcaggaggacttgaacccatttgctcaaccttacattatgactgcaactagcatttaagaaatccaccaaactgaggctatttataaccaagaaaatcatacatagtctatgccaccaaatgcacccataagcaaagccagagaaccctactcaacatacaccacagatgcatcctgaagaagaaaaaaagttacctttcagtaaaagtgaattcaaaaataagaagaagcgactgttaccccatatgcaaatgtatcagtgcaataatactggaaatatttaaaaaaacacaagatgctatgacatctcaaagaaacgccgtaattctatagcgatggagcctaacaaaaaagaaatctcacaacaatgtacaagagaaaccagaaaactaatgcaaagaaattagaaaataaattcaggatataattgagaaatctgcaaagatacatacaactacatcagtatctacatttacaggatatgactgagaaattcaccaaagatatctacatccccctatttatctataaagccaaaccaaacttttggaaatgaaaaatttattgaagaaattccataatacagttgaaagttctgacaacagactagaccaaatggaagaaagaatctcagaaactgaagacaggtctttcaaattaatccagttagacaaaagttttttaaaaaaggatttaataaacaaacaaagcatttgagaagtatggaactataaaaacaagactgaacctacaaatcataggtactcctgagaaataaaaaagtttggacacctgatttgaggaaataattatggaaaactaccttattctagcagaagatccagatattcaaatacaagaggctccatgaactccggaaattacattgcaagaaagaactcaccatgacatagtcatcagaatgcctatggttaacattaagaggggaaaaaaaattctaaaatcagcaagagtaaagcatctagtgacctatcaaggaaatcccaagagactaacagtagacttctcagcagaaaccttacaagccagagagattgagattctattttcaaagtgcttaaagaaaaaaaaatgtgggacaggcacgatggctcatgcctgtaatccctgcactttaggaggctgagcagggtggatcacctgaggtcaggagtttgagaccagcctggccaacatggtgaaaccctgtctctactaaaaacacaaaaattagccaggcctggtagtgtgtgcctgtagtctcagctacttggaaggctgaggcaggagaattgcttgaacccgggaggcagaggttgcagtgagccgaggtcacaccactgcactccagcctggaaaataagagcgaaactctgtctcaaaaaaaaaaaaaaaaaaaaaagtaaaccccaaattttatatcctgctagaataagtaaaggagtaataaagtctttcctagacaaggaaatgctgatggaattcatcaccactagaccggtcctatcaaaaaaactcaaagaagtttttaacatggaaacaaaaggttgacactctccatcctaacaaaacacaaaagtataaaactcacaggtcttataaaacaattacacttatgagaaagacacataaatcatatggcaatgtgacaaaaccctactaaacctaaaaagacagagaaaaaaaaaagaatcccaaaggcaagtagatagaaacattatgatagaaacaaaaaccttacatatcaatattactctttaacataaattgattaaatgctctacttaaaagatacagattcgtggaatgaatttaaaaacagatccaactatattctgcttatgagaaatttgccttactcataaagacatgtacagactgaaggtaaaggggtaaaaaaacatattccatgcaaacaaaaatcaaacgcaagcagaaatagctatacttatatcagacaaaacagactttacatcaacagtagtaaaaaaaaggaagtctttatgtaataataaagcaatcaattcaccaagaaaatataacaatcctaaatatatatggacccaacactgcagcacccagattcataaaacaagtattactaaacctaagagaaaaatatagatagcaatacaatactagtgggggatgtcagcacaccactgacagcactacgcagagtatcatgacagaaaattaaagtggactttagaccaagtggacctatagacatttacagaacattctatacaaggaatatatcaacagatggaacattctccaagacagtaactatattaggtcacaaaaaaagtctcaataaattttaaaaaaatctcaaaatcataccaagtatcttcttggaccacagtggaataaaaccagaaatcaattccaagaggaactttcaaaaccatacaaacacatagaaattaaagaatatgctcctgaatgatctatgggtcaacaatgaaattaaggcagaaatttacaacaaaaattgaaaagaatgaaaatggagacacaacatatcaaaaacctctgggatacagcaaaagcagtgctaagagggaaatttataacattaaatacctccatttaaagaaatggctgggcacggtagctcacacctgtaatcccagcactttgggaggctgagacggatagatcgtctgaggtcaggagatcgagaccatcctggctaacatggtgaaaccccatctctactaaaattacaaaaaattagccaggcgtggtgacacgcgcctgtagtcctagctactcgggaggctgaggcaggaggatcgcttgaacctggaaggcagaggttacagtgagctgagattgcgccactgcactccagcctgacccacagagcaagactccacctcaaaaaaaaaaaaaaagaaaaagaaatattgcacattagcaacctgacattgtatctcaaggaactagaaaaccaagaacaaaccaaactcaaagctagaagaacaaaagaaataacaaagattcaagcaaatagaaagaaattgagaccaaaaaaataaaacataaaggatcaacaaaaaattaaaaagttgatacttagaaaatataaacaaaattgatagaacacttgactaaccacgaaaaggagagaagattcaaataaacacaatcagaaaagaaaaaggagacattgcaactgataccacagaaatgcaaaagagcatcagagactactatgagcagctctacattcacaaactagaaaaccaaaaggaaatggataagttcctggaaacacacaacctcccaagactgaaccagaaggaaatagaaattatgaattgactaataattagtgagattgaactagtaataaaaattcacccatcaacaaaaaagtccaggaccagagaattcacagccaaattctaccagatatacaaagaatagctggtaccagtcctactaaaactgttcaaaaaattaatgtggacggaaacttccctaactcattctatgatgccagtattaccctgatatcaaagcacagtaaatacacaacaatgacgacaaaaaagaaaactacatatcaatatccctcttgaacacagacacaaaaatccttgacggaatactagaaaactgaattcaacagcacgtcaaaaggataatgcaccatgatcaagtaggttttattcccgggatgcaaaaatggctcaatatatgcaaatcaataaatgtgattcactagataaacacaattaaaaacaaaaaccatatgatcatctcaacagatgcaaaaaatcatttgataaaattcagcatccctttataataaaaaccttcaacaaaataggtacagaaggaacatatctcaatgtaataaaagccatataaaacaaacccacagtcaacatcatactgaagggggaaaaagatgaaaatatttcccctaagagctgggacaagataaggatgctcgctatcaccactcctattcaacacagtactggaaatcccagccagagcaaccaggcaagagaaagaaataaaaggcgtccaaattggaaaagaattcaaatgatctctgccaacaatatgatcttatacctagaaaaccctaaagactcctccaaaagactcctgtatttgataaatgaattcattaaagtttcagcatacaaatcaacatacaaaaatcagtaccatttctatacaccaataactaccaaactgagaaccaaatcaagaagtcaatcctatttacaatagctaccaaaaccaaaacaacacagctctaggaatacagttaacgaaggaggtgaaagatctctacaaggacaactataagatactgatgaaaaaaactgtagatgacacaaacaaatgtaagaacatcccacaccatgaatttgaagaatcaatatcattaaaacaatgatgctgacaaaagcagtctacagattcaatgcaatccctatccaaatacgaacatcattttttcacagaattagaaaaaataatcctaaaattcacatggaatcaagggagagctgaaatagccaaagaaatcctgagcaaaaagaacaaagttggaggccccatagtacctggcttcaaattacacaaggctataataaccaaaacagcattgtactaatataaaaatagatacagatcaatggaacataccagagaactaaataaagccacatgcctacagacaattgatttctgatagagtcaacaaaaacatacaatggggaaaggacaccttattcaataaatggtgctagggaaattggagtgccatatggagaagaataaaatagaacccatatctctcaccatatgcaaaaattaattcaagatggattaaagacttaaatataagacctgaaactataaaaaaataccagaagaaaacgtaggaaaaactcttctggacattgacctaaggaaatgattcattactaaaacctcaaaagcaaatgcaacaaaagcaaaaatggatggccatggtggctgacacctggaatcccagcatctctggaagtcatgcttgaggccacgagttcaagactagcccaggcaacacagggagaccacatctctataaaacatacacaaataaacaaatgtgaattaattaaaccaaaaagcttatgcacagcaaaagaaataatcaacagagtgaacaaacagtctgcaaaatggcagaaaatgtttgcaaagtatctatccaacaagggactaatactcagaatctatgaggaattcaaactaagaacaaaacaaaacaaaaaattaaccttattaaaaagtgtagaaagatgtttgcctacataacaaacctgcacatcctgcacatgtatcctggaacttttggaaaaaaaaaagtgtgcaaaagacatgaacaggcattattcagaagaagacatacaaatgaccaaaaagcataggaaaaaatgctcaagttcagtaataatcagagaaatacaagataaaaccacaatgaggcatcatcttataccagtcagaatggctattattaaaaagtcaaaaaataacagatgttggtgaggatacaaagaaaagagaatgcttatacactgttgggtgggaatgtaaattagcacaacctctgtagaaaacagtatgaagatatctcaaagaactaaaaatggaactagcattatatccagcaatcccactactgggtatctactgaaaggaaaataagttatgacataaaaaagatgcctgcacttatgtatgtttattgtagcactattcacaatggcaaagatatgaaaccaaactaagtgtccatcaacggatgactggataaagaaaatgtggtaggtatatacaatggaatactattcagcataaaaaagaatgtaatcatgtattttacagcaacatggatggaactggaggctgttatcttaagtgaaataactcagaaacagagtcaaatgccacatgttctcacttacaagtgggtgctaaaaatgtgttcacatggatgagagagtggaattatatatatagtggagactcagacaggtgaggagctatggcgggggtagcatggtaaaaaatttgttaatgggtgcaatatatattagttgggtgatggataccctaaaagccctgacatgacttcataatctatgtatataataaaatcgcacatgcattccacaaatttgtacaaaacaaaacagaaaagactaggatgctgaggtagagacaaatctatgggaaattcccagattaagaaacaatttgaaaatactgttttttcaggctgacttcaaatgtccagtttcttgattcatttttcttttgttctcaaaaccttttagcaattattgtttcttcactgtttcttttaatccctttctctcaaactcgtattacatgaatattacagcctttcaatctaccttatatgtcttttagctgtggtaaattaaattgtttttttctgaccccgtattgagtttctggtaaatgtatcaggactatccggaattttctcttcaactctatctagagaagattttatttcatgtactaatttatgtttatttcaatgactgtatttttattttcaagtttctaattggattctcttcatacatacatttctctcctgcttttgtttttatcattttctgttcatttttatttgatgtttcatctgcatttgtctttttgaacattcggtatgaacatatttttaaagtttttgttatttatttctgtaaaattaatttcatattgagcaaattcaggttctgacttttcttctggctgtaatttttagcagcagatttctccatatgattttgaatactgttttaatggctcgttttgagtggaagatgtttttctgcggttgttttctctcacttccttctccctgctcatacctgtctgtctttgtctttcatcttgaccctcctgtccccagccaaaaataatttttcttctatcaccagttatactgtacacatggaagactctttcacagacatatgtgatactttggttccgtttctaacagattaatagtatgtcagctgtccttccccccaccccccaccccaggtatcctcaggcaagcagtttgtcaaaagatataagtggaggctggcacacacgtgcatgtgtgcatgcacgtgtgtgtgttctaacctgccttcttagagacaagtgctggtgtgctctgtcatttctggttaagttctatcatcaacaggctaagtttcctttttcttctttatacaatttctgtttaattattggcaattgaggtgtttatcttgcttttgaactcggccctgccttttttatcttttcatatgttttatatgtcctggccatgtttttggtgtgcaatcagtgattgatggttcactatcatgccatcctgatttgaagacaagtttctaagttagcagattttcaaatatacctgacataactcttactgattctaagtggacaaggaaaggcaaggaaaagttaggattataaatctaatgtaattcacttgctggtcctctgcagtagataatatataagtggcttgcttattgataacttgcaattgcttggcttcattctgaattctgtaagttctccaaaaattcctgtccccaagttttctaagcactatagtacaatcagaggagaattattagcccagaagtctaatgtcctggagcctaggtgggtgaatctgggcacttttgtatttcaatttcctcctttataaaacaggtataataatgtctacgttcaccttcatatggagttgttgaggacactgcagagataacagagtgaaattcaacaaagttttacttagcttctgtttggagacagatatattgctaggtctagggaaataaaaattgaagcatagccctttggttatttataatactgtggtccagatcgcctgttttattatgagttgtgacaatccaatgtggactgtggtaaacactaaactaggtataaacagtgaattaagaccaccctccaaaaggagcaattcgcacttgaggaaatgagtgaaaacttcacttagtaacccatctttgatctaaagtcctgtgaaaatgccaagatgctatgtaaatgtaagatgtgctattattttattttatataccaaagttttctcatgagtgaatctgactggagaccacttagccattttgtctttttttttgtttgttgtgtaggtcggaccttgcacttaaatcttccatcttctgggtcctggtgcttgtcagtcaatcattctctcatctgtgatggctaattttgatgtgtatttttgaaaatcttctcctccaggctgcttttcaatctgaagttccaaggaaacacccattttgctattatccagatacaatttagactgagccgttgcagtagaacattgtgttctatttgccataattttttttcaagagacaaagataaacagcttaaacagataaccatctctggttgctgattttaacaataatatttagcagccagtgaatattctgcaagtgcctttctcagaaaggctgcattaagtaaacaagcagtaaatattccaaatgactgagataatagaagttaaatttagttagctaactgcccatatctggctaaaacattgtttttctgttatggtaaataatactcatcttgtttagacaggttttatcaaaaacagtgttagtatttcataccaaacatatttttatgaagctcatgaagcttatgagggctaaaactaacaaattttgagctgcttcagtcatatttcattagttttctttagatgtatattttgatttatttccaaatcacaagttatactgtatcctgtgttttgaagaacaatagtgactggagtattccaattagtcagcattttcagtaaaacctgggttgtttctgccattgaaatatcagccatgaattgaattggtattttgaaacattttcatttgattcctggctgccaaagaatgattttgttgcaggtgttttttgagatttatgtacttaatatgtggtaggttctgtatcacatatcgttgtaatttgaagtgtcaaagtgtcatttcctttgcaaactttaatttttttttttttttccagacaaggtctcactctgttgcccaggctggagtgcagtggcgtgatctcagctcactgcagccttgacttcctgggcttaggtgatcctcccacctcagcctcctgagtagctgagactataggtgcacaccaccacggccggctaattttttgtatttttagtaaagacaaggttttgccatgttgcccaggctggtctcaaactcctggactcaagcaatccgcctacctcagcctcccaaaatgctgggattacagtcatgtgccaccatgcccagccctctgcaaactttacagcaagagtagtctaagagatgtggccattccacagaaaagagagttactatacactatatccacagtgtcttcatctgtttattattgctataaaggaacacctgagggtaggcaatttataaagaaaagaggcttattcagctcatggttctgcaggctggattgttcaagattagccatctggtgagggcctcaggctgcttctacccaaggtaggggaagggaagccaacatgtgcagagactacatgatgagagagaaagcaaaaaactgaaggggaggtgtctggctctttataacaaccagctcttgctggaacttaaagagtgagaactcacctccccatcccctgcagaaaggtattaatctatttttgagggggtgtacccccacgatccaaacactttccattagggcctcaccttcaacattgggatcaaatttcagcatgaggcttgggtgggacaaacatccaaactatggcaatcagaataatgagaaacaccaaaaagtaaacttccgcagggcaaggattttatctttctcattgtatttttggatcctaaaacaggcctctttgcatatagtggttgttcaataaattaactgaaataattatcatcggccccaagatcatcatcagtatttccattgcttatgaaaatactgacacatagaacctgggtcctgccctcctccaaaagacggtcttaaaaaaaatgtataaacttagtgggtacaagtgcagttttgatacatgaatacactgcatagtggcgaagtctgtacttttaatgcaacacacatcacccaagtagtgtacactgaacccattcagtaatttctcatcctttaaacccctcccacctttaagtctccaatgtctatgagtccacactgtatgtccatatatacaccttgaggtacagtaaaaatgtgacattaatcttatgaaactaccatcatatatgcagcccgtcattgactggaaaatcattatgcagagcatgactgtacttctttagcctaaacaacctacatgccaataaaagtttcactgtttcttgattctgtatctttcaaaatgtttctttcttcttgaatgcctccctcattttccaactattcatcaaaatagtataaattgttcaagtgatgggtcaatctttttctctattccctgacttaccttaattaaaataactctattacatccacggatacccagagtactttatttagtacctcttgtaaacaaatattgtatgtatacagggtagttacataccaaaaaaacttggaaatgaaataaataaaggtgttctccaagataaaattttaaacattaacatatatttcaataaagtgtcatcttttcaaaaatttctggtccacaagcctggtccacaagccaaaccaacacaaaactaacggcatttacttaaaaatatattctcaaaagaattatattaagtagaaaggaggtggggagaaatgagaaatattcaaatactcaacaataaaaactcagtgagtataccaatagtcacagcagtattgttcataatagccaaaaggtggaaacaaccaaaatgtccatcaatagatgaatggataaacaaaatgtgatataagcacacaatgaaatttatttagtcttaagatggccggaaattctgatacatgccacaacctgaatgagcttggaagacattatgctaagtgaaataagccagacacaaaacaatacatattggatgattccacttatacaaggtacttagaatggtcaaattcctagagacagaaaatagaatggtgattatgagaggatgaatgatgagggaaatggggttattgtttaacgggtacagcatctgtatgggctgattaaaagttctggggatggatagcagtgctgattgcataacaatgagaatatacttaatgccactgaaccatacactttaaaatggttaaaaaggtatattttatgttatatatattttaacacagttatataaacttagtgaaggaagagttgacaggtctcacccaaacactgacacaggtacagatgacccatgtccatcttatagatataactttaccgtgaaaaataagcacataaaactattagacgctgggcgcagtggctcatgcctgtaattccagcactttgggaggctgaggcgggcaaatcacttgaggtcaggagtttgagactagcctggccaacatggtgaaacctcatctctaccaaaaatacaaaaattagccgggtgtggtcacacacgcctgtagtcccagctactcaggaggctgaggcaggagaatcacttgaatctgggaggcggaggctgcagtgagccgagattgtgccacagcactctagcctgggagtcagagcaagattccatctcaaaaaaaaaaaaaaaaaaaaagctattagaacctagtacaactaaacaatcaaaacagtaattcccctcttcctaagttccaagcatgaggccagaatgctaaataaaatgcaattccttttttcttcttcaatttccagctccaggggctatgaacaaggagtttctactataaaacgtaacttataatattgcaattctcacacaccaaaatccaagaaaatggtatctgagaaataatttttgaaaactcaacagcacaccttctagggattgatacagctactaagtatcacagaatacctactatactcaagatactatgctaacaaattaagtccaatgaagtataatactatcctcactctctgggaatacaatgcagtttgggactaggtaggtaagcattaaaaactatatacaatatgaagcaacatatacaaggttcaaaatgagtggcacaaacaacagattttaaaggagctaagacaagaaagaaacctccagaacagacatgatacaaactttcctataaacttgcctatagatttcaagaaacatcagttctctacttgattactgtccttctccacagaagtcttccctaattattctagcctctgtatgtcatttgctgtactctacactataacctatattcaattttcttatacaccagcttgtcaccataacaactgagctaacaaagtacattattaagtataattctgtacataaagaaagtgctccataaagacccaatgaactgaaatgaatgcttccgttataagctctcaggaatgttgcctgcatacataataaagcaaacaattactagttaatgtctgtaatacagataattttgggggtagggaggctgcatagaggaggaactgtatctcatcatttattccactccaaaaagtattggcattatggatatggcaggtattcaaccattacttgctgcctttattttgagacaattctatactttctaggtgacccagtacataattttgtggtttcctgcacaaggagataaagaaagcacgaactgatctaaaaccaagacaactgtcggttatgatgaaatgttagttcttggtagatttctaggagtttttgagttttgcttccctgatttctcttacttggaagaggcccagaagttatcagtacaatttggattagtcaagtaatagtttagctgaatttatttgtactgtaaaatgtaacaactgtaatctgatttttaagaactttaaaataattaaacatttcaagactaccaaagataaactcacctacaaaggaaaaataaagcaaaatatgatctgaagacaatatttagagaaaataactcttccaatcacttataaaagtagagaaaaagcaaagttagtaattttgagaaacagaaattaaaacaagtcccaagggaacagtaagggtctcaggccctagaaagatccatcatttggcaatcaaaatgattactaatatgctaatttttttcttggagataacatatacatgattttaatttttctagaaaatgggtaatttttattgttatatttagttttaaaacattttaccctaaaaagaaggactctgtaaatataaggccgaagttgtaatttttgcagcttatgtatggctgtgattagctgatgaatgaaatgagaagtgaaaaactttgacttgcctaagacagaatctgattttcccatacgattatcagaaaggagtatatcattaatcatttgtgctaccatgcaatcatataactccactaagccatttatcacagatctgttttcgctaacattctagaactagaaattaattctggcagatctaagtcaatttgctatctgtacagaagccgtaatttctattggtgaaaggaatgaaagagggtacgatttagaggaagagaacatccattaatgctaaaataaagggatgacacatacacacgcatttaaattcaagagttaactaatggagcttgaccaacaccaaagtgagagagaaagaacatcatgaatgcagtgtaggcaattttacttgatattcctctcagtaagattataccctagaacgagcataagattcaaaacaaaaacatgctatccacagtttacctcaatttaggaatgccttttaggaaaaaaaaaatagaatacatttacactgtgtatgattcaagtattgaagtcacaattcctcattttcttttccttctttctttttttttttgtttgagacagggtcttgctgttacccaggctggagggcagtggcatgaaccctgatcactgcaacttcttcctcctgggttcaagcgattctcctgccttagcctcccaagcagctgagactgcaggtgcatcccaccatgcctagctaatttttgtattttcattagagacagttttgccatgttgaccaagctggtctcaaactcctggcctcaagtgatccaccagcctcagcctcccaaagtgctgggattataggtttgagccactgtgcccagcctacaattcataattttagatcaatataaactccaaatatactaacagcttcatccagtggtcagctggaaaaaaaaaaaaaacaaaaaaaaatttcttccaatcttgaaagaataagctgctttagatgtaagatttaattttatattacctctgtaattatacagataatttatcaatttcttaagacatccttggtaataccagattttttccttatgtgttaactttagaacccagttatcacatacgatgtacatatatgtactaaaaaactatacatgataattaacatatgctaaatatctatctagttttatttcttaaagcaataaataatagatatgtgacttctagtctcccactaaactgtgattgtttcaaaaataataacttttaaagtacattctcttttgctaaatacagaaaggttagcctgaaatacctttgtgtacagtaaataccaacttgggatattctgtagtggagcgaaatcttgaaaaactgtaggaagataggtaaataataccaacattcttgtcacaaataaatcacaaactacatacagtagttaaatagacacaataaagtttagacaatcccattcagtaatggtaaggtggcataaacattaaaaagcattaaaaaatacaaacaaggatatttggtaaagcataaaatttggaaagtacttctcagagtttcctaaaagttcctataaatatattaacttttggccgggtgcggtggctcacgcctataatcccagcactttgggaggccaaggcaggtggatcacctaaggtcaggagtttgagaccagcctgaccaacatggtgaaactctgtctctactaaaaatacaaaattagtggtggcgcatgcctgtaatcccagctactcggcaggctgaagcaggagaatcacttgaacccaggaggcagaggtggcagtgagctgagatggtgccattgcactccagcctgggcaacaagaacgaaactccatctcaaaaaatatatgtatatatatattaactttttattcaaaataaggcctgtaatttcccacttccatttagaatcattttcaacatatagacatttatttttaacaattaaacctgactgcctataaaggttgtgcatatgagtctgtgggtatgtgactacatacagtcaaaaaaattattttccctactacaaatacacacagattttttttttttttttttgagacagagtttcactcttggtcttggctcactgcaatctctgcctccgaggttcaagtgattctcctgcctcagcctcccgagtagctgggattacaggtgcccgccacgacgcctggctaattttgtatttttttagtagagacggggtttcaccatgttggccaggctggtcttcaactcccgacctcaggtgatccacccgcctcggcctccttaaagtgctgggattataggcatgagccaccgtccctggcccaaatacatacagattatatctgtattaatatcatatgatttttgggtggtggtaacggggagtgggtatcactgacaagccttcttagactcatgaagcataaaaaaaaataaaaaggaatcccacacaatcacatttttaaacagcataggttatggccagctgagaaaaaaaagaaaaaaggaaccatcgaagccataaaatatataaaatatataaaatatatcctaccttggctttctgagtagctgggactatacaggtatgcaccaccatgccgagctaaatttttttttttgtacagacaaggtcttgctatgttgcccaggctagtctgaagctcctggcttcaagcaatcctcacatcttagcctcccaaaaagctgggattagagacataagccacagtgtcctgcctatatttggtttttaaggagtacaataatatcaccttcaagttattgtaaacatttaaatagtaagaaaatattatcaacaatgaagtaataggatttagtctgtatcagcactaaaatgacaactcctgatgtaagaccagagggctaaacatgtgcagagaatgcaagatatcacttgcacacaaacttaagatacataacatagaaatactttaatgaaaacagatttaaacccacaatttagtactttcaacagccaactatgacagtcttatacatttcttccccaaataaaaaggaatatcactgaactccacaagcttttttaaaaaaaatcaactgctgctaggtgtaataatatggcatagagtaagaaaatcaaagcacatggtatatttgatgagtcatgttccaaagaaaatagtccattttttaaaaaggtttaaaagaaagttccatgaggataagaagaggattcaagtttttgtctcagagaacaaacggattttaatcacacatactgattttaatcacacgtactgcttttaatcacacgtactgattttaatcacatattacctgtttctagacttaatgaaccttgtattacacagttgagcaaaatgtcccaaataaaacagccatatagagtctcagagcgggggaaaaaaagaagtatgctaacatcagaagaacatacctaaataaataaatgttatttttatttcaacctgccattgcttagttactttaactaagtgactattcaaaagtaaactgaaccaggagccacaaccagtgaactatttcaaaagtaaactgaaccaggagccataaaatgccctaacatctaataaatacaaataaaccatgccacactgactcaacacaaaggagaccttcataaacaaatctctccatactttaaaaatatttggctaaatagatgctagaggtttcctaaaacaagataattgtatttttctacatgtcagctagtttatcatcaagttttaggtatagtttacaaacaaagatttaaaatcaaaactacctacacattaataaacaatacaggtgaatcaagattttgctttgattgatatataagatttagtatataacaaaataaaatattttccctagaaatatgtatttttaactactcaatttgattagccttataagtcaaagttctgtaaaaaaaaaaaaaaaaaagtaatgaaatgagccaaaaggtcttacttatctctattactttatcaggaatcagctatttaaatctaaattccttgctgtccattacacaaggcattaacaatattgttatcataacaatactttaaaaaagccttacgagacttagaataaagtaattatgcaagtacaaaataacagaactgctcaaggtctggaataaatattcacaaaatctcatacaagcggtgtcttttaaaaatattacttttctgataatgtcaaaaggcacctcaatagtacatttgtgacaataataatgcacttttttatcaccttgcaatgagtcattactttttctcataaaacttaagggaaaatattctcttataaagtacaaaacaatttgctttccaaattatagtgctaatcattcattttttttctgacaccactacaggcagcaacaatagaaattaagagaaaattggacatgtatataaaggatgaataaagaaataaatgcaacacatttacactattcagtcactatgactttctctagaacctactattctcattgctatggtctaaaaggcccctaaaattcatgtgttaaaattttatcaacaatgtgatagtattcagaggtgaggccttcagtagatgattaagtcatgagaatacaaccctgatgaatggaattagcaaccttaaaatggagcttgaggaaatgagttcaccctgtccgtcactttcgccatttgagaacacagcattctctcctccagaggatgtagcaacaagcacttgacaacagagaacaagccatcaccagacaacaaactttctgcaacctttaagcgtggatttcccggccttgagaactgtgaagaaataaatatctattctttataaattactgtctgtagtattttgttataaaagcacaaacgggctgacacattgacacaatttggttctagattaaacaggtaaaaacgaggcagtgaaacagtattactttccaggcaagtgcctgtctattcaggcagagaccacgaaacaaaattaacaaaatttaaaatattccaaaacacattctttaaaaaaagcttattagaaaggaaatcctcaaaaatttggcatcaagatgtagaaataggaaatttcagccatcgtcttcctgcagaaacaatattgtcaaccacccacagatgacagtagctttgtgggagcccaaaagtccagcagatatggccaacaccccagtagaaaaaaagcttaaataaatagatgcattgaaaagggtaagaacaatttcactttagctatttcttcatccctcccctaaagccgcacagcccagtgccaagagagatccaatcagccttggatctgtctcacaaaggaaagtaaaagcatagtgagttcctgtcttctacagctctgagagtcactgcctaagaggcctacttctttctcaccccaccgacaacacacagaagactcggaggagaagctagaaacaggagaaaagggtggggactcaaaacaactagggcacagaacgcaacaaagcaccatggtttctgctaaatgcctcccacactccaccaagaggtattcccaagaacatctcacctatggtcccatctgccaactaggctatatgttcccctaacataccatgcacccctctctcctgtacatggcaccctatatgtgcccctgcagacaatacatacaagcatccacagacttggtttgattctgaacatttcaggacactaccgtagagaaaattaaaggaggctctcaacaatggacctacctttgcaggattgagagaaggaatgtaaacctaagatttcttccctgaaaaagggaagaagtagagtagttatatccacagaaaaggtctgaaggacctccagaatccccacctcagctgactggtgaagtcttttctcctgaagccagtcactacagagcaaagaagataacatcttctttgaatgtgaagatggcaaggcaaggcttcaaggaaaattaaaaaaaaaaaaacaaagaaatatgataccaccaaagaaacaaagtaaatttctagtaactaacaccaaagaaatggagatctatgaattgcctgacaaagaactcataataattgtttaacaagctacaagaggtcacagacaactcgatgcaaccagaaaaacaatatatcaacaaaatacaatcaacaaagacaaaaaatgcacacacacacacacacacacacacacacacacacacacacgaaattctggagctgaagaacaccataaatgaaataaaaatgtaacggccaacttcaatatcagacttgataaagaaaagaaagaatctacaaactcaaaaacaggtcatttgatttccagtcagaggagaaaaagaaaaaaaaagaatgaaaaagagtgaggaaagcctgcaggatttatgagacaaaatgaaccaaaccaaaatatgcatgatagaagtctcagaaaaagaagacaaaaaggatttatgggacaaaatgaaccaaaccaaaatatgcatgatagaagtcccagaaaaagaagacaaaaagaaagaagcaaaaggcttctttagataaataatgccttaaaactatccaaatcttgagagagatatggacttccatgttcatgaagctcaaaaaatcaagaccaatccaaagaaaattacactaagacatgtgctaatcaaattaccagaagttaaagacaaagtaagactttgaaaggagcattagaaaactgactcatcagagacaaagaaacaccaattagcctatccacaagcttctccctaaaaatgttacggaccagaagaaagggataatatattcaaagggctgaaaaaaaccatgtgaaccaagaatactataactagcaaaaatgtttttcagaaatgaaagagagattaaaaactttcccaaacaaaagctaagggagttcaaaaacagtaaacctgccttacaagaaatgctaaagggggttctttaacctgaaacaaaactattctaattaataacctgaaaacatgaaggtataaaactaactggtaaaggtaagtagatagtcagtgtcagaatattacactataacgatgatacacaaatcatttttaactctggtacaaaggcttaaagacaactattaaagtgactatagccataataatttgttaagtatattaagataaaaagttgtacattgtgacatcgataacaaactgttggggtggggggaataaaagtgcagagtttttgtatgtgagggaatttaagatgttatcagtttaaaaaagactgttaaaactataaaatgtttgatatgtcttatgaaaaccaaacacacacacacacctctaatagaaacaaagagaaacaacaaatagaaagaaatcaaagtatgccactataaaaaaataaagttacaatgaaaaacacaaaagaggaagaaagaatcaaaggacctacaaagcagcaggaaaaaaattttaaaaaatggcaatactaagttcttatctatcaataattactttaaattgcaaatgaaactaagttcttcaataaaaagacaaagtgggtgaatcaataataaaacaagacccaactatatgctgccaacaaaagactcattttaactttataaacacacataggctaaaaggggatggaaaaaggcattttgtaaaaatggaaaccaaggagacagatttgagtaattataaaactccaatctcctgcaaaactggctctgtgttaattactctttctctactggaattcacccatcttgataaattggctctgcctaggcagcgggcagggtgaacctgttgggcagttacaaatttggaggctcgtctgggattgcccttgtggctgcctgcctgtggttcagtagccccctctctggtgatggatccaaaggccagcccaagcggccacagttgtcttggactgggggctgattctggcaatctctctactggcagggtgctgccaatccaatgtgcatgaatttaactgcaatagagaaacagtcctggggagacgtcccataactgtagccctaccacagggtgtctgtctgtagctccatggcagggtatatgtctgtagcctggtcatggagtgcttatagctgtagccccactatgaggtatctggtttggtgagtatcctaggtactgcccacacctccttccttctcctgatcagtttggatccttcaggggtgttggtttttctgtagccccatggtggagtatccgtctgtagccccactgcatggtgtctgtcttggtttggctccatcaggggtcttggttttcctgtagccttgtgtggaggtgtctgtagctccactgcagggtgtctgtcttggttcagcccctttgggggtctcagttggctctccctaattagtaggaggagtcttggttcagcagacatctaaatcaggaagatttcagggagatttctcagacggaaaatagaatagtttagaaaggatactctcggagttcttggttagggatctggatttggaaggccttctgcctatcgtgtctttgtgtgtgtgtttgtttatgtgaagggaatctctggaggaattgctggcacaagttcagcaggcctaactcagagaaccctccttatttgtctggtcacattcggtgagccctgaaggaagctcaacaggcctgactcggggagactatccactcttcgtcttacccagcaactacccaatgaattaccattcggaggtcatccctccccgcctggagtgaatcaaaggcaacagggaccaacaggagaaagctgagccttgccagtttaatactgggtgctgaatgagttgactagtgtctgttttgttatatgtattttgctttggctgggatggaaaatgttaactcagttccccacacagtctgttgggcagcatcttgcaaaattgagaatcttttgccaatagttccataaaacagaaaagggtgatttccttttgtaaagtggcttgacccccacagctatgccacagtaagcagggtcatcaaaaaccgctccatttttctggaagctgcagtgaaatggaacccggaaacctggtatgccggcaaaaagggtaagaaattcttaccagtcaaaagtttctggtgtgtctctctctctcgctctgtgtgtgtgtgtgtgtgtgtgtgtgtgtgtgtacatggtaaatgtcaatatttatctcctctgcaagggtttaattaatagaaaaaaaggatttgtgagactagtcttaggctgcagcaaatctggtgcgctttgtgctaagaatgtctttcagtgtcgttctgtaatggagagagaggtatcacaggatagaacatgggtttaggacccctataagcctacctttcaagccagcctggcaggctggtcagttacaaactttgctaggggtccctgaaaccaatactagatgaaactttgtcttgttttatgtccttaagagcttaaccttgtgaccatgtggtgatactctctcttggtttccaccatccagaagacacgtgattttagtaattttctgggaataaagacagttttaaagactactggtaaaattaaaagtcctccaaatttagacatttggtctaaattaaggtcaggtatcagatttgctaaatgctttaaagtcataaactgcttctttgacttttgaaaattgttcagtttacctaatttggagcattagattctagataaggcctgggaacatgtggagttagcctggctccccagctatgctggaaagagtaagacctcatctgcacttctgtctgatgtcttaggctccacacctagtacataattaaaatcacttatttatcagctttttcatcaaaaataaaagttgctaagagttaaacactgtaacatgtaattgagactactggagaaacagcttgacatacaaggttgcaaggtatagaaggaaaaagtagaatatggttttgctgggagatcaaaagaaggcatggggatatggttttcgtgaaagacaatgtaattttgtgtagttcagagggttttaaagattgtctcaacctaaaagagtaatgggacaaaactgaaagtttaagcaggttgaaaagggtgtgtgaagggttgatcctgtaaaaaaagttctgggggtataagcaagttggctaaggtttgaagggtattatttttttctgcaggttgaacattaaaataaaagcacactgatatggggccacagtctgggcccatgtgtctgagtaacagggttttcttagaaaatttatctgctgtttaacagaaaattataaagagatctaaaaagtttatgaaaatcttaccttatggtaaaactaataaaaagtggatggatttataaaattttatttaaaaactagctttagcattaaagatgcactaataaaaacataaaatttttctcttttgaaaaagatttttatgtaatattgagagacaatgaaagatttttgcttgccttttgagtaaactacaaaaaatggggagagagaagaaacagattcagttggcctcagggtgtcttcattgggtctaatatattgtttgaaaagctgagtctcctaacagagtaaacgtttttctttttaaaaatttttgagttatcattttggccaaatgaatgaattatgatgacctgaaattctattttgtgatatccagtgttttaaacctttgatatttgacaaactttccaatatcaaattatgaagtatgcatttttctgacctaattaatcttttagatattatgtcctctaaagaccaaaaacgacacacttggtttatttggtataaaaatcataaaagaaacactatcaaatatgaaatggtgtttggctttctttgtgctatatttgtgtaaatgtgttattggtatatgttgcaaaattatatgaaagtcataattctgatatgacttagtatatggtaccagtaataattatgttaaattattgtgtgccacaaaagtaacaaatttccttgtcaattttgtctttacctgtggctaagactttttgtcatccacagacaattgttgtcttgctttgatcctctttaaatggtgattttataatcagctgtaaaactctaacagatgttcttaaatgcaggtttctgataactttgaagatggcaacagtagaatgaagggaaataacttttaggactctcatggagagctgatatgttcatgaatatcaagcaaaacaggagttaactgaatggactgaactaacagataatgaaggccaggtgcggtggctcatacctataatcccagcactttgggaggccaaggcaaaaggactgcttgagccgagatagctgagaccagcttgggcaacatagtcagacctcattgctccaaaaaaccttttaaaattagccaagcatggtgatgcacacctggagtccaccctactcaggaggcttaggtgaaaggatcacttgtgcccaggaggtggaggttgcagtgagctgaaactgcaccactgtactccatccatctggggcaaaagagtgagaccctgtctcagaaaaaaaaaaaaaaagagagagtgccatttccataaatgtgtgaattttccaattttacttctgctagtgagtctaacttcatcctgttgtggtcagagaagatactttgtatggtatctcttcttaaatttgaggcaaaaatttgtgtcctaaaacacgatctatcctggaaaatgttccatgtgtaactgagaagaatttgaaaacaaaaaagaaaaaggaaacagtaccagccctttaaatcccctggaagtcacttgtcaaaagaagagcagtttgaaacaatggtggaaggtataacaacaatggctgcccacttctttgtctggaaatctgagatcagaagcagcaatcggcaatcagagcacagatccccaatatttggagaacaggctcctaacttccgcaacgtaggtgcaaactgctccaggaatatgtacatggctgcctatcacggggctgggtgtgagagacagggagctggtactgtgctaagagctgaaactgaccaaaacaaactacatttatcatctaagccttttcttggaaactgtaagcattaaacagtctccagagttccaaaatagtcacattagattctaccagtgcaactgttgtctaggtggggagacagattcttattgcttcctactcagcctcttcccataatcctccaatagattttcttaaataagttttcctttatttgctatatgaccttaggaccatttccagagacttaaaatacttgtggagcatctcatgctatcgtttcagaagtcatctttgactatattattttctcttcttcactgagtattaaacaagccttgcattcctggaataaagtccacttggtcacagcatatgatctattttatatattgctagattcaaattgctaatattttgttaaggatatttttatcatcttcactgggaacactggcctttttttccccctgtaatgtgtttgcctgattttaaggtgagaataatgctggccttataattagttggaaagtattcctcctcctctattcactgaaagactttgtgaacgatgggctacagatagattagcgctgtaagggttcaaaagaaaacactgtgtcttgaaaggactgatacagttggtgaaatctgacctgcaaaagccagtcttaggagagaggggtgaagaaataccataactaagggaacaaatatgagaaattttaaaacaaactaaggaaataagcagcctactttgcttaactcagcaacttctggtacattggtaataagctactaaaacatgatgatagaaagaaacatacaaggaatttatatctccaattttcaattacttcgtgaagaataatcacaccactataatcttactaaatagattaagtaaatggattgtaccattcttgtacaatgtaaacatggtatcactacatgctatgtaccttttaaataacagagcagaaggcatttgatattcttttagcctgtgaaaaataaaagctcacttttttatatttagagaatatccagtgtaaggccatttcactaacatatgctgtaaatgtcaaacacttgctctcttagtcttctttgcagccagggaaaggcacatgacctaacctgtatcgatcagccatcagctgaagcatgaatgggtaaccggaagcaatagtcaaatccaattttcaaagcacattctggcagattctatagctatatcaaactctaaaaatacaatctaatgcatagtgacagaaagcatatcagtgatagctgacagagggaggtgcatggagaagagcaggagggagattaccaaggggcaataggaaattattagagttgatgaataattgcattatcttcaaaagtgacttcataggtgtttagatatgtcaaagcttttcaaatgtgtgtagttttattttttattattattactattttagactcaggaggtatatgtgcaggtttgttacatgggtatattgcttgatgctgaggtttgaacttctaatgatcccatcttgcaagtagtgaacatagtacccaataggtagtttttgaacccttaccccacttcctcacttccctctgtagtttttaataggtgtagttcactgtgtgtaaattatatctcattatacctttttgaaataaagaaaataaagaaaagacagggaaaaacctttgctacaggggtaaggcaataatcctttagatacacaccaaaaaacacaactggccgggcacagtggctcatgcctgtaatcccaggactttgggaggccgaggcaggcggctcacctgaggtcaggagttcgagaacagcctggccaacatggcgaaaccccatctctactaaaaatacaaaaaaaatagccggacgtggtggcgtgcacctgtagtcccaggtggcgtatgcctggaggcatgagaatcgcttgaacccgcgcagcagaggttgcagtgagccaaaatcgcaccactgcactccagcctgggtgacagagcaagactccgactcaattaaaaaaaaaaaaaaaaacccacacaattaaaaaactaacgaaattgttaaacctgttttttttgaaatacacttataaagtaataaaaaagccacagattaaaagaaaaatatttgcaaatcatgtatctgaaggacttgtatccagatagattttttaaaatctctaaaccaagtaagaaaaatctaatttaaaataaaaatccaacttaaaaaatgggccaaagaattgaagaagtacttcaccaaatgagatatacagatggaaaatgagctcataaaaatgctcaatattctaattcattagacaaatggaaattaaaaccacgagatgccactacactgtagtccaatggttaaaattaaaccaattgtcccttcctagatgttagtaggatgtggaggcaatggacctcactctacttgaagaaatggtgtacaatatatttgaaaaatactttggcagtttattccaaaagttaactatatacatatacatacttaaataagtccaggccattcagcttctacaaatttacccaagggaaatgaaatcatgtgttcacacaaaaacttgacacaaatattcatagtaacttaatttataatagccaaaaaactaaaacaaccgaacattcatcaacaggtgaacagataaagtgtggcatatacatataaatggaatactattcgtcaataaaagatgaattattaatcaatgcaataacaaagacagatctcaaaataattatactgagttaaagaatctagataaaaaagaatattgtatgactccatttaggtaaaattctatacaatacaaactgatcttgtattagtttcacagggctgctgtgacaaattaccagaatcttggtggttttaaacaacatagatttattctgttgcagttctaaaggccagggtccaaaatcaaagtgttggcaggattggttcattctggaagctctgaaggattatgtattctgtgtctcttgcctagcttctggtagctgccagcaatacttggcattcctttccttctaaatttattattccaatctctgcctccatcacatcacctcctctttatgtctcctcccctctcttctaaggatatttgacattggatttacggcccgtcctaatacaggatgatctcatctgaaaccctcaattacatttgcaaagatggtttttttccaaataaggtaccattcacaggttatggatagacatcttttggggtggggacaccattcaacccactacaaagctctagtgacagaaagcaaatcagtggttatctggagatggggagggattagaggaaagaattgcaaagaggcatgagaaaacttctaaggtgatagatatatccactatcatgattgtggtactggcttcatggatataaatgtatattaaaagttatgaaagtatacgctttgtgacaagaatatgataatttctcatgcctgagtctccggatacagccatcaaatataacctaagtaaccataaattcaaacacgatagaacaaatagttttaaaaagatgtggaattgagaaaggatagcagaacactgagctataaattaataaatgacagaggctaaggaagaatgagttctgctaccccaaaagggaagacaggtaaatcagacagtttacaattagttccctgagcattgtcttctacatagaccctaaacaaatactggtggagtgagtcaatggctcaatgaagcactaattcagagttccctgtgttaactatgaagtggtatttatagatccagggcagtttgggtgcttgttggaacaaagtaaggcacacagaacctcaaagaaggctgcaaaaacaaacagtaatagttaactttttttttttttttttttttttttttgagacggagtctcgctctgtcgcccaggctggagtgcagtggcgcgatctcggctcactgcaagctccgcctcccgggttcatgccattctcctgcctcagcctcccgagtagctgggactacaggcgcccgccaccacgcccggctaattttttgtatttttagtagaggcggggtttcactgtgttagccaggatggtctcgatctcctgacctcgtgatccgcccgcctctgcctcccaaagtgctgggattacaggcgtgagccaccgcgcccggccaatagttaactttttaaggggactgtatgtaccagtacgacaaaccagatttctatagtaacattagcatacataagaccaaataaattaatgttcccacttaactctcatttgccaagaagaaaattttacatggtgcagactaaaggaggaggaaaagttagaagaaagaataagaggaaaagagtaggaacctccaaaggctggccccttccaagcctcttacaatatctacaatttggtgatgcattggaaaatatgctgaacataaaaattcctgccatattatttagaaaccgccaaattaaatacatatgcaaaaggcatttttttctattccacagaaagttcaaaggtatgtgtgtatatatatatatatgcaaatagctctagatttatctatgaataaaccttataatgttattatatggaaaatatattacatgttaaaggaccaaaaaataatccttgagaaagatcaaacatcttctttaatgagggagatttattaagcagcaaccatttgttctagtgtattgagtttaattcacatgactagcagcttgatttggcagtctcaatgcataagacaaataattcataaaagtttgacagtattatttttagctcgcatgcttcttggactcagcccacaaatgctgctgctttatgctaccctagggactccattcaaatacaaatacatttgttagcaactgggaggctgagggaggcactcagtgcacacaacatgatattctgagaatccaaatttatcatctcatttgggtagacacttagaataattaaaaaatgactgttgttgcttctacatggactcaacgaagtaagatggtataatttaggccacataacattatgtactagaagcatgtttctagtaaggattatggttaccaatgatcattacctagtaagtttaacagtttaattgatctctctttcataaaacaatatttgagaatggtcacctaaaacatcttgttaaatgtaaacagtgttttcacataccttgattatattatgaagcacaaaacatttttatttttcatgagggagaaatatatctaaaattagaacttaacacaaacatgtgaatcaattgtttctcaactacttccaaacaaaatatttcaaattccacacaagattctgcaaacccatgagtacaagctctaatcttgacactgaatttggatcatctccatggaggaaatccatgaaccagatgtggatttattcgtccagatgtatttcacatgtatgaggaaaaataaaacatttcttcactgcctttatttgaggccacttaaaaatacactagataaaaatagcaaaaaaggaaatcctacaaatcttgaatcttgagtcttccactattctgaaggaatcatttgttgaattattactaaattaaccaaactacatatcgagtagttttcatattatcaatgcacattaaagttactagtaaatcacaatcaacttaacatcatttttataatcctccatttttctcggtattcagtagccatactaattaaaatagaaaattttaaaacaatttttgctttcacattatttgcaaattaaagagaaaaagtattccttcagttttaactaaaatgtcatgacttcaagatctaaaataaacttctatgcacaaagaaaacatggatctacaatggcaaattaatgatcacaacaaaatttcataaaattagtaatacacctggatctaattgtatggtctcaaaatttcaaattactttaaaataccaatgacacgagttttaaaagctataaatttaatatcacaaaaccaacctccatcatattaagagttcaactaactagaaaaaaacaaaaatggttctgttggcacatatatttcctttgccctctactagagatccttcaaatgcttaacaactctatttaaatgttaaagaaagtcaaatcaggaaaatgggtgatctagttgaaatgtttaattttacccaggaaaagaatgtacacatatactatttagttataataattgtaaacagatataacgatacttattttatatgaaaatgtttaatttactgagacacagtagctagtcatatatcaatgcaaattacagcagtacagatatacacatacgaccacattaaactgaaacagtagctagtcatatatcaatgcaaattacaggagtataaatatacacatacaaccacattaaactgaattaacttttgtacagcttaggttgtcaaggatttaataagaatgttaaaattatatgctgacataaaaatgaatattttaaatttagtaacccattttaatttaataaaatatgattttaaatgatttcacagaaatacttcatgcttgctccaaaaattaaaattctaaacaaacagaagaaaatttccagccaagaaatattttataaataattactttttaatttatggaggagggatggtttcccacatgcatcagaaataaatgcgaagtagtcggcaagaatatatgttttaggcttcagtaaagttgtacaatcactcaaatcatagcaacagtatttcatttccaatactataaagaaccagaagtagatcattttcataaacacatacttaatgcataattttggagtgtgtcaacaacactagagccttaagaatttctctctagaaaaaagtaactgtagttggattttaaatacaaataaagaacaaaaattttacttggctgggtgcagtggctcacgcctgtaatcccagcactttgggagacggaggtgggcagatcacttgagatcaggagttcaagaccagcctggccaacatggcaaaaccgcatctctactaaaaatatgaaaaattagctgggcgcggtggcgcacgcctgtaatcccagctactcaggaggctgagacaggagaatcgcttgaacccgggagacagaaattgcagtgagctgagttcacaccacttcactccagcctgggtgacacagtgagactcagtctcaaaaaaaccaaaaaaaattaacttagagttctgttagagatgttttgtttcactatttaaaaaattctatcaagggcaaaatctcctatttcagaggaaagcagttataagctgtatttagacatcaaatttgaatgacataaattactctgaatcacagaaagatgtagtctctaatttcaagaatcaaagtatgaataagaccagccatgaactaaatgtcacattctacacatgataaagtttgaacccctgatttctaaaacacatctggtctttcctttatctaaactcttgaaagcaaaagaacaagaactgagagtaaagagggcacttaccacctgatatggtttggctatgtccccacccaaatctcaccttgaattgtaactcccacaatttccatgtgttgtggaaggaacccagcaggaggtgactgaattatgggggtgggtctttcctgcaccattctcgtgatagtgactgagtctcacaagatctgatggtttttaaaatgggagtttccttgcacaagctccctctttgcctgccgccatccatgtaagatatgacttgctcctccttgccttccgccatgattgtgaggcctccccagccatgtgaaactgtaagtccattaaacttctttctggtataaattacccagtctcaggtatgtctttatcagcagtgtgaaatggactaatacactaccagacaaggacaatgcaacctttaataagtcagttagcaaacacatctttggggaaaataaaatttgtaaggctcaagaaacagaagacagaagcaaaatgaataaacagaagaggtaagagcagggaaagcaaaatcatgtaaatctgactctgacacagctctttaaattataagtgcattaaagaaaataatatgagaatgttccttattaaaaggaaaacctactgaagtatgctgacaacagaatgaaaaataaataggaaagaagtgcattacatatgtgtacttatcatgaagaacagaaaacaatttttctatcttctcctctcctgaattatttctaaaaagtaacaaaatacaaaacactcttgtatctcatagagatcattctcttattttatttgttgttgttgtttttgagacagggtctcactctgttgcccaggctgtagggcagtggatcaatctcagctcactgcaacctccacctcctgggcttaagcgatcctcccacatcagcctcccaagtagctgggaccagaggtgcacaccaccacatctggctgattttttaattttttatagagacagggtctcactatgttgcccaggctcatctcaaacccctgggctcaagcagtcctccgaaatcaatctcccaaagtgctgggattacaggcgtgagccaccacgcctggctgggactattttctaataacaacatacatgttcaaaaatgacacacattaaaaatcttaagtatttaaacctgaaatatctgcagagaataaataataaaatataaaaatataaacaaacttgtttcatctgatatttttctatagcaattatgatagttcaaataatgagagcaaatataattatcaaagacttctaaatattttaaaaacattaagatattactatatctatttttcagtgaaatatttattgagagcctaacacatgccaggtatttcactataaagactaaagatgtagatggcaaataagcaaaacatgatccgtgcccttataaaggttactttttagtgggaaagtgaaacatacattaggtagagatgtgtggtaaatgtcactcagaaaaattattcaattttatattttctggaaatactaatagaagttttgggaaaattcacaaataaaatgtatgagactggtgtttctcttacatgcagtttaaaaaaaaaaaaaaaactaatgagtcaatgtctttaaaggttagagttccttaagattttctatttgcttttacatttctccagaaaatttgtaattctttgttcaaaattttcataattttagaataaacttgttcaaagctgctattataattttaaaaatctcaacaggtaccctttacattcctaatattgttagtgtgtatttctcttatttattgatcaatgttaggaagattgcacaatttcaaacactggctccaccatttactacttgtgtggctttaggtaggttacttctctgggcctcagtttcctcaattttaaaaaaggaataaaaacagtactttctcccaaagcattactgaaggaattaaattagataatgcatgtatttagaacatgcctgagatataacataataagtgctcaataaatgtgatgtattatttttaagtgtagatttatttgtatatactttatttggaactcagcatccatcttcaatctgagatctcatgtttttctttaattttggaaaatatatgctttatctttctttcagatggcatttcttattctttttattctctggttctaaaactcctattaggcataagttgaagcttctcattctgtcttccatgttcttaacatttctcttcctttcctctttctttatatctacatgctgttttctaggtgacatcctcaaatcttccttcatattatgtaagtctgcctttgcatgattataaaatactatagtaagaactacacagtggcacatagaactcaaaagtttgctgaatgaaaaccgatgacattttaatatcaattattgtatgctttcatttctaagtattgtctgaccgctttcaaatcttcctgttccttttgtattgcacaggttttccattatgatcccattgtcctttttgtctataatcatttcaaacaaatttgtttcacagtctctttgaagtttttctattatcttcagttcttgttgtgtttattatcttacttatgtttgcacattcttctacatgatggtttgttttctcctgtggtttataatgcctgtaaccatcagcaaaggtcagtttatcctgtgggagcctggtgtgcctggagctatggaaacccatctacagggcagttgcatttggacatttgcttcagccaggctccaggagctctcattagttccaaccagggatatgggaaagaggttcatatgcaactcaagtttgtaggaattgtttatttatgcataattttttgcttattttacagtattttttattttgataggaatgactacatcattgttaatgaaattcctggcctcggtgaacaaattaacattcctttagatgtttttctctgaacaatatattcaagtcataccagatatgtatactactatcccaagtactggcagttctaaccttttctataaatcacctttttaataaaggaatgcaatacattgctgtgtatttttagagtaattgtcataaaaataatattaaatacattcaagttgtatgctaagagtttacataatcctttaagtaaattcaaaaaatggtgtcttccatgtattccttgcaaccaccctgggaagaaagggcatggtttactaatcccatttgagacatgaagatctgagatccaaacctactggctcatgtgcacacacagaaatatactacattcccatttactgttcatttggagtacacatatttgatattctcacattggtaactattcttccttgttttctgctaaattctagatactaaatcctgcaactcttcccacctattttacttcttcaattattaacatataacactaattggcactcctaatctacgagacacataatgctataggcattatgaaaacactatataacctcaaacctaaaatatatctttcacactttaatgtttctacaatcaggatgtatctttcaattaatgtcaaaggaaactttctgatgatcaggtagaaaagtaagttataatactactacaaacacaattgtacatataaaatatttgtttatctgggccaggtgcggtggctcatgcctgtaatcctagcactttgggaggccgaggcaggcagatcacgaggtcaggagattgagaccatcctggctaacacggtgaaaccccatctctactaaaaaaatacaaaaaaattagccaggcgtggtgatgggcgcctgtagtcccagctactcgggaggctgaggcaggagaatggtgtgaacctgggaggcggagcttgccgtgagccgagatcacgccactgcactccagcctgggcgacagagcgagactccctctcaaaaagaaaaaaaggaaaaaaaatatttgtttatctgaatattactttggttgaggtatttgcatttgtatgtcattgtgactgaattttaattcatttaattcctggttgtctagttttctaaaaagattatactgtgatactgttctgaaacagaaagtaagacgatacatataaagttgactgtcatataccaggtaaggcatttaattaaatacagtggaaaacatgaaatctttaagaactggttgctgaattacaatgccaggagaggatttatgcatcagaaaaaactcaagatactctcttctaaatttttcaaaaataattgatatattatttttctaaaacattgcttttgtcatattatttccctgttcaagaatctataatggtttcccactgcttcctaattcaaatataaactcctacacaacttgcaaggccctctattacctggcttcattagtttatacaattttaattgtcttttttttttcctccacaattctccatgagctctctgctttagtcagatcagtctctttaagtaagtctccatcttgcttacaactctgccttggtcctcacttcctgtgtcaccctcttactagcaggaaaaaccctgcctagccttcaggcccattcaagtcttaatctacgtcattttgagctcctatttatagctagagacattgttatgtaagttacccatggcatttgtctattcttggtttcaaaactattactttttccaaatttatgttgaatatggaaaacattattgatcatttctctttttcattagaggaaattctattaaaaagaaaagagattgtaaagatagaaaactaaatctcagagtaattaagtgaagtgcccagatcaaagagataaatatttcaagctagtcaaaaaaccaggttagtgatcttttactttcatagtactgatacatgaagtaaggagcaaaacaaaagatatgtatcaggccgggcgtggtggctcacgcctgtaatcccagcacttcaggaggctgaggcaggtgaatcacttgaggttaggagttcgagaccagcctggccaacatggagaaaccccgtgtctactaaaaatacaaaaattagccaggtgtggtagtgcacacctgcaatcccagctactcgggaggctgaggcaggagaactgcttgaacccaggaggtgggggttgcagtgagtcaagatggcaccattgcactccagcctgggcgacagagtgagaatccaactcaaaaaaaaaaaaaaaaaaaaagatatgtatcaaatcctgtgtcctattttgcttttcagctagcttaatataaaaattaaaatcacaaatgggacccattacacatttctgtttattgcatgttgatccactgacattcctctttcctgatcagactgaaagtttatgaactttcaagtgtaagttcacataaatacaaattaggtgtgattattgggagcaggggagatggggaggattaattatggatttgcttagagacacaaagatatatttgaacttgggaaagcagccttaagagtctctcttgggtgctatttccatgttgttgggttttttttttttctggttatacttatgcaatatgactccatttgggatttcaagtaaagctggaatgctgtattctctaaggaattaatactgttcagtttttttgttaaaacaaagaatgtgatacttttggtcaaaagttctttctctggaattcatgataaatgaaaagaatcttggcagtttctatgtcattctgcatctcacaagcaacgtgcaattcttcatgtcactacaacttggttattcactgaaacaactgatcttattacaaaacaagttaaagaaacaaacaaagcctccttcagttcctgccttgattcattattagaattcacctttcctttcacctcacccacaatcccagatatttgaaggccaaatgttgttctctctgaaagacaggacattagacaatttaaacatcagcaaattgagttcagctatccttagtcactgactgatgactctattcctatttgtacatttttaaagtaatacttatgtccttcctggaagttctttttgcattccagattacgacagggactaaagtacaacaaagaaaaaacgcaaaaagtcaagtgtcaggcagaataagatccataagcatacatatatgtaagtctgggtcaaattcaccagggtattaatctttattttaaaattacaagtaatatttatcaaattttgcccaaagtaatttaattctggcttagtatcaaattttaaaatatggtcagaggtatacatttcaaacatatgtaagcagaaaatatttacaaagaatttaaattctataataaataatatttggttgtaccatatatcctctttctaatgtcatgtgataatcagatgtaaaaattgctaccatccattttccatctccaattttagaagatgtaatgtacctgttccccccaaaatcagagatgacataattgaatgagttaaaatttctaaaatttccctagaggaatttcaaagaaaataagcaatttagtaagaacattagaaaatctcaaacatttttaaatggtatacaccctctatctctaaattacctaaggttcatttagcaaataactattgtctttattctgctgatcacctgaagtactggaagaaaaaaaaaaaacaaaactaaacaaacaaacaaacaaaaaaaaaacactcagcatcttcctctgttaaagtcacatctgcaggaaaaaggctactaaaaaaagaacaatctgctgttccaagttcatatcctgccagtagatattttgcaattctcagggtagaacaatgtttgaaaaaaacagttttataggatcaaatatttaaggtggaaattccatactcagaatatttaaatggtagttacattactaattaatatattttactaagtctgccactttgtccaagtctccagtttgtaccatgttttctaaaactttatatgacaaagcttgtcttagtacttcctgttccgcttgtttttcccatggactatatttaccatttatgattctcatgagtaaatactagtataaagaataaagtagagacaatttttctgaaaaaatccagaaaagaattaaagagatatacagataaaaacaataaaggcataagcaacaaacactattccagttgaactgtacttaatctcccaaagcaaaagtttaagttaaataaatgttcatttaactgttcttaggccactgcaaggtcaaaaatagattcaaaagttcttaaccaagtgatatgctgttatcttgtatacactggtcaaagtcattgataagagaacctgacatgtctgttttcacattatttcttcatttattaaagtgattctctgttttaaactctgatggctaaattaataaataattgcttagtaaattggagtccgacagtatgtgaaccaaagaatgtttaatctcctgggataaaattatttatagggtcataaaaaaaccacctacctaatatcttgtggttacaattacttatgtttttatgtttatttcagtgtttctcaactctgtgctgtggaatcaacctgggaggctttttaaattttgcaatatcaagactccatctcaaattgtataaatcagaatatcttggcagtcgggccttagaatcaatattttaaattttctaattatggtaaaaacataaaatttatcatctcatccattggtaaatgtatagttcagtagtgttaactatgtgtacactgttgtgcaacagatctctagaactttttcatcctgcaaaactgaaactctatacccactgaacaactccccattttcccttcccctagcccctggcaatcccattctacttcctgattctatgagtttgactactttagagacctgttataaatgaaattattaagtatgtgtcttctcatgactggcttgtttcacacagcataatgttctcatggtttatccatgttatagcatgtaataggattttcttcttttttaaggctggataatattctattgaatgtatataccacattttctttattctactgacagacatctgggttgcttctacttcttggctgcagtaaataatgctgcaatgaatatgggtgtgcaaatatctttgcaattctccttgaagttcttctggaagtacacccaaaagtggaattgttgaatcattcagtaaatataatttttttaatttttagttttaattttttaaggacccttcatactgtttcccacaatggctgtaccatgttacattcctgctaatagggcaaaagggtctaatttaatccacatcctcagtaacacttgttgttttctgtttgttttttcttctgttttttttgagacagagtctcgctctgtcacccaggctggagtgcagtggcgtgatctcagctcactgcaacctccgcctccgggttcaagcgattctcctgcttcagcctcctgagtagctgggattacaggcgtgtgccaccacgcccagctaatttttgtatttttagtagagatggggtttcaccatgttgattaggctggtctcgaactcctgaccttgtgatccacctgcctcggcctcccaaagtgctgggagctagcaggcgtgagctaccgtgcccagccatgcccggctaattttttatatttttggtagagacgaggttccaccacgttggcaaggctggtctcgaactcctgtcctcaagttatctacctgcctcggcctcccaaagtgctgggattacaggcttgagccatcacgccccgcctgttttttgtttgtttgtttgtttaatagtatccaacctaatgggtgcggtgtgacatctcattgtggttttaatttgcatttctctaatgattagtgatgttaagaaacatccacataataacatccagtcagaaatacgggatcagcactcagaagataatgcatagataggtaatggttgaaatacaattagatgagagacaaaactttcaagtaagactggtttgcttcttccatctaagacagcctgcttctgtctttgaaatctctccaatctctcctttttctatattctttcaatccaattctgctcttaagaaaggatttaatatgacttgaggaacattttttatttctcccagggacatttatgtatgaagtcttaacactgttaaaggaaagatatatccccctcccaccaccacatggtaaggaggatgggataaagccttaagacttagctacaaggcagaggtatgcagggctagtattctcgaaaccaattttacatatgactagcagctgatcccctatttcacctaagactgacaatttttagaaacaaaaacaaccaacattgatataaaaatatgcttttgtacaagccaagcatttacttgggaacctgtagaataaattacagttgtcctcttttacccacagtttcattttctgtgccttcagatctgaaaatattaaacagaaaattctagaaataaataattcataagttttaaatttcataccattctgcatagtgtgatgaaatctgtcaccactccatccagcctcggacagaaatcactcctttgtccagtgaatccacaatgtgtatgctatctgcccacctgttactcacttagtaccatcctggttatgatgactgctgaagtattacagggtttgtgttcaagtaacccttattttacttagtaatgtccccaaagtacaagagtagtgatgctggcaattcagatatgccaaagagaagccataaagtgcttcctttaagtgtaaaagtgaaaattctcaagtgaataaggaaagaaaaaaatcatatgcttaggctgctatgatctatggtaggaataaatcttctacccatgacattgtgaagaaggaaaaagaaattcatgctaatgttgctgtcacacctcaaactgccaaagttacagctacagtgtatatagtaagtgtttagttaagatgaaaaaggcattaaatttgtgggtggaagacaggaataaaaatgtattccaactgatggcaatcaagtgggtactgtccacagtttcagggtgggagtcttcgaacatatactcctcagctaagtggggactaatatatatttatgtattttagagtgcacagctagaactcagaacaggccctaaaaacttgcttaatatttgaattatgagacttttccaacatctcacttgttcaacaccctcaattatgtggcacacagccaaggtcctaaaagtaggccaaacaagcaaactataaaaaactaaaattagatatcacaaatctttattaaaaggcacttgattttcctcataggagaatcatttgacactcactcagttattagatactattagtttacacataattctagcaaattcaactagtcattttccaatttataacaaatgcatttacactgggggtgaagatggagacacgggagtctcagcacgcacagtaggctaggtcagcccttcatacctgcacacttacacattacttgtatgcatcatttactagagtagattacaagaattgaaactctatagaatagccttagtcatcaaaggttaaattatattagtatgtgctctcagaaatatgcatagcttgtacagcatgtagttacacacacacatacacacccataccttgtctccgtttttcttctgctttctgccaaaagctattcaaacctcaaccatttcatgagtcaccacacaggcagctcttactttggctttacctctccctgcttggtttcaccactccaatcacctggctcaactatagaaaacccttctgattttccctactgaaggaaacatcagggttagagtgtcacaaaacactacaaaaccgaaatgaatccatgtatgctcatctttgaaagagaaagtcagggaggaagagttcgacaaacagaaacaggaataagaagggaaacatagggttcagctcacaaatacttgcaatttatttgagtacaaaatattcattcctctaagtagtttatttatgacagacactttgaggtactgtatactctaatcacttgttctactttatctgtctttaacattactaggaaaaactgaaggatttccctgttatctgggtagttttataaatcccgacaataaaaaatctaccaagagaatgtgatatttaagtttttgtattcatatttttaaaattctttttaaaaatacaaaaattaaaatcacttatccctacttgaaaaaagagagagaaatctacttcctaacagtgcctaatggttatagatctccactagttcctgttgtattcagagtcgagtttaatctctctcccctagtcttgactataaagtcttccttacaaaaaaaaaaagaaaaatattttccttacttccactaacataaataagctttattgtctgcattattcagacctaggtataaacatacacatgtaataatagctttttaaaataaaaatgtacatttgtccacatcttgcttttctcacttaacaatgtcattcttttctacacttctcaaacatggtgtatttacctaacaacaagactactgagacggttttcagtattttgctattccaagaaacaccaatgaatatgcttataacaaattagaatctcactattaaagtgtgaatatgaacagcctaacactaatagttagttatagaaacattttatggtttggccaacctgatagccaaaatcttcattcacttttattttagattgcctttaaaaaattatgactgagattgcaggcagcttctcatggtttctggcaatatgtgtttcttcagtgaactgacagtttgtatttttttggttgttgtttagttttactattaagttctaaggtgtttttgatcaaggtaatcaacctttgtatcttttaacttggttgacagtatctaccacagtacactaacattaagaaaatttatccttccaatggcatactagaaaactgttaacctgcctacttactctatctgattagagtctagacactgtgaagttccatgtaacttgtacatttccgtcctagagaaagcagaaacccaaaggttaccgttttataactttttagaaaattaaccaaatttgtatctaatcaatattattctgaaggcatcatttttcaattttcctggaaaggtgaactatataagtccctattattcaaatgctctaatatcaagttttattatcttactggttcctactttaattaaaatgttgaatgagtttttgacacatgttcattctgtattttcatgagagtcatttttctaatgtgtgaaaatttcctgacatttaatttatttgtagatagagctatcacaatgttattcctttaaagcacctgggctttctcattaactgaggaaggtcatctccatctctgcactgtgaaaaaataaaaacaaaaaaatatatatactcatctattttccacagattaaaaaaattttctggctgggcgtggtggttcacgcctgtaatctcagcactttgggaggccgaggcaggcggatcacctgaggtcaggagttggagaccagcctgaccaacatggcaaaaccccgtctctactaaaagtacaaaaattagccgggcgtggtggcaggtgcctgtaatcccagctactcaggaggctgaggcaggaggagaattgcttgaacccgggaggcggaggttgcagtgagccgagatctcgctactgcactccagcctgggtgacaagagagagactgtgtctcaaaaaaaaaaaaaaaaaaattctacttagaattttaccatgaatagtatgattatgcagttttactctttcaatatgtaatgaattatattgatatatttcattataatgaaacatactgtacatctcaaatgaaaactacatagcatattactctctcaacagactacgagattcgattttctaatactttgcttaggatttttgcaaccatattttcccttttttgctatcttcattaagttttttttgtactgaagtaatgccaccttcatataatacagtgagatgctttctatatttttaatatttggaaatagttttaatagtaatttaagaattttcagttacttgttaatgaacgacactagaaagggcagtaagtctataaaactacatagcctcctgccttttatatgtgtgtctgtctgtcatatctttaacaactctagatttaaagaaaattgtaaatatagaatacagtccttatatacccttcactcagcatcctcctatgttaacatcttagagacagggtacagttgtttgaactaagaagttagcattagtataatactatcaactaagctacagactctatccagatttccccagtgtttccactaatgtccttttctgttccaggacactatactgcatttagcatcatgactctttaattgtcctcctctgctctgtgataatttctcagtcttttctttttttcccataaacttggcaattttaaaaagtatgagtcagaaattttgtagaatgttccaaaatttgggtttattttctgtgttctcatgcctagactgtgttacggatttaggggaaggataccacaaaggtgaagtgatcttctcattgcatcatattgggaggtacattctatccacatgacttattactggtgatgtgaatcttggttacttagtttttaacagtccttttcacttcatccatcgttatcagtttgttcaggttttctctctcaagtttcattctgatactttatattttattttaaaatgtaattgtctcatctagatttaataactgtgtatgtttaaaactgcacaaaatgttttatcatttttggtactatctaaatctgtggttatactgcttttctcaaccctaatactgtatattattgttttctttctcttttttcttaggcttctttagggtatacctaatttgttcatttttggagtttcattatcaattatattttggttttctaatttactgtcaccgttgaactctattatgtatcaaaggaatggtatttagatcttgataaatggtcaatgtgttgacagatcaagaaggaaagaggaaggcaaagggaacaagccagatgactacagcaatagaaggctggaaaatatggagcatgtgatctgtaatctggtctagctataatatataatacatgcaggaatgaaaaagaatagatgtaagcaagcaacattaaacaggtgggaataaaatattatatttagtaaataaatactgaaaaattaaacacaaaatttcatacaatccaacaattttacttctgggtatatatccaaaagaactgacaccagaaattcaaacagatatttgtctatccatgcttatggcagtactagtcacaatagccaaaaagtgaaagtaatccaactgtccatcaatggatgaataggttaaacaaaatgtactataatcatacatcaggatattattcatgtttaaaaaggaaagaaattctgatacttgctataccatggatgacccttgaagtcattacactaagtgaaataagtaagacacaagagatcaaataattgcatgattctacttataaagggtacctaaaataggcaaatcatagagacatacaagggaacagagattaccaggaggtaggggcaaagggaaattgagagttttttaaaaaatgaatacagtgtttcagtttcggatgatggaaaagttctggagatgaatagcaacaacagttgcacaacaatgtgaatgtacttaatgcctctgaatggtacacttacaacacttaaaatggtacattttatgtgtatgcatattttatcataatttaaaaaattaaataaatacagattccttactacctggaattaaagattctacataattagtttgaaatgtttttcacatattatgctttactatttactgacaaagtgtctggctctctcaaaagaaagtttaaagaatgaatgggcaaaactgtttcctcttttaggctggtcttaacctcacaatattctaaaagagtcatgctaattcctccaatgcatccttttctattgttgttatctcatcaacatccctccattgcctccacagtccacctccccatctatatctttatcttaaccatcttctaagggtcagttctccatggagtctttcccaataattctacttgatggttctctatctctattttctatccaaaaatccttttgtgtcaaagtatgtcatttgactacactttttagaattttatctattaacatcacctaacagttaaatatattgtctttatctactggaataagaccgaaagcaccttaagagatagggattttggtcatgcttcttttatatccctatatggcctaacacagtgctaaataatacagaacagaatacacaagtggttaagagctcaagatctgctgttactaactcaatataaaaaccacttctaccactaagtaggctacgcaaattatgaggctaagcaagtaacgaggttaggcaagttacttaatctgagtctcttctttctcacttgcaaaatggcaagaataaaagtatctatactttataacattatgtgagcattaaataaaataatgaatgttaaaagaacataagcactcaataaaggttagcattcagtattactattagaagtgtctgatactatttagcctaaatgatgttgagcaaatttctgagaagttgaattataaatgaaactcgattttggtgactctacagcgcactggtgacaaacttgagaaaataatacgattaaacacacacttgtttgtttgccagttctttagctgtcttcctaactacactaccttcacgaagtcaggcattgtatcagttttacctactaccatatagagagcacctaaacacagaagttgggagaagtatactgcgcacaaatttggcattcaaataactactgaataaattaatcaaaaagctaatattttgtaaaattcaaactcagatgcttacattactaacaataacacctcttcctcttttccctgtaagaaaagatgattctgcctccttgaacagtaaaagcagagattatattttttacaaaggtaaccacagaatatcaatctgtttcagtccctgcctattttacaacatgctctaatcccaagaacatatgctagataaagaaaaataatctgtagttgtacattacacactggttaaaaactctgatgactctggcaatagatgaaactacagtactaaacctcaaggtcctaaagaaaatactgctgttcagactgaaaatgagaaacagtatactttggcagttttattaatttataaactcaacttgtagaaaaaagaatgctcaacaaaataaaagttgtgaatttagaaagttgcaaacatttcatctgtttaaaacacgtaggggaaataagtttgttttctttcaaaccacatttgctaataaatacatgtttattttcccgcttcttttcttacctagttctattcagctatcaaaacaggaattcctttccacctgcaccaacgtagatagtatccaaacaattagactacaggctaaaagagtcatgtttcccatgaaatactatttcttactcctttgttaccattttcttggtgataagaagcattgagaaaaatggttttgttatttgcacgcaattttctctctttttttttttttttttttttttttgagacacagtctcgctccatcaggctggagtgcagtggcacgatcttggcttactgcaacctcgacctccccagttcaagcgattctcctgcctcaacctcctgagtagctgggattacaggcatgcaccaccacacccagttaatttttgtatttttagcagagtcggggtttcgtcctgttggccaggctggtctcgaactcctgacctcaagtgatctgctgccttggcctcccagactgctgggattacaggcatgagccaccgcgcccggccaattttctctcctttcttcaaaggaatcaacagctatatatcaaacacatagccatgtgctgtgcttaggaagtgagaaaactaaaaaataaattataagtaaggcaggtgctctcttatatcagctcacacctaattagatcctcctttaattttgttgaaagcaattaattgggaatcatctaacttctaatagggtttgtacacagacatgagaattattcagtttctaatcttctgggaagtaaaccaaaatagtttttccaaaaattatcttgtgaatattaattatgtctctaaattttttacctacggacagcgtctttaatcaaataaaaaggcagtaatcgtagcagtttgggaggccaaaacaggagggttgcttgaggccacgagttcaagaccagccagggcaacatagcgagacccccatctctaaacaaacaaacaaacaaacattaatgaggtatggtggtgcatacctgtaattccagctacttgggaagctgaggtgggaatctcatttgaacccaggaggtcaagactgcagtgagccaagatcatgccactgcactccagcctgggtgaaagaaggagaccccaatctcaaaatattaaaaaagaaaaaaccaaaaagggactggaaaacttaaaatagtcttaaatttcaatacacctcgccaggcgcagtggctcatgcctgtaataccagcactttgggaggccgaggtgggcagatcacgaggtcaggagattgaaaccatcctggctaacacagtgaaaccccatctctactaaaaatacaaacaattagccgggtgtggtggcgggcacctgtagtcccagctacttgggaggctgagacaggagaatcactttaacgcaggaggcggaggttgcagtgagccgagatcgcaccactgtactccagcctgggtgacagagcaagacaccatctcagaaaaaaaaaaaaaattcagtagatttcttaacactcttaacaatatacccttaaacaatttttttagtttttattttaaaattatagaaattcatcaagttacaaggcaatacaatgaggtcccctgtactctttactcagttccccccatggttatttcttatataatacaatatcaaaaccagaaaaatcacattgatacaatgtgtgtatagttctatgtcattttatcacatgcatagatctgtgtaatcaccatcacaatcaataaataaaactattctcactataaagagcttcctcatgctacacttttatagtttcacccaaccccgcccccacaaaaatcccatgactaccattaatttcctggtgacctctacaattgtgttgtttggagaatgctatataaattgaatcgtacagtatgtgtctttttgagactgatttttttcacttacataatgctcctgactgagatctgtccaaatttttgagggtatcaatagttcattactttatattgctacgagatataccatagtatagatgtaccacagtttaatcactcctactattgtaggacattttggttgtttccaattttgggccattgaaaataaaaccatgtatgggattctgtgcagaaataaattttaatttatctaggagaaacgcccaagagtacaactgctgagtcatatggttaagtgtatagttagcattttaagaaattgctaaaccgttttccagagcaactatactattttacaactcctaccagcaatgtgtgagagactgtattaccatatccttgccacctccagtggctgttccttgcccacatttaatattgccactaattttttttttttttttaaagatagggtctggctctgttgcccaggctggagtacagtggcacgatcacggctcactgcagccttgacctcccaggcttaagtagatcctcctaccctaaatcctttttggcaaaatatctttttgtgtcttttgcacattttctaaatgaactgttgtttactgttgtttttaaaaaagattgtgatttgagagttctttatatattctcttgttttgctcttgttgcccaggctggagtgcaatgctgtgaccttggctcactgcaacctccgcctcccaggttcaagcgattctcctgcctcagcctcccaagtagctgggactacaggtatgcaccaccacatctggctaatttttgtatttttagtagagacaggatttctccatgttggtcaggctggaggctggtctcaaactcctgacctcaagtgatctgcccacctcggcctcccaaagtgctgggattacaggcatgagccaccacgcccggccaagagagttctttatctattctatatacaagtcttttgtcaggtggtggtttgccaatattttatcctagtcttttcattctcattacagggtatttagcacagcaaaagttcttaattttaatacattccaatttagcaattttttatagatcatgtttcttgtgtcatgtctaagaactcttcaccaagttttagttccaaagatgttctatgttttctcctaaaagttttatagttttacattttaaacttcagtctattatccattttgagttactctggtaccactgtgagtcttaggtcaagattatttttttggtctaagttttttgtctatggatatccaattgcactggccccacttctgaagaatactattcttttcctttgaattgtttttgtacctttgtcaaaagccaggtggctgtaattggataggctatttctgggtttgctgttctgttccactgacctagtggtcaatggaacaaaccaaatatatatatttggtttctgcccctggttctaacacaaagctcctaaaactcttgtaatttcgtgaacgacaggggtcctaatgtgtccagaattggtgggttcttggtctcactgacttcaagaatgaagccgtggaccctcgcggtgagtgttacagctcttaaggtggcgtgtctggagtctgtcccttctgatgttcagatgtgtttggagtttcttccttctggtgggtttgtggtctcgctggctcaggagtgaagctgcagaccttcgcggtgagtgttacagctcttaaggcagcgcgtctggagttgttcgttcctcccggtgggctcgtggtctcgctgggctcaggagtgaagctgcagatcttcacggtgagtgttacagctcataaaagcagtgtggacccaaagagtgagcagtagcaagatttattgcaaagaacgaaagaacaaagcttccacagtgtggaaggggacccgagcgggttgccaatgctggctcgggcagcctgcttttgttctgttatctggccccacccacatcctgctgattggtagggccgagtggcctgttttgtcagggcgctgattggtgcgtttacaatccctgagctagatacaaaggttctccacgtccccatcagattagttagatacaaagtttccacacacaggttctccaaggccccaccagagaagctaggtacagagtgtcgattggtgcattcacaaaccttgagctaaacacagggtgctgattggtgtgtttacaaaccttgagctagatacagagtgccgattggtgtatttacaatccttgagctagacataaaggttctccacttcctcaccagagcagctagatacagagtgtcgattggtgcactcacaaaccttgagctaaacacagggtgctgattggtgtatttacaatccctgagctagatataaagactctccacatccccatcagactcaggagcccagctggcttcacctagtggatcccgcgtaggggctgcaggtggagctgcctgccagtcctgcgccgtgtgctcgcattcctcagcccttgggtggtcgatgggactgggtgccgtggagcagggggtggtgcttgtcggggaggctcgggccgcacaggagcccatggagtgggtgggaggcttaggcatggcgggctgcaggtcccgagccctgccccgtgggagggcagccaaggcccagcgagaaatcgaacgcagtgccggtgggccagcactgctgggggactcagtacaccctccgcagccactggcctgggtgctaagtcccccattgcccagggccagcagggctgcctggctgctccgagtgcggggcccaccaagcccacgcccacccggaactccagctggcccgcaagtgccgcacacagccccggttcccgctcatgcctctccctccacacctccctgcaagctgagggagtgggctccggccttggccaggccagaaaggggctcccacagtgcaatgggggactgaagggctcctcaaatgccaccaaagtgggagcccaggcaggggaggtgccgagagcaagcgagggctctgaggactgccagcacgctgtcacctctcactaagagcatcttttgttctaatatttggtctttgaccttggttcctgacacagaactcctaaaaccactgagtgatagcaatgataggaacatcttacgtaaagcttctgaattccttagactttgtattagtccgattttatgctgctgataaagacatacctgagaccgggcaatttacaaagaaaggcgtttaatagactcacagttccatgtggctggggaggcctcacaatcatggcagaaggtgaaaggcatatctcacatggcggcagacaagagaagagaacatatatatacagggaaactcccctttacaaaaccatcagatctcatgagacttattcactatcactagaacagcacaggaaagacctgcccccctgattcaattacctcccactgggtccctcccatgacacatggcaattgtgggagctacaattcaagataaaattagggtggggacacagccaaaccatatcattctgccctggccccccccaaacctcatgtcctcacatttcaaaaccagtcatgccttcccaacagtcccccaaagtcttaactcatgtcagcattaacgtgaaagtccacagtccaaagtctcatcagagacaaggcaagtcctttctgcctatgagcctgtaaaatcaaaagcaagtttattacttcctagatacaatgggggtacaggcattgggtaaatacagccatttcaaatgtgagaaattgaccaaaacaaaggggttacaggcactgtgcaagtccgaaatccagcaggtcagtcaaatcttaaagctccaaaatgatctcctttgactccaggtctcatatccaggtcacacggatgcaagaggtaagctgtatggtcttgggcagctccgcccctgtggctttgcagggtatagcctccctcctggctgctttcacgggctgctgttgagtgtctgtggcttttccaggcacacagtgcaagctgtcggtggatctaccattctgggatctggaggacagtggccctcttctcacagctccactaggcagcagcccagtggggactctgtatgggggcttcaaccccacgtttcccttttgcactgccctagcagaagttcttcctgaggaccctgccccagcagcaaacttgttcctggacatccaggcatttccacacatcttctgaaacctaggtggaggttcccaaacctcagttcttgacttctgtgcactggcaggctcaacaccgcgttgaagttgccaaggcttagggcttgcagcctctgaagccacagcccacactgtaccttggcccctttcagtcactgctagagcagctaggaggcagggcaccaagtccctagactgcacacagcagtgggaccctgggcctggcccaggaaaccattttttcctcctaggcctctgggtctgtgatggcaggggctgccacagaggtctctgacacgccctagagaccttttccgcatggccttggcaattaacatttggctcctcgttacttatgcaaatttctgcagctggcttgaatttctccttagaaaatgggattttcctttctattgcattgtcaggctgcaaatcatctgaacgtttatgctctgcttccgttataaaattaaatgcctttaacagcacccaagtcacatcttgaatgctttgctgcttataaatttcttctcccacaccctaaatcaactctctcaagttcaaagttccacaaatctctagggcaggggcaatctgtcaccagtctctttgctaaaacataataagagtcacttttgctccagttcccaataagttcttcatttccatttgagaccacatcagcctgaactttattgtccatatcactatcagcattttggtcaaagccattcaacaagtctaggaggttccaaactgtcctacattttcctatcttctcctaagccttccaaactgttccaacctcggcctgctacccagttccaaagttgcttccacattttttgggtatctttactgcagcgccccactctcctggtaccaatttattgtattagtccatttttatgttgctttataagcaacataaagacatacctgatactgggcgatttacaaaagaaaggcgtttaatagactcacagctccacatggctggggaggcctcacaatcatggcagaaggtgaaaggcatgtctcacatggcagccaacaagagaagacaacttgtgcagggaaattcccctttataacaccatcagatctcatgagacttattcactatcacgagaatatcatgggaaagacctgcctccatgactcaattacctccacaaggtcccccccaacaacacatgggaattatgagaactacaattcaaggtgagatttggatagggacacagccaaaccatatcaggcttccttggtgacaagcgtatctttgctctaatgaagaaactcttggtgggctcctgaatagcttcaggatggggagctgatcaccagaaagaccaagccataatttgaagctggggacttttagccccatctgcattctccagggagtggctggagactgagttagtatttgattatgtgtacacactgaagcctccacaaaaagcctatctgctgaagcctccaaaactgcagggcttggagaacaaacaaattatcaaacctgaggaggatgttgtatggccaagtcagacaaaagcatgcatactccatacttgcaactagcacctgaaatgggaggtaaggtactcttgtgggactgagcctttaatccgtgggaattctaggtaattaatgtcaaaaactgagttaaactataggacactctattggtatccacagagaagtgaagaactgcttggtgtggaacacccatgcatttgatataagaagtgttgcgaataaagaaactgtttttcttttattatctttctgccaatacaataggatgattcttcccacttttttcttctttttctaaattgttttagctattctaattccttcaactttccatatatataatcttgtccatgtactagaaaaatctttggggatttttataagaattgtgttaaacctgtgtatcaacttgagtggaattagcatctttactgtattgagtcttccaatctatgtacacagtatttccatttacttagatctttaattttttccccaacattttgtagtctcagcatataagtcctgtatgtgttttgttggatttacacctaaatacatcatttcttttagtaactgtaaattacactgtattttaaaatttttccacatcttcattgacaggatatacaaaaatacaattagtttttgtacgatctcataacctgtgaatctatataactcacttattagttctagatgtgtttttgtgtactctttggaattgtctatacacataatgatgtcaactacaaacagggacagatttattccttccattttgatctgcatgtcctttatttccttgttttgtggtattgagctggctagaacttccaacagcatattgaatagcagtagtgagagcagacatcctttcttattctcaatcttagggggaaagcattcaatttttcaccagtaagtataatgttaccttcggctttctgtagctgttctttatcaagctgaagcagttcccctctattcctagctttctaagattttttaaaaattataaatgggtgttgaattttgtcaaatgctttttccacatttataaacattttgtagttttccttttttgtctttgtctgcttttggtatcagagtaacacaggctttaaaaaataaattgaggccgggcgcggtggttcacgtctgtaatcccagcactttgggaggccgaggtgggtggatcacctgtggtccagagttcaagaccagtctagtcaacatggtgaaaccccgtctctactaaaaatataaaaattagctgggtgtggttggcggacgcctgtaatctcgggaggctgaggcaggagaatcgcttgaacccaggaggcagaggttgcagtgagccgagattgtgccattgcactccagcctgggagacagagtaagactccatctccaaaaataaataaataaataaataaataaatttctatttttttggaaccaattgtatagaatgaatgttaatcagtctttaaacatttaatataattatctggtaaaatcatctaggtttggagatttctattttgagaattttaaaattatgaattcaattttcttaacagaattattcaaattatctattttatattgggtgagttgcagcaggttgtgcttttcaagtcatttgtccatttcatctaactgagtcaaatttacatgcatagagttatttgtagcagtttctcattaactcgttgatgactgactatagggtctctagtgatatttcatttcatttctgatattgaacattttgtctatttgttctaggggtgtaacaattgtatcatcccctcaaagagccaactgtgtgtttcattgatttttctctagttttcaatttcattgatttctgttttcatgtttattgcttccttcttactgcttggcttaactattctgagcttcttttcctatttttttttttttgagacaggattttagatgatcaattttagacttttcctcttctccagtataagcatgtagtactgtaagtttccatctgagtaatactttagctgaatctcagaattttgatatgttgtacttccattcaatgtatttttatttctttgaaccactatttagaaacatactgttcacttttcaagtgtccagagattttcctattttctttccattatggatatctagtttgattccatggtggtgagagaacatactctatatgtttcaaatttaaaaaaatttttcagatttcttagtggttcagactatggtctgtcttggtgtatttaccatgaacatttgaaaacactgtattctgctatttgtggatagaatgttccttgtctgcgttttccttggaaagtcttcatgcatcccaggataagactgctaatttgcccatcaactggactctttaacaaatgtgactatggaaaaccatgtaagaaactaactcatataataaaaaagtattaatggaaggggagattattcatatcataaactattactacagtaactccagaaaattacatatttaaatttcatttgggaaggagtgtgtattatttttagtttacatgagtattaaaaattacttatttttgggaaaatgttaagattttcatttatttagcccatcaaaaaatattttctaagcactctatcatatacaaaggattgtggttggtccagactctctaggggatcgtaaaccaggcatattgtagagtctccagcagttttttccttgtgttagatcaccgccatccaaaagcattttctgtaatgatggaactgttcttcatctgtgatgtcaaagactgtagtcactagatatatgaggctattgaacacttcaaattagcgtattagaagtgtagcaccagaacataatacaggccccttgcatttattacactttccttgttcaaagctgtgcaagatttgtctgaatttaaagcagataagacaggagtgactgagatacccagttttacattagactgcttcagattttacttttacattttctatcacatgggctaaaattgctcccgtatataagctcctgttcaatcttagctatttgctttatttaatttttgttcaataaaaaggatggtgttaagtaattgtcttcctgccttcattccaaaaatatgactaatcttggccaagtaagttattgtcctcattagtttccctgccaaggaaaaatcaacagaaaatgtcagccttctacatagctccttccatctacattcctgtgtggctactggctagatcattctgctcctacccactgggtgcggattagcagaagtataagtcaactatgatgcagatgctatccggagactcagaagggcaatccttaggtgtggtttccatgaataaaaggcctttggacatataaatataggagattaaacttgtatttcactttgatattgtgatttgtagtaagaaatatacatttggtctttgccaccagttcccggcacagtgcttctaaaacccttgtaatttcctgaatgacaggagtgccaggaccatcttttgttttaatatttggtctgtgactagaaacacagctcctaaaacctctggaatctcagaagtgtctttttttatgctaatgagatacatggtggctaaagtctcctgaagagcctccggttggggaatggcttccaggggaaccaacaatatgattagagcactggaagtttcagctctcctctcctgatgtcttacaaagagggactggcaattgagttaatcactattggccaatgattttaatcaatcatgcctacacaatgaggcctccacaaaaccccaaaggacgaggtttcaagagattctgggttggtgaacacatggaggttctgagaggtggtgtgcctaactggggcagggaagctctgtgtctctcccccttaagtgtcctatgtgtgtcttgcatttggttattcctgagttgtattctatataataaactgacactcataagtaaagtgttaccctcagttttgtcagctgttctagaaaattttcaagcccaaggaggggccatgagaacctcccatttatagctagtcagtcagaagcacaggtgacagtttggacttgagagtggcatttgaagtggggagcagtcttgtgggactgagtccttaacttgtggggtctgtagtaaccccaagtatataccatcagaattgcattgaactgtaatacacccagttggtgtcagaggttggaaattggttgatgtgggaaaaattcccacacatctgttttcagaagataaatattttaagtataggaaaacagtttatttttccttttttattcatataactttctttaaagacaagcaaatcatgattggaggtaaaatatgcccagaaaaaaagaaaaatggaagaaaaataaagacaggtaaatgaaaatgactcggtccagagatgcatatatccttactgtgtggcaaatataaaaatgcttgatctcctcttaccaaaaacacagacttaaatctatacctgtgaataaaagcatagaacccatgtaatagctacagtgtcatgttttgtattcagaaaaggtttataacagtgtttctcgggacccaggaaagaagagaaagctatgttattagaagtcactatgtacactattatctccagctgaatgtaaactgtgctcttgatgggaatagctaaagaaacatcaaatttaaagaaggagtcattagataatttttccatttcaaacagtgctttctgtgcttgctggttttgaccttcttctattccttcagaggccatctccccctctctctggaagagactgtaaataactaattattttagaacaagaaagaggcttgattcccttagctaatgtaatatgcatactagtctgtatgaacgctagaaatcatttctttcaaaagacattacaacttttattatccatcaaactaaatcatcaaaattatagcttccctcaagtttttaataaggtgatgctgcttgataaactaccacacatcttttgtcatcatataaatattttagtttcataactctctcataaatactagtaagtataggattggaaatcctttcagaaagcaaatcatagtgaagcatctatccagttctccaacaagactccccaactgatacattagttcaaaaataatcttaaaagcagtcaccatcaaacttattacaaaacttgcattcatcaagaaactatgccagaaaatttctgagtttaaatgtgttcaaatctgacttcgtagagcatttgatgtaacattcaggatagtaagaacagaagtaaaagctatccatcctctttaagctcttaaccttagagctctgcacctcttcttagaaacatcattcctccaatatttcagcctagatttttctcactgctaatactgcaattctgagaagaaggcaaattaactaaagttatcatcattagcagaggagtaacctgtgtcatagatatgaactgtaccacttctgaatgctttagacatttttcttagcaaagaagtatagatacggataaccagtactataacctgaaatactgcacaaaagcttataatttcttatcttgcatctgtcatttagaggtaaattaatttccttaattgctagagactaaggaatacatttttactctgtatttttcaatatttaagggaactatgttgttaggtcctcctgcaatgtgaaaggactgcaaggtctgactctcacaactaatttaaaaattgggatcattgtagaaagcctcttccatcaaagccacgggttgtaagaataaccttgcttttcaagattagttatactggggcaaaacattttttccttctctctactcaaattcctgaagtcccattatacttttctcaaagaagagtttataatacaaccagcgtgaagtcaccattctctatagaaatggcttctgatatatgaatttaacaaatgataggatataattctataaaacactgatacttagcacttccccacaaaccacataaaacttgtgaagtcaccattctctacagaaatgacttctgatatgtgaatatcataaatgataggctataattctataaaaccactgatacttagcacttccctacaaatcacataaactcgtagactgattttaaccaatacaactatttcacttctgtttgaggaagtattcaaactcagaatttattttgactgttttaagactttgtaacttgagatgtctccaaagagaatggtctaaagaaaggtaccacttggcaatgcaatgatagcatatgtaattgacacactcttagggaatcactctgcaaacccctgaacttataagggtataggtactattaagtagacatctctgctacaaagctaacaggtttgtgaaagtattcctcttcttaaattattgccaattctacccactttggttaatctataaaatattgatacggtgggcccccatccttactcctcccattaatttgacattgtaggctctagtcaattatgattttttttttttgagacagaattttgctcctgttgcccaggcgggagtgcaatggcgcaatctcggctcaccgtaacctctgcctcctgggttcaagcgattctcttacctcggcctcccaaatagctgggactacaggtgtgcgcccactacgcctggctaattttgtatttttagtagaaacggggtttcaccatgttggtcaggctggtctcgaactcctgacctcaggtgatccgcccacatgggcctcccatgaatttttacctataaaatgaaatcaaagaaaggtacagcagggagaaaccagctggctctgtgtgatataatcccatgagaaacaacatacaatgaaagaaaataacactaattactactatacctatactaaaacagtaaatgaagaaaaattctgggttcataaattggtagatcaatatcagtaagatgtcatgtctccctaaattgatctatagatttcagtgcaatcttcatcaaatttgtggcataagtttttttagatattaacaactgggtttttgcttttgttttttttttttagacgaagtctcgctctttcgcccaggccggactgcagtagcgctatcttggctcactgcaagctccgcctcccaggttcacgccattctcctgcctcagcctcccgagtagctgggactacaggcactcgctaccgcgcccggctaattttttttgtatttttagtagagacggggtttcaccgcattagccaggatggtctcgatctcctgacctcgtgatccgcccgtctcggcctcccaaagtgctgggattacaggcgtgagccactgtgcccggcccaacaactgagttttgacaaatgcatagagatatgtatccccactgaataatatttcctgatcttgatttaaccttcaagccttttctattgcatttacgctttgcatattcaataccattacttaatatatgcacgtagccaaaataatttttagcgccctatttagaaataaaaattacataataggtcaggtgtgatggctcatgcctataatcccagcactttgggaggcagaagtgggcagatggcttgagcccaggagtttgagaccagcctgggcaacatggtaaaacactgtctctacaaaaaaacacaaaaattagccaagctggtggtgtgcacctgtagtccccgctacctgggaggttaaggtgggaggactgcttgagcccgaaaggtggaggttacagtgagccaaggctgtgccactgcactccagcctgagtgacagagcaagaccctatctcaaaataaaataaaataaaataaacattaaggctggctttcttattagaaacaatttcatgaagaaaaaaataaatattttcactttacaagaactatgcttctggcagaatgtacatgtttgagaaatgtttgctgagtgaacatatgtaagtataaataaactttaaacacattctaggaagttgagatgatgtaaaagaaagcgagaaagttccatagtcattttctacatgttcttctatgctcaaaaaatctttatggtctcatggtacaagggaagaagtttagacctattaatgaaatattaggaaccataaacaattggcccctaatgcctttccagacttctcttctgttacaacctaacatccttccaaatccaaaataaatactaagcgtcaagcaacttaacatactacttcaggacttttgctgaagcagtgcaaatgccttttctctttagcatgtgttcaagctccacttacattccacttactgttgctacataataaattaatcccaaacatagcttaaattaaggatcaccttatcatggtcaaggagtatggggattaggaattcacgtagcacaaagaggcgatggcttgtctttgctttacaacgtccagggcctcagttaggacaacctggagactgaagatgatgcaacagtttgaggctggaatcatcttaagtcttgtccactcatacgcctggcacctgggctaggagattcaaaggctatgactgccaaacagagtaccaacccttggcctttccaaattgcttgatttcttcaaagaatgaagacctcagagtagtcagacttcttacattgcaggctcagggatctaagtgcaagtattccaagaaaaaggaatacatctggatcattatttatgacccagcctcagaagtgcatattcttttgttccaatcagttatgagaccacccagatttaaggaaagaagaaagaggtatacatcttgatgggaggggtataaaagagctttagggctgtgtttaaaaactaccacagcttttataatcatgacaaatttttacctccaagaaaatgtttacaaactcttcctaggcaaacttaaattctcccaaaatactcttagtattttatagttattatcatcacaggacttaatataaccttccatttaattgggagttcctcgagagatgggcttcataatttgtataccccattacagcacctggtatagtgctctatactaatgtcacaaatacattttttcaatatttattctatagtcaaactatccctgtttgcagatgacatgattctacacctaggaaatgtcacggtcttggcccaaaagttccttcagctgataaacaacttcagctaagtttcaggatacaatatcaacatacaaacaccactagcattcccatacaccaacaacagccaagctgaaagccaaatcaggaatgcagttccattcacaattgccaaaaaaagaaagagatacctaggaatacagctaaccaggaaggtgaaagaggtctacaatgagaattacaaaacactgctcaaagaaatcagagatgacacaaacaaatggaaaaaacattccatgcttatcagagaagtatcaatattgttaaaatggccatattgcccaaagaaatttatagatttaatgctattcctatcagactatcaatgacgttcttcaaaaactagaaaaaacattttaaaattcatatggaaccaaaaaagggccagaataaccaaggcaaatctaagcaaaaagaacaaggctagaagcatcatgttacccgatttcaaactatactacagggctacagtaaccaaaacagcacggggctgccacaaaatcagacacatagaccaatggaacagaataaagaacccagaagtaaggctgcataactacaatcatccaatcttgaacaaagccgacaaaaaacaagcactggggaaaggactccctatttaacaaatagtgctgcaataactggctagccgtatgcagaaaattgaaactggaccccttcgttacatcacatacaaaaattaactcaagatagaataaaaacttaaatgtaaaacccaaaacaataaaaaccctggaagacaacctaggcaataccattctaaatataggaactggcaaagagttcatgacaaagatgccaaaagcaattgcaacaaaagaaaaattgacaaatgggatctaattaaactaaagagcttctgcacagcaaaagaaactatcaacagagtaaacgacaacctacagaatgggagaaaatttttgcaagctatgtattgacaaaggtctaatattcagcaactctaaggaacttaaatttgcaagaaaaaataaccccattaaaaagtgggcaaaggacatgaacagacatttttcaaaagaagacatgcatgtggccaatgaccatatgaaaaaagctcaatttcactaatcattagggaaatgcaaaccaaaaccacaatgagataccatctcacaccagtcagaatggctattattaaaaagtaaaaaaaaaaaaaaaaatagatgctgacaaggttgtggagaaaagggaacacttatacactcttgggaggagtgtaaattagttcaaccattgtggaaagcagtgtggaaattcctcaaagagctaaaagcagaactatcatttgacccagcgatcccattagtgggtatatacccaaaggagtataactcgttctatcataaagacacatgcacccatatgtttactgcagtactattcacaatagcaaagagatgaagtcaacctaaatgtccatcaatggtagactggatacagaaaatgtggtacaaatacaccatggaatactatgcagccataaaaaagaatgagatcatgtcctgtgcaggaacatgaatggagctggaggccattatccttagcaaactaacagaaaaactgaaaaccaaatactgcatgttctcactttgagggagctaaacgatgagaacctatgggcaaaaagagggcaactacagacactgggacctacttaagggtggaggagggaagaagggagagaatcaggaaaaataactgctaggtactaggtttagtacctgggcaatgaaataatctgtacaaacaaacccccgtgacataaatttacctatataaaaaacctgcacatgaacccctgaactataacaaaagtttaaaatatatatatttattccacaactactacaaattctataatctactagtgataaataacagtgaataaggcagagtttgtgtctggttcttaaaacactattgtccatcagaatgaaattaagtaagtaattatggtaaaatacaaacccaataaatagcagctactagaaaaagttacttataaatgttctcagcttcagattcctaaatctctaaaacaggaataacattcacttctgataagtaactataaacagcaaataagatgacaatgtgctaaatgcttagcatggtacctaaaacactgtaaataatcaagaaatgttattttctaaaagttatcaaaatagtataaatgtaaaatattgatttttatatttgtgctttactatataatacgaagtttactgctataacccaaatctcaatgccttaacccaatgaaagtctaatattcattaaataataatttgggggtggcggtgagcaggagtatcgcagtagagagagaatacttggtacatggtcatttagggaactaagttccaaaaatcctgtgagatctacttttgaggacataattgaaagggaaaagaaagcaaaccctacatttgcctcgaaatgacttctgctcatattccattgacaaggcatagtcacatagcctccatacatgggggctatctgagtctatctgtatgccccaaaagagcaaagagagaatctaattagtttctggaacaatccattatttaactcactaaatacctattttttttttaattcttcctcccagatatagaatgcactcaagctctccactaggaagattaccaaaggtcccagccaggacaaaatctaggatctccagttcatacataatcttcttcatcagatgtagatgtcgctctccatgtccccacaacatacgccttaaagagaagatatctgtcctgtctccctctgtacaaaacacataccatggggaaacagagaaaggatcaccgcatttagaaatgcaaaaaaaaaaatggaaaatattcagtggttgctaatctgtagcattatgaaatcccactggatgtatgaacattgtgaaggaagaaattccttgttaaggccctaattttgttctccaggagaaactccctagtcctttgttgttctccatggctcctggcttcaccctctatgggttttccttgcctgttatctcccgtggccacatatgaagttggtgttgagaagtatgccacttgaggacagcttttagggctcaatgaacagtcacatgccttctaaggccaagttccaagtttctctagcaacaaaattccatcagaatcatagcagcttccagtcagatccaaatgctaataaccaactccaaaattactttttatcattctcaaatctgctttatttttttgcttcttttcccaatgtctcatctctctgttaatttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacactactaacaacttcttttcttaaaccttcaatcttggtagaaacatgaaatggcctccaagttgccaaaggtaagagttttacaaacattcatcacatgacatagatttctagccatcccaatatgctgtatgtgttcctcactgcccaacccttaggccaatgtcatatactttgggatcttgttacagtagcaacacaattcaaaatgtcaatttctatgttgatcagggtaagtaactctctctgctgtaacaactaactccaaagcttcagtggcttacacaacaaaagttttccctcttatgtcacaatcaatttgggacagggaaagatggtctttcactatgtgactcaatgacattttgtctactagtgtctatcctagggccttggaaactcccactaaatattcctcaatgaggagagtatggaaagttttgaaggaaattttagggttagttctaaacgtcatgctcattattttcatccacattctactctcgagagctagtatcatggccccacctaatacaagaggaagtacgtctaacagtatgccacagaagagagaaaatggttataatagaataaccacccagtctctgccatatctgtatccttgaacaaaaattgcatactcttatctatgccaaaatccaaaactatctatcatttcaagcagacccttctcagcccacagatggagaatactaaataaatgaagtccataggttcatttagttactctagtatataaagtataattctgatataaccatatgaacttaatccaaatcaaatatttcgttgtcattcttttaaagataaattatcttagtcatgattggataaaatttatgacagaaaactcattactttttcaggggcgaaacactattttcattcctgaccaaatgtcaacataaaagattaagatgaacaaatcaagatctattatttctggagaatgggattactgatggaagagggggtacttaaatggaaatataataatttaatatttaaatttactttgaaatgttttaaaatctatttcaaagaaaaaaattgttttgttacaataatctgtcttgtttaaataagtaacaatattttattgactagaaatcaaccccaaaagctagtttttaagctgtttagttgaaaactctttatcgacaaataactgatcatctgttttagttctaccttaacataaatgtcccacatattgtacctggataaaacagtaaagacttaaacacttcaaaggaaaacatactttaaatataaatggaggcatttagttatttttttttccctcaagtctatataaaaaggtcaactgctaagtaaaaacaagaataggaatgaaatgggaggataaatcttttaccaaataaggataaacgtagaactggagcaattatctaatatattaaattattaatcacatatgacttaaaccttctggaattggcatgaaatcattatagaaacaccagtcagcatttcttgtaagactcctaaaaaagtagaaggttcttcccaactttctatgctaaaggttgacatgtatttcccttggagaacatgtctatatgttatcaaatcttatattccaaaatacacagtctcttgccttcagggacgcaataacatttgaaaacatctatgcatacatacacaatactttatacctctaaaaatatccagtaatctagttctaaagaggttctataatgctaaccagaaaatcccttggcatctctttgctcgctcagccatctggatccatcttttttcgctgattagggaggaagagcacaaggttccatatatccattgatatctttaattaggattcctttcctccccatgttgttgaaagtcaaagaaacagcacacccaaaatatctttgaaaatggtaaaagtggtattcaaatgttactactgcatagagcttattttcttggttataataactcccattcacataattccttatagatcgcaaagtatacagcaggttaatctgattactccaactagttgacaaatgtaggaaatcagaaaaaatgataaacatctctgttcattttaacttaaaacataaatgtacaacttttactacaataagaaacttttagatttagaagaaatgtgatgatttcctgaataacctttctactgtttttcataaattaaattattgagtataacataaaattatggactgggggactttggctaccacagaagaaatttctagctttgcaggtaatttttgcccatcttcctctttatatttaaataggtctattgctgtcactatgcatatgattcctatatcacccataatttcattttccaatgaatagtcaacattaatcaactattactgtcatcttcactaaacgttcaggaacacatacttttatagctatcagccaataaactatatttttagttctttttgtgattcattattttctgtagcattgtcaaagttagttcttgtttttctctaagatttactaaaaattaggctgggaattctgctttacctgtggaactgaactgggaattctgttctatttgtaaaaactatccataatgcagatgacttgtaaaagacatccttatagaatctatgattttgaatccaatttatcttaaaacataacttaaaaattttcgtcatgccagaaccccttgatccatatgctgaattaaggaaggcatatttattaattagaaaacaccccatataggccgggagcggtggctcacacctgtaattcaagcactttgggaggccaaggtgggcagatcacctgaggtcgggagttcgagaccagcctgaccaacatggagaaacccctctctactaaaaatacaaaattagccgggcgtggtggtgcatgcctgtaatcccagctggtcgggaggctgaggcaggagaatcgcttgaacctggggggcggaggttgcagtgagctgagattgtgccattgcacaccagcctgggcaacaagagtgaaactccatctcaaaaaaaaaaagaagaagaaaagaaaagaaagtaccccatatattgtcctaatttcctcacaactgagatacagtgaatgcctactgtatttcaggtattaaaagattagtagaaaaaatgacatctactcaaaggtgagaacaatgacacaaaaagtgtcacccaaagtcaaagtataccataagaaacatataaatggtgaaccaaagataaagcaggattctgactaagggaattaaaaatgttccacatgtgctgcagaatcaaccatgggtattaaatgaaaagcaagaaggtgagagaaggggaattcaaagagaaaggaatagcttgatcaaaggcacagaggcctgaaaatccgtaatacattttctgggggaaaaaaagccaataaaacatggctgaaatacagaatgtttgggaagaagcagcaaagggtgacagtactatacgaggctttcatagaaaaataacttataggcaaataatgaaagcattttctacaatgataaagaggattcatttcattctgtagatagtgggatgtccctgacacttctggagtaaggtaaaagtgacaagatcaaattggtgtttaggaatagtaactctggtgatagtgaaatgtaagcaatgataaactagaggaagactggataagaaatttttataattaccaagaagaaagataatgagagccttaaatttaagcagtagaggccaaggtggaccatatttggggccacaaaactagcattcataaaatttaaaataatttgaattatacaaatctacatcttctgaccaccatgcagttaaattcaaaaccaatttatctacaaaatctcacaatattaggaacacaattctaaataactcacgggtcaagaataattcaaaagaaaaatttaaaaatattttaactgaataaaataaaacacaatttaataaagtttgtgagatgcagttaaagcagcgcttaaagattaatttatagcactaaacagttttaccagaaaggaataaaggtctccaatcaatgacttcagcttctatcctaaaaacttgaaaatgtaatgcaaattaacccaaaagtaagcagaaggaggaaaataataaagttgagaatggaaatcaatgaaagtggtaacaaaagtaacagaaaaaaataaatgaaagctggtcttgaaaagatcaacaaaatttatagattgatcagggaaaaaagaaagaaggaagttttataattttagagtttacatttaggtctatgatttatttggatcatttttaatacactgagagatggattgaagatcatttgttaatatgcttattcagttattctgcaccatttgttgaaaagactatcctttctccactgaataatctttatacattttttttaaaaatcggttgtccatatatgtatgggtctatgtttgtattctctatttagttctattgattaaattaatattgtttatcgtctatcttgtctacagtattaaactattttaatcattacaatgtgtcttcaagttaattagtggaagtcttcaaactttgctcttacttttcaaagttgttttgcctagtgtaggtcttttgcatttacatataaatttgaattccaatagattattgctatcctatacaaaaataatttttgtaaattgatcttttatcttgcaacttctaagaaatccttaattagttttagtagtgtttggagattctggaaagtattccacatacaggatcattttatcaactcttttctgtattttttatttttttaagaaaatccctatgaaatagtttcggtattttcttctggcctatattttagttcacgaattttcttcaacaatactcaatgtgttgctaagtcaatcctctgagttgctaatttcagttatcatactttttcagttctcgtatttgatgtaattcctagtttctagttctctgccacatactaagtcttcttcccccttaaacgtattaagcacagccatgtatgatagtcccattagctaaatcccctgtgagtctgtttctagtaatatttctcttagtttcttaatcacattgtcttacctccttgaatgtctgactatttttgattgaatgctaaatgctgtatgttttttatgtggccataacttgagattctcaatggtgctaccttcatccaaattaaacttatgttttcttttagcaggcagctagcctaatggccttagaaataacaaatcaccttaatccaatcagaggttaaaattattcaaggctaggattcagtctcagtgacagctgatctatttctagttcaccaatacacatacaatgtagtctattttgacaaactaaattcagaaactgatttaagttaaaagaatgaaagttacccagtttctgactccattaaagtcagaaaattctgactatctattttagtactgaaagctctctccaaaattaaatgctctctatcttctgtttttgtgttaaactccacctggacttctttattaattataaaacaaataaaccatttgcaatgagctataatgctagtcacatggaaaacacgttaggcaaaactactttctgcatatagttgtaattcagtaattgtttcactatcactcagaagagaattattttatacactggttgcatttagtccacaatttaaatcattttcccgcattagagaatagtaaaatgtaagagaaatataaatttcatgtttttaatttgttcaaaattttaaaacattaaattttgtaacactgttgccatgctctgttgacagttatattagaagagggtggaacaaactcataagtatgaggcctccctggttcaaagaaagtagagacagaacattcaaatatatattatttccatttatttgtttttttaaaggggaactttggggtaatgccaaacaataatatttatgtttatagtctagaactttatgtgttcttttgttaaaatttcccaccaattttattctcatttcagaggggaaggtcatacatattttaaaacttcacatatataaaggattaaatagttaaataatgtttgtatttctgacaattttcaactctaccttattctaaaataaagtaacattttaaatgtcttcataattttatttttccaagcctactggtattttcacattattgaaacagttacaaatggggaaaattaccatgtactttatactatttgtatcttttcaaggatacaacttatcaagctatcagatcatttactttactgaaagaatgaatacaaattgatggtggcagtggccagtttggaggagcccctgtggggatgccagctgcagtcagggacgtgtggctggggctgtgcattccacagagcccacgggggtgggacaggtgggagccccgccccctaccaagtcccgtgctaccaggcacagctgcagccgcccagctgcagctctggacccgggcatccctgcactctcggaagcccaggaagccccccctatccccacaggcttggaagtgcctgctcctgttccctggcctctcctcgctcccagtgcccactctgatttcagagaaaagctgtggctgagcctggatgctgtcgccacctggccaggtgtgtgcactcagggtggtgctgacatgacagccctttgctgactcacccacctctggactttggtaaccatggtaaccagcgagcatgggagggtggcctggggtgaagacagatgggtgcaggcttgcagctgcccctcggcgcgaacagcctgggcatcgtggacagcatgtcgatggcagtggaagacagaaaggttaccaggcatgaaggggccggtcctcggtgaaacccccaccttcaggccaaggatagcctgaagcctggggtccaggccatccagtcctgggtgaagttggcacgtcagttctgggtgaagtctggggctcagagtgagaacttcattgatggctgttcagccagccagatggtgctttttccaggcctgcctgtggccacacatggaccaatcagcacacagagccaaatcaggaatgaacttccattcacaatggccacaaaaagaataaaatacctaagaatacagctaaccagagaggtaaaggagcgctacaagaagaactacaaaccactgcccagagaaatcagagatgacacaaacaactggaaaaacattccatgcttatcagaggaacaatcaatattgttaaaatggccatactgcccaaagtaatttacagattcaatgctatgcctattaaactaccactgatattctccacagaactagaaaaaaactattttataattcatatggaaccaaaaaacagcccaaatagctaaggcaatcctaagcaaaaagaacaaggctgagacatcatgctactcaacttcaaactacactacggggctacagtaaccaaaacagcatgggattgccacaaaatcagacacacggatcaatggaacagaacaaggaacccagaaataagactgcacacctacaactatctgatcttcaacaaacgtgacaaaaacaagccctggggaaaggattccctattcaataaatggcgctggaataactggctagccttacgcagattattaaaactgaaccccttccttacaccatatacaaaaattaactcaagatggattaaagagttaaatacaaaactccaaaccataaaaactctgaaagacaacctaggcaataccattctaaacataggaactggcaaagaattcatgatgaagatgccaaaagcaattgcaacaaaagcaaaaattgacaaatggaatctaattaaactaaagagcttctgcatagcaaaggtaactatcaacaaagtaaacagaaaacctaccgaatgggaggaaatttttgcaaactatgcatccaacaaggtctaatattcagcatctataaggaacttaaattcacaagaacaaaacaaacaaccccataataagatgggaccttctagttgcaagaaaataagcttagggctcccactgattctaccttatggtgagttttataattgtttcattatatattacaatgtaataataatagaaataaagtacacaataaatgtaatgcacttaaatcatcctgaaatcatatccccctgcccacagtccatgaaaaaactgtcttccatgaaactggtccctgatgccaaaaaggttggggaccactgctctggaacaaatggacctaacagacctatacagaacattccacccaacaacagaaggataaacattttcctaagcacacattaaacattctccaggatagatcaagttaggccacaaaacaagtcgtaacaaatttatgaaaactgaaatcatagcaagaatattttctaaataaattggtatgaaattagaaatcaataatgggaggaaaaactggaaaattcacaaatctgtggaaattaacacactcttaagcaaccaatgtatcgaagaataaactaaaagagaagtaaaaaaatatcttgagaaagtgaaaatgaaaaaaataacgtatcaaaccttatgggatgcagcaaaagcagttctaagaggaaagtttatagtaataaatgcctacattaagaaaaaaacaaagatctcaaacaaacaacttcactttatacctcaagaactagaaaaagaagagcaaactaaatcagcggaagaaaagaaaataataaagattagagtagaaataaatgaaatataaacaaggaaagcaaaagaaaaaaatcaacaaaactaagaggtggttttttgaaaagacaagcaaaattgacaagcctttagccagactaggaaaagagaagactcaaataaataaaatcagaaataaaacagccaacactacaattgatatcatagaaatagaatcataagagattactatgaacaatcatatgcaaacaaattgaataacctagaagaaatgtatcaattcctagaaacataaaacctactaacactgaatcatgaagaaataggaaatctgagtagatgaataataagcaaggagactgaatcatacagatcataaaaagccatataaagactacagaaaaagaaaattacaagctaacatccctggtgaatacagactcaaaaatattcaacaaatggaattcaacagcacactgcaaacatcctataccatcatccccagtaggatttatccctggagggcaagaatggttcaatatatgcaaatccataaatttagtataccacattaacagaatcagtatcacatgatcatctcattaaatcacaaacaacatttgataaaatccaatatattttaatgataaaaactctcaacaaattaggtaagaaggatgtaccccccaaataataaagtctatatatgtcaagtccaccagtaacatcatattcaatgacaaaaagcttttcctctgaaagtttttcctctaacatcagagacaagcaattatgaaaccacctttgcaaaattatgactgagacagtgaaagagatctaacttaaccgactccatcttgcttctaacctccaagctgtccttgtttgttccttggcgtaggctgaactaactttgggagaaatgtagtttatagtttaaaaaaagatggtaacagccctttcccaaagcagacctccttctggcctggggactagattacatttgtgggactaacattagccacaagattagaaattatggtttaggagtcatacagctggaagctacaagattctgaccctccctgaattgctcctaagatcagagtttgagatgttttgcagaccctgcacttgacagatcagctggcaccactcagatcaataaactggctcatctgatcttgtggcccccacccaggaactgactcagcacaagaagacagcttcgactccctatgatttcattcctgaccaatcagcactcttggctcactggcttccccctaagttatccttaaaaactctgcccccttggccgggcatggtggctcatgcttgtaaccctagcactttgggaggccaaggcaggtggatcacgaggtcaggagatcgagaccacagtgaaaccccgtctctactaaaaatacaaaaaattagccgggcgcagtggcgggtgcctatagtcccagctactcagggggctgaggcaggagaatggcatgaacccgggaggcagagcttacagtgagctgagatcacgccactgcactccagcctgggcaacagagcaagactccgtctcaaaaaaaaaaacctctgccccctaaatgcttggggagactgatttgagtaatgataaaactctggtctcctgcacacctggctgtgtgtgaattgcactttctctattgcaattcccctgtcttgatgaatcagctctggctaggcagcaggcaaggtgaaccccttgggcagttacaattagacacgaaaaagaaataaaagacactcaaaatgtaaaagaagaagtaaaaaatatctttgcagatgacataatcttatgtatacatagaaaaccctgaatactccaccaaaaatctgttagaagtaataaacaagttcagtaaagtcgtgaaataaaaacatgtgttggtaaaaaaaagtgttggtgaaataaaagcatgtctaatgaccaaattcaaactctccattccccaaactatacctttttctataatatttatttcagaaaattattctaagacaaaaaccttgcctctttccatccctaatctctattttcagtgagtgcttcaagtttttgctatatgggccaaaaagatctggccagagaagaggcaaagagaggaaaaaaggaagaaggaaaaaaggaaagacaggaggaaaaagagaggcggaaaaatagaggaattacggcagtacatacaccacaatgttaacagtggttatctctggttgaagagattatgagtcatcttcatatttttctttatacacctttctgtattttggagattgtccttaaaaactgtgcttcctttttcatgagagagagaaaaaaagttgttttgaaaatgtctttaatgatattctgaaagaactctaagcccttcattatgtggttcatacacctcctgccacaccccatacccttgtatcttttcatatctgtacctctgcacaagcagctatctcttcctagaacattatccccatttacctgcacctggctaattcctattcatccttcaaaactacacgtgtaccacttcctccataaaatcttcttgtaccacaaacctcattacaggttcatgcctctaatcccagcactttgggaggccaagatgggcagatcacttgaggccaggagttcgagacacgcctggccaacatggtgaaaccccatctctactaaaaatacaaaaattagctaggcttggtggcacacgcctgtaatcccagctactcaggagtaaggcaggagaattgcttgagcctgggagacagagtttgcagtgagcctaaattgcaccattgcactccagcctgggcaacaaagcaagactctgtctcaaaaaaaaaaaaaaaaaaaaaaataggtcataagaaaatagcagttttcaatcgtttttttctggctgccacaaacatggacacacccaaagttatgcattcttcccacaacaagctaaataactctactcctaatagggtatgaagcctcacagtgtttgccagttatactgcctcttctttaaaagcaagccaaagcagtctaatttacaaagccaagaatgacaagagaaaccaattttaatttcctaaccacaaatgattagcacaggaatgactagctgaagcctgcactgttaagaactctccatattggataatatgggagagacggctggctgttcaccagtatccattttccatattatatatggcaatatgcctaactcaaacaaatacacactaaatttctctgcctcctttgtagtcagacatggttacacatcagttctggccaaagagataccagtaggagtgattggtacactttcaggaaaattctttttaaaaggaggaagagggtgggcgtggtggctcacgccagtaatcccaacaaggattgcttgaggctaagagctcaagaccagcccaggcaacatagcaagacctccttctctacaaaaaaaaaaaataataattaaaaaataaggattagccaggcctggtggcacatatctctagtcctagctactcaggaggctgaagcagcaagagtgcttgagcccaaaagtgcaagcctgtggtgtcctgtgattgcaccactacattcttggctgggcaacacagtgagaccctgtctaaaaaataaataaataaaaatagtaggaagactcggttgcatttttagcactgttcccctttcctcttccttctgtgtaggacgagaacatgaagataagagtgatatcctatataggaaggaatagaaagctggacagagcatgagtctttgacaacatcacaaagttactgttaacagccccaaatcacctaccttgtctttttttttttttttccaacagggcagaaaaatacatccctacctcatttattccattatagtttgagcattctgttacaggcatttagttgaatataagcctcagtggaggctgaggataactagtggaactaaccgaaatctctatccttggggcaaaggagtaatataattgagaatgacaaatataaccaagagtgaaaagacaaactctaatgctgagcacccaaagagtttctgttatgtctttgaaataagaacgcagggtttcatgttgtctgagcttcattgcaggccagagcagcaactaaaatagcattggtttctcttccatttaaaaagatatcagaatgcagataagtgagaataaccttatcttacagatacccttaaatgcactcttttaaaaatttttaataaaacagtcacaagttttggcagtcaaattatcagaaccaaattaccagtactccgtcaccctccgtattctagcatccttatctggcatgcagttaaacagacaggctctatttaaaacattgaatgaacagaaatggatatgcataatttatttaaatagtgatagatggaaggaaatcaaagagaagaaacatccaaaactatatgacctttacagatccaagaataactaggaacagttctgtttatatgtggggcttcctccagtctgacagcattcctcagactgtccctttcatctggaaatttcccaaaaaacccagctttttcagctgagtctttagactagttttagctcctctaagcatgcaaattgcttcctatatgtttcatgaaaatatcagggaatgtatgagggtcgaagacagcataaaacatgaagtccaaaggactagataaattcactgagggacaaagctaatgtcattaagtgaggtctagtaggagaaaaataaaagctgaaatcacaactctgaacttaagctaaacacagtgtccagatgagaatgacagaaagtgggcaataaacattttcaatatggttctttaaaattcaaaaagaattgtaattacagcaaaaaaaaattttcaaagactctctcacatccctaaaatacacaataatgacaagatttaataattaaaattgcacaactaattttccacaccttggatctacaagtttcagagggcaaaggtggccaagtaaggaaagaaaatgaagtctcctagaactgctcctaatgaaagaaatccttttgataacattaggttttatactgaaaccacagcattatttttgaaaacataccctaataatgacaataagagtagcaacagattttacttttatgcttactatataccaggaaccattttaagcacttgatgtgtattaagtaatttgatccatatatctctcccttccagacatataccaaacacaaattggataagcaacactttaaagtaaactaaaagaaatcaatcacatttcctattcaaatgaaatgcagagcctttaagattttagtactggaaacatttaatagatacataaggatcaaatgacttaatatacatagagtgcttaaaatggttcctggtatatagtatatgaagtttatccccattagactgataaaaagaggtatagagcctttaaataatttgcccaaggtcacagtgttaccaagtggagaagccagaactaaaactcaacaagactgttctagagtccatgatattgaccactgtaccaaattactttgtaagtgttataccttaagttcatttagagagtcaagctggacaaagctgaaattatttctggcttctcactactctatcaaggtagtgcttctctcccagttatccaaatttgaatcagtgagataacttttggtgcctcagtgcattccatattcaattagtcatccaaccaaaccctgtcaattaaatactccattcccactcatattgtcaccatcttggatattccacagtcaaaaactgcatcagcttttctataagctaatagctcatgccagccttattaataaaacatctaggtctttttcacatgaactgcaggtcttacatcataattttgtaggacataattataataaaatattttacatttcctcaaaaaaattcactttattaatttcagtccattattccagcctatatattaactcttccttccagatatataccaaacacaaattggataggcaaaactttaaactaaaagaaatcaatcacatttcctattcaaaagaaacacacagcctttaagattttagcactggaaatatttaatagaatcgatagtcaaagacagtagctgaatcaagtgaccttttaacacataagttacactttggagtggggcgctcttagttcagttaccaaaatcctaatttatataactgttacgggagcacggtgcttcctttaatctatcttggttccactgagtatcactgagacagtttgaagactaaaaagactaccaaatggaaacaaccaaacagctaaaaacagtccacagcatacaataaatcacagtgctctccaacctttttcacttcatgcaacatagaggatgttatctatacacccataccacagctaatcacaagactgctcacagtcagagatctcaatatctcaacacacttagggctaagccaagtgcctcagggcatctcttagcaagtttcacactaaactaccacaatttatttgctctcagcattaataaatcctcatctattccaaaccagatagtcatccaaaaccttggaacaactctgaaggtccctcatatggattccttgcttcccagctccctttacaactggatgtgaaaggtgctgtcttctgtactttctcttgagaggcagaaagaaataaacaatggctaattctgacctatacctcgggccctcctattttctatttttaatctggagaaatacctattctagcagcttgggtaacttactatataaatgattttggtctttaggtgagctcttgcctccacagacaagggacagctacctgatccaaagcgctaaggtgatgtgagattgtaagatataatgcattgctattggtatttgaagcttgccacagatattaatccagtgtgatatggattagatcaactttacattatccaatgccttgcccatgctttcatgccctaatagcaatacagctaacatccctaaaaatgactgccagaataatagcaagagctcatggccccattagcaatagttggcactagtttccagtttccaatatgatctgttgcaaaattagccaaaaatgatgtccaaagatttgccgaagttgaatttctttttgaaatgcagaggacaacttcattaagattctactagtacactgtagcattgtacactgtaccagcactaaacagaaccaaatctccatcccagtcacttcaactagatagtatctaaaatctcacccttagtataatgtacttaaatgagatggaaatactccacattctgccctgcctaagttctagaaatttttattaggttaagggttctatatttataacttaatgacacatccatacatattaggaccttcaactcttgaaaaaggaatttgaatatgtatgtattttaatacaaatttagcaaataggcttctgagaagaaaaagatctcacagtattttcaattatagtaactgtacttttagcatatgtcaagttaatggtcctataaactcacagaaaagaataagactcttaaagataatatgtatcaatgaaggcgagtatacatacaagaggaagttcacaatcactttaaaaaccatacaataccgagtccataagggcattgccacattggttttatttaccactatattcccagcacccaataccttgactagcacataataggcactaagaaaatacataaggctgaatgaatcatagcaaatatttaatataaactaaaattagatgatcacttgacaagggtattgtatacaaacttatttaatcagtaaaaggaaggttagaatttgaccaggaaatctttaaggtgctttccaaacctcaagacttcataacattttcatcactatgccagtgaaagtattaaatgaaggtcatactctattatagaaaggactactagaaacatgtctatcaataaccacaggatgcattataatctaccagtcagcctttttatacaaataactgtcaagcgggggtgggcaggggaagggaccacaagagaaaccataaaacattagtaatcttaaaggataaattaatcttgtttatatacttctatatttatacacaaaaaaatgttaatctaaaaatgactaggtctatgaattgtgttaaaagaacaaatccaaaaatgatgtattaataattagggggaaaatccctggtatcgaaagtaatagaattattttttccttaaaagctgcaaattagctgggcatggtggctcattcctgtaatcctagcactttgggagaccgaggtggggagaccacttgaggccagcagttcaagaccagcttggccaacatcacaaaacccatctctactaaaaatacaaaaataagccaggtatagtggcgcatgcctgtagtcccagccactcaggagactgaggcgggagaatcacttgagcccggaagtcagaggttgcagtgagccgagatcatgccactgtactccagcctgggcaacagagcaagactctgtctccacacacacacacacacacacacacacaaaaaggctactaattgaaaagttcagtaccagttaagcaactgctcagttacagaattagtttagaaatacacaggatttttatacttgtacttaatgataagctgcaaatatctgactatatttccctactcttttctctgtccttctataaaatacaaatatttttgaaatttttgaattatatacaaataggtcacacattaaataatggttaatttaacgcaagaaactaatgtccaccgttaatgaacttcacataacttcccataatatacttcacattaaagatattttcttcagtaatttgttaagattaaaagtctagttacaggccaggcgtggtggctcacgtctgtaatcccaggaattctagaccagcctcagtaacatactgaaccctggtctctacaaaaataaaaattaaaaaattagctgggcaaggtggctcatgcctataggcccaacaacttggaaggctgaggtgggaggatcacttgagctcaggaggtccaggttgcagtgagccctgaccacagactgtactccagcctgggcaacagagcaacactgtgtcttctaaatgaataaataaataaataaataaaatctagttgcaatttgcttggtaatataggaaatatgaaaaatgctaaaagctattttacctagatcatttgcttttcttagactctgtttggcaaaaagcagcaggaaactggttgccttgatgaagtaataggccacggccaagcacggtggctcatgcctgtaatcccagcactttgggaggctgaggaaggcggatcacctgaggtcaggagttcaagaccagcctgaccaacatggtgaaaccccatctctactaaaactacaagtatcagctgggtgtggtggcacgtgcctgtaatcccagctacttgggaggctgaggcaggagaatcacttgagtcccggaggtggaggttgtggtgagtagagatcgtgccactgcactccagcctctgcaacagagtgagactctgtctcaaaacaaaaaacaaaaacaaagtaacagaccacattccacccatcactgttttactgtttttttacagtacttatcaattatcacatactacataatttactaacattatggttagtactggtctctctccactagaaatttaagttctgagaagacagcttttatctggtttacagctatatcttcaaccctgatctcagttcctggcacataataagtaccaaatagatatctgttaaatgaatagactagaatctatcattgctaaatattcaaaaaggctataaattttaaagtaatattctgcataaatgagcaacgaccaaaaaaggttgtttttctctaagtacctgcaagccagctgttggtgatctttaactaacttattagtttctagactccacccttacccctgtttcatgttcaagaaccaattcttcccttttactaatatcagcatcacatggtcattctactcaaatttgtcactgtcaccaataggaaacaggctgctatgcgagatgaaattacagataatacccaggtagaacaatattaatccaggtaaatatttatatgaatttgaaatgtaccttccggaaattttaaagaggccagaatcagtctaaaagaatctgtagttaatagaatgagtggaagatattatttatgagcaggtggctttcctgtgctgcttctcaactaaggacatgtctcttcttctgcttctttggcttgtcagaaagtaaaatatttaaaacaacgcagggttccacctcatctttttatcaaagctcagaagtctcaggaaaaacagttatactgcataaggaaaaagaaagtgaacttcaagcaatggaaaccacaataaattaaccaattgagcacatttttcacacaagttttaaagcagtttaatactctttccaaagtaagtacataatattgtactgtttttctttcttttgaagagcatttaattggagaaaaatactgaagctgttagtactctcaatgaaatcttttttgaatttttaatttttatgggtacacaggtatatacatttatcaggtacatgaaatattctgatatgcatataatgcataataatcagtaaatggggtatccatcacctcaagcatttatcctttgtgttacaaaaatgcaattatactcctttagctatttttaaatgtacaaaaattattgttgactgtagtcaccctgttgtgctataaaacactaaatcttattcattctacccaactatatttttgtgcccattaatcttctccattacctcctctcccccgccacactacccttcccagcatctggtaaccatccttcttctctctctctctatgagatcaattgttttaatttttaactcccacaaataagtgagaatgtgcaaagtttgtctttctgtgcctagcttatttcattcaacatgacttccagtttcatgttgttgcaaatgacagaatctcgttcttcttatggtcaaagaatactccattgtgtatattgtcacattttctttatccgtttgtctgttgatggacacttaggttgcttccaaatcttggccattgtgaatagtgttgcagtaaacatgggagtgcagattatctcttcgataaactgatttcctttcttttgggtatatgcctagcagtggaattgctagatcatatggtagctctattttcagttttttgaggaacttccaaactcttctccatagtggctttagcaatttacattcccactaacactgtgtgagggttctcttttctccacatccttgccagcatttgttgttacctgtcttttggatataagccattttaactggggtgagatggtatctcgttgtagttttgatctgcatttctctgatgatcagtgatgctgagcaccttttcatataactgtttgccattcatatgtcttcctttgagaaatgtctattcagatcttttgcccagcttttaatcagattattagattttttttcactacacagttgtttgagctccttatatattctgtgggttgtctcttcactttgttgattgtttcctttgctgtacagaagctttttaagttaatgtgatcctatttgtccatttctgctttggttgtctgtgcttatggggtattactcgaagtctttgcccagttcagtgccctagagtttctcccatgttttcatgtagtaatgtcatagcttgaagtcttacatttaagtctttaatcaattttgatgtgattttttttatggcgagaaagaggggtctagtttctttcctctgctatggacatccagtttcttcagcaccatttactgaagagactgtcttttctccagtgtatgttcttggcacctttttcagaaatgagttccctgtagatatacagatttgtctctggattctctattctgttccattggtttgtgtgtctggtttcatgccagtaacatgctattttggttactatagctctgtagtttaatttgaagtcagataatgtaattcttccagtttttttaattttatttttatttttatttttttgctcaggatagctttggctattctgggtctttttttgcctccatataaactttagaactgtttattctatttctgtaaagaatgttattgatattttgacaaggactgcactgaatctatagattgctttaggtagtataaacattttaacaatactgattcttccaatccatgaacatggaatatctttcctttttttgtgtgtcctcctcagtttttttttcatcagtgatttataattttcattgtagagatctttcacttctttggttaattccttggtattttatctgtagctactgtaaatgagattactttcttgatttttttcagatagttcactgttggcatatagaaatgctaatgatttttgtatgctaactttgtatcctgcagatttattcaatttgttcatcagttttaatagttttttggtgaagtgtttacatttttccagatataagatccatcatctgcaaagaaggataatttgactccctcctttccaatttggatgccctagacttccttctcttatctggttgccctagctagaacttccagtactatgttgaataacagtggtgaaagtgggcatccttgtcaccttctagatattagaggaaaggctttcagttttccccccattcataatgatattagctgtgaatctgttgtatatagcttttattgtgttaaggtatgttccttctatacccagtttttaaacagtttgtatcataaagggatgttgaattttatcagatgctttttcagcatcaattaaaatgatcacacggtttttgtacattctgttgataaaatgtatcacgttgattggtgtgtgtgtcttgaaccatccttgtatccctgggataaatcctacttggtcatgatgaaggatcttttaaacattttgttaaatttggtttgctaagattttattgaggattttttgcatcaatgttcatcagggaaattggcctatggttttcttttttgctgtgtctttgcctggttttggcatcatagtaatactagtctcatagaataaggtttggaagtattccctcctcctcaattttttggaatagtttgagtcgaaattgcattagttcttctttaaaagcttgatattaatagaattcagcagtcaagccactggatcctgggctttcttttgctgggagactttttattacggctttgatcttgttacttgttattggtctgttcaggttttggatttcttcattgttcaatcttggtacgttgtaaatctctgggaatttatccatttcttccaggttttccaatttattgacatatagttggtcacagtagccactaatggtcctttgaatatctgcagtatcagttgtaacgtcttctttttaatctctggttttatttatttgggtctttatttttttcttactcaggctaaaggtttgtcaattttatcattacaaaaaaaccaactttttgttttgttgatcttttgtattgttttcttaatttcaatttatttctgctccgatctttattagtttcttttcttctcctaatcttgggtttggtttgctcttgcctttctagttctttaagatgcatcattaggttgtttatgtgaagtttttcttcttttttgatgtaggcacttatagctacaaacttccctcttaatactgttttcactatattccataggttttggtatgctctgttttcattattgtttgtttcaaaaaaaaatttttttttttgagaaggagtcttgctctgtctcccaggatgaagcacaatggcgcatctcagctcactgcaacctccacctcccaggttcaagggattctcctgcctcagcctcccaagtagctgggattacaggcacctgccaccgcgcccggctaatttttttattttttagtagagacggggtttcaccatgttggccaagctggtctcaaactcctgacctcaggtgatccaccggcctcggcctcccgaagtgctgggattacaggtgtgagccaccacgcctggccaatacaattttaaatttcttttctttttttttgagatggcgtctcactctgtcgcccaggctggagtgcagtggcgccatcttggctcactgtaacctctgcctcctgggttcaagcgattctcatgcctcagcctcccgagtagctgggattacatgcatgtgccatcatgcttggctaatttttatattttttagtagagacagggttttgccatgctggccaggctggtcttgaactaccgatctccactgacccgcccaccttggcctcccaaagtgctgggactacaggcatgagccagcgtgcctggccttaatttccttcttaaactcttcatggacccacaggtcattcagcagcatattgtttaatttccatgtgtttgtatagtttccaaaattcctctttattgatgtctagttctattctattgtggtcagagaagatacttgatattatttcaatgttttcgaatttttaaaaacttagtcaggagaggagccaagatggccgaataggaacagctctggtctacagctcccagcgtgagcgacgcagaagacgggtgatttctgcatttccatctgaggtaccgggttcatctcactagggagtgccagacagtgggcacaggtcagtgggtgcgtgcaccgtgcgcaagccgaagcagggcaaggcattgcctcactcgggaagcgcaaggggtcagggagttccctttcctagtcaaagaaaggggtgacagatggcacctggaaaatcagttcactcccacccgaatactgcgcttttccgacaggcttaaaaaacgccgcaccaggagattatatcccccacctggctgggagggtcctacgcccacggagtctcgctgattgctagcacagcagtctgagatcaaactgcaaggcggcagcgaggctgggggaggggcgcccaccattgcccaggcttgcttaggtaaacaaagcagcagggaagctcgaactgggtggagcccaccacaactcaaggaggcctgcctgcctctgtaggctccacctctgggggcagggcacagacaaacaaaaagacagcaggaacctctgcagacttcaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcagactgacacctcacagggccgggtactccaacagacctgcagctgagggtcctgtctgttagaaggaaaactaacaaacagaaaggacatccacgccaaaaacccatctgtacatcaccatcatcaaagaccaaaagtagaaaaaaccacaaagatggggaaaaaacagagcagaaaaactggaaactctaaaaagcagagcgcctctcctcctccaaagcaacacagttcctcaccagcaacggaacaaagctggacggagaatgactttgacgagctgagacaagaaggcttcagacgatcaaagtactctgagctacgggaggaaattcaaaccaaaggcaaagaagttgaaaactgtgaaaaaagtttagaagaatgtataactagaataaccaatacagagaagtgcttaaaggagctgatggagctgaaaaccaaggctcgagaactacgtgaagaatgcagaagcctcaggagctgacgcgatcaactggaagaaagggtatcagcgatggaagatgaagtgaatgaaatgaagcaagaagggaagtttagagaaaaaagaataaaaagaaatgagcaaaccctccaagaaatatgggactatgggaaaagaccaaatctacgtctgactggtgtacctgaaagtgatggggagaatggaaccaagttggaaaacactctgcaggatatcatccaggagaacttccccaatgtagcaaggcaggccaacattcaaattcaggaaatacagagaacgccacaaagatactcctcgagaagagcaactccaagacacataattgtcagattcaccaaagttgaaatgaaggaaaaaatgtgaagggcagccagagagaaaggtccggttacccacaaagggaagcccatcagactaacagcggatctctcggcagaaactctacaagccagaagacagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacgaccgataccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgttctgtattcaggaaacccatctcacgtgcagagacacacataggctcaaaataaaaggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagtcaacaaggatacccaggaatggaactcagctctgcaccaagcggacctaacagacatctacagaactctccaccccaaatcaacagaatagacatttttttcagcaccacaccacacctattccaaaactgaccacatacttggaagtaaagcactcctcagcaaatgtaaaagaacagaaattataacaaactatctctcagaccacagtgcaatcaaactagaactcaggattaagaatctcactcaaaaccgctcaactacatggaaactgaacaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgcatccaggagctggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatacaccctcccaagactaaaccaggaagaagttgaatctctgaatagaccaataacaggagctgaaactgtggcaataatcaatagcttaccaaccaaaaagagtccaggaccagatggattcacagccgaattgtaccagaggtacaagaaggaactggtaccaatccctctgaaactattccaatcaatagaaaaagaaggaatcctccctaactcattttatgaggccagcatcatcctgataccaaagcctggcagagacacaaccaaaaaagaaaattttagaccaatacccttggtgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcacaaaaggcctttgacaaaattcaacaactcttcatgctaaaaactctcaataaattaggtattgatgggacgtatctcaaaataataagagctatctatgacaaacacacagccaatatcatactgaatgggcaaaaactggaagcattccctttgaaaacaggcacaagacagggatgccctctctcaccactcctattcaacatagtgttggaagttctggccagggcaattaggcaggagaaggaaataaaggctattcaattaggaaaagaggaagtcaaattgtccctgtttgcagacgacatgattgtatatctagaaaaccccattgtctcagtccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctctccaaggagaactacaaaccactgctcaaggaaataaaagaggatacaaataaatggaagaacattccatgctcatgggtaggaagaatcaatattgtgaaaatggccatactgcccaaggtaatttacagattcaatgccatccccatcaagctaccaatgactttcttcacagaactggaaaaaactactttaaagttcatatggaaccaaaaaagagcctgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagcaatggggaaaggattctctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataagcatgggcaaggacttcatgtctaaaacaccaaaagcaatggcaacaaaagccaaaattgacaaatgggacctcattacactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgactcagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcatgtatacaccatggaatactatgcagccataaaaaatgatgagttcatgtcctttgtagggacatggatgaaattggaaatcatcattctcagtaaactatcgcaagaacaaaaaacgaaacaccacatattctcactcataggtgggaattgaacaatgagaacagctggacacaggaaggggaacatcacactctggggactgttgtatggtggggggaggcgggagggatagcattgggagatatatctaatgctagatgaggagttagtgggtgcagcacaccagcatggcacatgtatacatatgtaactaacctgcacattgtgcacatgtaccctaaaacttaaagtataataataataaattaaaaaacaaacaaaaaacaaaaacaaaaaaacaaaaaaaaacaaaaacaaaacaaacaaacaaaaaaaacttatttttgtcacctaatgtatggcctatccttgagaatgatccatgtgctgaggagaacatatattctgtagctgctggatgaaatgttctatagatatctattaggtacatttgttttatagtgcagattaagtgtgatgtttctttattgaactttctgtctcgatctgtccaatgctgaaagtggggtattgaagtctccagctattattgtactggtgtctattctttagctctaataatatttgctttatatatctgggtgctccagtgttggatgcatgtggcaggacttactcctgccattttgttatttgttttctggttgttttgcagtcttctcttccttgtttccttcctgtcttccttttagtgaaggtaattttctctggtggtatgttttcatttatttttatttttacccccttttgttttgtgtgtatttgttgtatgtttttcaattcaaggttaccatgaggcttgcaaataatatcctataaccaattactttaatgacaagttaacactaattgcataaaagcaagcaaaaagaaaaataaaaactctatactttaactttgttcccccactttttaactttttgttgtttctatttctacctcattgctctgtatatgtcttgaaaagtccttgtggtttttattttttattggttcatcttttagtctttctatttaagaggagtttacacatgacagttacagtgttataagtattgccagtgagttttgtaccttcagatgatgtcttatttcttattaatgtttttttctttctgatggagctattccctttatcatttcttgtaagacaggtctggtgttgatgaaatccctctacttttgtttgggaaagtatttctcccacgtgtttgaagaatatttttgctagatatactatgctaggataaaagcctctttccttcagcactttaagtatatcaggccactctctctggcctgtcaagtttccatgaaataatctgctgtcagacatactagagctctattgtatgttatttctttcttttctctggttgctttcaagatcctttctttatccttgacctttgggagtttgatattacatgtcttgatatattcttctttggattaaatctgctagctgttctataaccttcttgtacttcaatattaatatctttctctagtttggggtaattttctgttattatcactttgagtaaactttctacccctatctctctctacctcctctttaaggccaataactcttagatttgccccattggggctattttctagatcttgtaggtatgcttcattcttttttctttggtgttctgcctgtcttcaagctcacaaattctttcttccacttgatcaattctgctgctgttaagagactctgatgcattccttagctttattgaaatctttcacttggttttgaatccaatagtaaaatctaactttttcattagaacactgtggctgtcataatcaaagctattcctaatttcacagatattagaggtttttctggtaaatatggtctatctttggaaaaaataaaagctgccaactctctaagcaccgagtactcatgtcattacactcttctgattttaatgttaaaatgctttttctctaagtgtctttctaacgccacttaaaccatcctaattggaatctagggcttagtctattaattttttaagtatcagaaataaagaaaacttttttaaaaatcagctttctcatataatactactagcagaatagttttagaaaagctttagcagagaatcaaaagaccagggttttattatcatctcagcaattactaagtagctacataacactgagcaagctatgaaatctgagatttcaatttctaatttttttaatgaatgaattttagcatttaagaaataaatataacttacctaaaactgtcacttttctctttggttttctaaatcttaactttatacaaattttcccaatttttgaagtgatttttctaaatttctacatgcagttcagattctagataatttttggccagacttaaagtatctttaagagttagccagaattaactgtttaaaaaagtacattttactaaggacttttatctttataattaatctatgaaattgtgactccctttttagctttcattacatttcaaaagaggtcagaaatattcccaccatcctccttcctggacacatctcaattcaatgcaatagtaaactatttctgaatgttaaatacaagttacataaaaattctcccaattaagagatatgagtataattccaaggcatttcttgaaagtgaggaaagtttagtggtgataataatttgctataaaagtagatacagccatatcattgataaatttatatttgattaatgagcttttagttctcaaagactaaaaaacttttcttcaataaatacacatatgtgtttactttgtcaccttagtaactctcaccctaaaattttgtacattggtgactttttatagacacataagtaccactagaggccaccaaatacttcatcttattaaatcaacagatttgcaagttattctggctagcttaaaggtactttaaattaagctaagttacaaggagatgaccatacatggtaatatccgtaactggaaactctcaaagaattattcaaagtcaagcaaaaagatgtaaacatatttcgtacagtaattaggatgtatggatgtatagatgtataattcgacaaaaagctttatgagatcaaaatgggggggtaggtaatataaaaattcattccttacgtacctttgaaagtagacctagagagatgacctacaggaatgacctagagagatggtgttctctcaaattgctgttgtcctttataagcaaattatgtatttaaatatacacctctctatatatacataaatataaacatacagatacataaaatcctagagttcagtattctttcttgcatatcacaaagtctttcacataatgattttaatatctcaagttggctaccatttacagcaatcaaaacttcaagaaagaagtcttattgtcaaaatcacctgactttttttttgtctgtttattttaagacagggtcttactctgtcacccaggctggaatgcagtggtgcaatctcggctcactgcaatctctgcctcctgggctcaagcgaccctcccacctcagcctcccaagtatgtggaactacaggcaagcaccaccatgtccagctaatttttctatgtctttttgttgttgttgttgttgttgttattgtttgtttgttgttttttaatttttttttttgagacggagtcttgctctgtcgccaggctggagtgcagtggcgatgtctcgtctcactgcaacctccgtgtcctgggttcaagtgattctcccgcctcagcctcccgagtagctgggactatagcacgcgccaccacgcccagctaatttttgtatttttagtagagacagggtttcaccatgttggccaggatggtcttgatctcttgactttgtgatccgcccgcctcggcctcccaaagtgctgggattacaggcgtgagccactgtgcctggccagtttttctatgctttgtggagacagggtttcaccatgttgcccagggtgatcatcaccccacattttctaatatacccaaaattctggcttgaagaagaaaacctggcatctggcaaaaataacacctgagtaaactttgctctccctttctaggtgaaagcgctgcttaaagcgtcccacatcctctcatttcttccagcgtcctcctcctttccaatggtaaatagtaaaaactagaaggcccaagtagcatccaaagattctgtagatccaagggaaacttctaaaaaaaatggggcttattgctattgtattatccaccttttctgcatggttatatactatttttcaaggtttttcaggaaatccagagaaactttaatcagtcacggttttgacattctctctaaaaaatcttggcttaactaaaggtctcaaaatcctaagttttcttttaaaaactttatagtgttagcttttacatttagactatgatccatttcaagttactttttgtgtatggtttaagggtcaaggctcatttttttcctaaatggatatccagttgttctagcaccatttgggcttatcacttccacaactgaattacattagcaactcggtccaaaaaccaatttatgaagtcaggcacagaatgataactactgtgtgttctcatccatatgtagaagctaaaaacacaaaaaacaaaaatttgagctcatagaagcagagagtagaattgtggttattagaggctgggaaggatgtggggagggaaggaaaggaagagattggttaacagacacagagtcatagctaaatgggaaatataagttctcgtgttctgtagcaccgttaaggtgaatatggttaacaataatttagtgtatattttcaaaaacttagaagattctgaacgttcacaacacagagaaatgataggtatttgaggtgatggatacactaatttgattccaccattatacattgcatacatgtactgaaatatcaccctgtttcccataaacatgtagaattattacatatcaactaaaaataaaaggaaaaaacaaaaaagataacacatgcttttctttcaataaagtggaacatttcagaaaaaagaaataaattcatgatatatatgtgagtttgcttctagactgtaccatggatctacatgtctattccttaagctaataccatactgtcttgattattgagccttatgggatgtcttgaaaccaggtagtataagtcttccaaactttgttctttttttcccagatagtttttggctacttgctataaaatatgccttagagatttattcatttcagtacataaagctttatttcatactgttttaaaaagttaactacagtaaaatatatataacacaaaatttatcatcttaacaatcttaagtggacagttcagatagtgttaagtacattcacactgttgtgcaactaaactccaaaactctttccatcttgcaaaattcacaatctatacccactaaacaacttgccattcctccctttccccagcccctggcaaccaccattctacttcctgcctgtatgaatttgattactctatgtctctcatattagtgaaatcacacagtattttgttttgttttttattgttgttgttgttgcttgagacggagtctcactctgtcgcccaggctggagtgcaatggcgtgatctccgctcactgcaagctctgcctcctgggctcatgccattctctcacctcaacctcccaagtagctgggactacaggcgcccaccaccacgcccggctaattttttgtatttttagtagagacggggtttcaccgtgttagccaggatggtctcgatctcctagtatttgtgtttttttgtgattggcttatttcccttaacatagtgtccccaaggttcatccttcaggttgaaccttgcataacacaacaaatgttggcacatgttgtaacatgtgtcagaattttcttcctttttaaggctgaataatattctgggggggggtgtgtgtgtgcgtgcacacgtgtatcacatctcacttgtctattcatctgtctatggacattcaggttgcttccaccatttgactactgtgaacaatgctactataaacatgtgtatgaatatctgtttgaatcccagctttcagttcttttaggatatacccagaagtgaaattgttaggtcatatggtaattttattttcaattttttttgaagactctccataccattttccatagtggctgcaccattttacgttcccaccaacagtgcacaagagttccagtttctccctaatcttgctaacatttgttattttctgggatttttgttttgttttggggctttttttagagttggaatctcatctatcacccaagctggagttgcagtggtgcaaatcatagctcactgctgcctccaactactaggctcaggtgacccttccatctcagcctccccagttgctgggactgcaaatgtgagccactgtgcttggcttttttttttttttttaatagcaataataatgggcatgcaatagtatcttatggtggctttaatatgcatttccttaataattggtgatgttagcatcttttcgtgtgcttgtagatctccttatctcgtactttttaacagctgtactatgttctgatgagtggctgtggtaccgctaattcaacgagtccccatactaatggtcatttagatagtttccaaccttttgcatacaggtaattcatacatacacatatatataagtaaccatacaaatcagttggttctagatagctccagtttatgcatatttttgattcaatccttttcactctcaaaaacattctggtttgaataagacacagttaccctagtttcagattaaggataagataaattgctgaaactgaaattaggcatgaacgagctgtgatttaatcttccaggctatttgttacccagaacttacctcatattagaaatttagtattagaaaaagatatttatatttaccacttgattataaaggatacaactaagaaacagacaagtgggagagatatacagagtgaggtatggcagggaccatgccctctctcaggtgtaccactttcacaagacattagtgtgttcattgggcaagcacagcggctcatgcctgtaatctcagtgctttgggagggcgaggtgaggagattacttgaggccaggagtttgagaccagcctgggaaagacagactctgtctctaagaaaaataagaaaatagctgggcatggtggcacacacctgtagtcctagctattctggacactgaggcaggagatcgcttgagtccaggagttcgtggttacaatgaactaagatcacaccactgcactccagcctggatgacagagtatgtaagatcctgtgtctctttaaaacaatcaaaaaaaatgtgttcatcaacccaaaagctctctgagccctgttatctaggggttttaatggaggtttcactaagtaggcataactggttaaatcattgccattggtgactaaactcaatctccagcccttctctctccccactgggggtgaaagttccaacccactaaatgcataattgcttcctctggtgaccagcccctatcctgaaactatttagggcctctcaacccaagagccatctcactggcatataaaacacagtaaatcacaaaggtttcaggagctctgtgccagaaactgggggcaaagaccaaacatttattttttcattataccacaaagaccaaattaatgaggtcaaaaaataaaatggtcaaggaaaattaagataagggaaacaatctttggattcagcatgaacagtgtggcagaggaaagctatttgttcagtaaatctgtttccttcttctcctaagcacacatctagggtttatttaccaatctcctattacagctaactggctttgtgattgacttctgattaatagaatatggataatatatactgcctccagacatatcccataaaactaacttttactatcctccatgctttctcttactactctgacgaccaactactgctgcctaagaagaccctgaggactgtaaccaagtacccccatttttctgtaggtgatttaattattctctttttcctctctctcctctctctctctctctcctttttctctcctctctctctctctctccctgcgtcccctctccacctgcctcagaacttacacctacttggagggcttgctgaaagcatgtccacttggcaccttttacaacttttcccaggaaggtgccaacccaactgcctagtagataactgcctggtagcagggggacccctgccttcgctcatctcctcccctgccttataaaaatgcctgctttctgctccaaaggtgaagtgggacatttaaaagaagaatgctttgtgcctcttccccccaatgagctttggaataaactcactttttttttttttaatcagacatcactcttgttaattgaactctacatttagtgggcatctaacttgctttttcgttacaagaccacattttgaaaatggcaaaccccactcccatctaccctactgccactaattagccattatgtaaataaggggaaaaaaaaccttctattatgttaagttactaagatttccaggtatatctattacaaaagctagcattaccttaaccaattcagaaaaaattaacttcaactttgtgatttcagaacagacaggacataaactatacttcagaataaatccctgcaatgtgcgtgagatagaggtatgaaatgagagtaaataacaacaaattgtaacattacaaatattaaaatattaacagatgatcatctaataacatccctgtaggaaaattattattatcagagagagtaaattaacttcgctcaaggcttttaaatttcaaatcccgtattctttctactgaaccacattagtctcttagagaaattgggacagcaaatgaagactcactgaaaacattttataataaagaagaaataggatagtagctaaaacataaagtcaagaaatttttttttgctaaaattatagatacaatggaaatgggatgaatagaaatagaatagtagcaaaaaggaactggaacttaagaagtacaggataagccataagggtgatatgacagacaagcacatgagagatgagtagcagtatgataccatgtaacgaagtccaggctgtccgcaaacaatacacagatgtagtgggtcaggcctgtgtagctctacatcttcctcaggaagttctctttggtcttaaagcatcaggtagagcagaaccctagcatgacaagaaaactttgtctaaagtggttctgagagcagaagtgaagtacgtgactgtaggggaaagattttctagcataactgagggtatcgatgcactgacaaaataagcagaattgagagacactagttctagtacaggataaacaaaccattgtagtgagtatggaggagtgtattagaatcataacaccaagattaattaatctcttcctcagagatgataaaataatctactacctcacatgcactttccagacttcatgaggttccctgccctgtggttttattacttcaaagagacaacagtctgggagtgggtaccaaaaatatgagctcaaaccaccattttctagcttaaactccatttatatccacttgctttgttgtgaacataacttttaaaatcctttttatagttcttagtatgttttaaaagccaggtcttcatacttcgtagcagttttcttaagttttcagcctcaactctatgccaaatcaagagtccttccacacacggtttataccaagctttggaccatctttaaaactgtgtattttacctcgcaccttacctcaggacagaggctttagattccatctacagtatctaccatacataccttttataaactttttaaaatctgtcttcttctatttctcaaacctctctagctggatagtatctgcctatctttattctaaataattacttataaatctagctttatatactcacatgcaagaacttaaatttttacttattatatttcattttcttaaacatcccataactcctgccttttaaaatgtttgtgaaccctgattctgtcatctcattctcctttcaagcatattcttctacaaaaaggaagagaaaagtctcttctaaccaaacagtatttacatctatgtcagatggatgattgctacccatttattgtatgtattgcattctaaacagcttaaagaattaaagcattacatggtacttatatttacctctctgtcctcaaataacatcccatattaaagctacttttcctatgttacacctgcacaatgtggaatacaagctctttttcctctcttctcctcaatctacatttacagaagactgaattcatagggcaggtagtcaaattgctagtgtataatttaaataacagaaccaatttcgtaagaacattaaagttagaaattctaactgaatgcttctctttttcaagccacaaaatttatttactacagtactttagtcttctaaaaaaatcaggtacatctaacaaaaaccttagtacaggcatgccctactgagattgtggcatattttctgaataatgatataaaaaaattcactcctaaaacagggcatcttaaaaaggagctaaggtcggctgggtgtggtggctcacatctgtaatcgcagcactttgggaggccaaggcagggggatcacctgaggtcaggagttcgagaccagcctgaccaacatggtgaaaccctgtctctactaaaaatacaaaattagccaggtgtggtggcacatgcctgtaatcccagctacttgggaggctgaggcaggaggactgcttgaatctgggaggcagaggctgcagtgagccaagattgcgccactgcactccagcctgggcaacaagagtgaaactccgtctaaaaaaaaaaaaaaacaggagctaaggtcaaaacaatacaattttgctttaattctttaagctgtttagatgtctctgatctagccaataaaaatattgttcatataatcaggaatagattgttaaccatagaatgcctctgaaaaacaattttctttgaaatgctgtcactaaaattaactgcaactttatttatatgactgtctgtggttttcgtgtatgcctaaaaagcacaagagaaagataaaaatatcccagaattggaaaagtagtcattatgtttggtttagcttactttcatatttttatttttaaaatccatccgaattaaagtttaccatttttcaatagaaaaatagaaggcaatttctttatgtaaaaatggaaaaagaaattcagcatcctctaaattaaatttggaatttgattagtgaatgaatgcctaaaatccttttccaccagttgtaaggctgaacacatatctatttttcatttagaacttacatacatcaattatgtgttccctgggaaggagaagtggcaacagaaaataatttgaatataatattatattgtgagcccatgtgtgttctcagataaaataaataataaagttggtccctattcaataacacagccttctcttaacatttctcaaccttagttcttccaaatcacagaattctacatttacactaaaagactaaccatttacactaaaatgctaaccacagctaaaagtgtcactcctagaaatctctcagatcttggctgacactaagagtcaaaagatcagggtttgaatcctagctctgctgtatccttgctgttagatctcagtaaagttatttaaatttcctaagcctctgtttacttatttgtgaattaatatactaccaccattatgtacgtgagttcatcacaatctattaatcctatacaactgctacatattaacatgaatgttacatgctaatgttgttccaccattatggaaggggtaagaatttttcccataaatcatcagaaaagggtcacgactacactggaaacaacaaaccacttaaggattaagccagatcaccttcaattagactaaaattttattatatctatctttggtcttgaagccgcagggttactcaagatcacataaggcatcacaattattcaagctattgttgttcatatacagaatattcacactctctaaagatatgcaaaaataaggcaataaagactggacaataaaaaattaatagtgatttattctgtttttaaaatggactttgatagatgtaagataaatttattttgtacttgacaacaccatagacattaaagaattgaaattgcgatccattatggaaaaaggaaaaggaaaaagaaaatttctgacgtaatccaacagattactctttaaatattaatctagcccaacaaatcttgaaatgctatgctaagaatatgccaagaagtcatctaggaaaatcttagggaggaaaagttctgtctaactcttagcacctccatttcactattctaacagcacatgactccacttattggagaaacatttatagcacttgaacatggcagtgtctgtcatacaaagagaaaatatctatttactaagtagtaaaatcagtatgtttctctcccttgctactggagaaataagagaggtatcataggtatctattctcttggttttcaaaacaacactatcctttctctgtcctagctaaatagctatgccaatccatgatttcccttctccctctatgatgtctgttggttcctgaaacttatgaaggtgagtcactgctcatactgttaaattggtatagtttatatctctccacactttgatgtgaatggaggtaggaacccacaataagttctaacaggtccctagcaccaaaaatttcccctcaatcacactaaaagggacattgaaacagggtttaaaagcttttatagaacaaatgcctgcttattcacactgtaaggccaattactggtatttgcaggcatatggggaaaaagagaaaggaatgcaaagggctttccaaaaagccattttccttggatcctcacattccttccccatttttaatgccaaaattcaagatttaccccctctgtaggcctacagaaccctcagctttctttacatggctgagttataacaatcaaaactaagcacctagcaatgtatctttaattttcagtgaagcaaaactggacagttattagctacgacgagaaaatttacaattttcaatacaaaatatctaacagatatttctgatccatgccaacaagagaatgaacaattgttcctgtgggtaaggtgctgagatatgttgaacaaacagcaacaatactaattaaacaatgggacaactcatttatggaagacattgttctaatcattttatgtgtattttttccactttatctttacaacaacctatgagattaatataatcattatcctcattttatagataagtattctgctggctcaaagtagttgagcaacttgtcaaaagtcataccacgcagctgagattttaacctaggcactctgctccagagcctgcactcttaagtatcatgttataccaaatgtcctctcaacaggactgctttgaagacactgcttctatgtgtttatgtgtgtgcatatccataaacacaatataaataagtacacacacacacccccagtaaatctggagaaccaaacttcgtagacatattacaaagtactttagtaatcacctttctagtccctcagtttaccaccatggatccaccaccagatagaatatcttgggtagcataaattatgttcaaccaataaattcctttaaaacgggtaacaacaacaacaaaaggagttgaactgcactattataaaataaccttcagaccttgtagctaaaaacaaaagaaatctaatttgtgattttaagatcaaattcaagccatgactggtcaacattaaatgaacttttggttttttatttatctgtgttttttgttttgtttttactaagacaataacctggacattttcaggaaaaaaaaaatatatatatgtgtatccctgaagttactaggctaagacttttactaaagaagcagtggaatttttctgcttttgagtatatgaaaatcatcaatttcatctttttttttttttttttttttgagagggagtcttgctctgtcgcccaggctagagcgcagtggcacgatcttggctcactgcaagctccgcctcccgggttcatgccattctcctgcctcagcctcctgagtagctgggactacagacgcccgccaccacgcccggctaatttttgtatttttagtagagacagcgtttcaccgtgttaccaggatggtatcaatctccttacctcgtaatccgcccgccttggcctcccaaagtgctgggattacaggcatgagccaccgcgcctggccctcaatttcagctttaatattagaaatttaaatgagaaaaagaagagcaaaataggcattctagaattaatatattcaaagatgaccgtacttgagggactaggagggaagataactatttctagtactgtaatatcttacaattaaattatcaaattatttaacagcaaatgtaacataaatgtaaaaatcaatgtgacaaaaaagaaaagtaacattataaatatgcaataatacaacaaccacttaccaactcaattccctgtggaaaaggtgtatcatcccagtccttctgtggaaatctctggattattttccccagaccttctcctgatcctgttaataaaatcaaagtgaatcattattataggacactaaaaactacaaatactcattctactcttacttatttctaaatgaatatttggtaaataagttaataaactgattaaacattttcaagttttaaaaaacatgtgagtatgcatcatctaaacattatgcagtaggacctccatatccatgggttttgcatctgcaggagacacccaaccatgaattgaaaatatttgggatgaaaaaaacaataaaattaacaatgcaacaatttaaaaatgcaaatcttaaaaatacagtataacaaatatttccataccattttcattgtattaggtattataagtaattaagaaattatttagagtatataggaaaatatgcataggttatatgcaaatactacaccattttatataaggaacttgagcatccatggattttagtatccgtgagggttctggaacaaatcccctgcaaatacccagggatgactatacagaaataacaggcaatctctattctataaacacttttttttgaggcagagtcttgctctgttgtctaggctggagtgcagttgtatgatcttggttcactgaaacctccgcttcccgagttcaagcgattctcctggctcagcctcccgagtagctgggattacaggcacccaccaccatgcccaggtaatttttgtacttttagtagagatggggtttcactatgttggccagactggtcttgaactcctgacctcaagtggtccacctgccctggcctcccaaagtgctgggattacaggtgtgagccactgcacctggccattattctgtaagactgactgatacgtatgaaaagctaaaaaacactagccagaggcattgaaatctagtctctaccacgttatgggagtaactgccctttgtgccccaataaggaaattaatcccaaattgaaatttaagaagaacttttctatggagatgaaataatttcaagtaacaaatgaaatggcactgctagcactaagtttcagttatgggctataaatactgttactggttaaagtttctgaggctggcctgggaacttgaccattgtttaggcagggtttcccaacatcagcactactgacatttgcagatggatacttctttgggggaatggggattgtcctgtgcattgtaggatgtttagcagtattcctagtctcaattcctagattccagtagcaccctctaccaccagcaagatgttacaatgaaaaatgtccccagatgttgacaaacgttccctgggttgaagaccacagatctctatcactgttgttataaaattatcctgtgacaccgaagaaggaatcaacttcccattgaactttggggatgtaatttgtgagtaaactggggatggaaggtacatgttaaatctaaactaattcttgctatagttttttaagatcttcatgttccttgcatattctacatgttgtcctagttcatatgaaatgaaggcaacaatattctgattatttgttttgtatacctaacttgaggaagtcttcacaacgaattcattttgttaatatactgtaaaaatcatccactatgatttctcaacctcatctctatgaatgcaacttctcccttgcccctcacctaaactgcaatcaatttacggccaaatttttatgtttaaaatataaatggaaagtgacattcactttactgaccaactcagaactgtattctgaaacgaggtcaaaccaaaatccatttgaaaaagacaaaataaaaatattctcaattaaaatgaataattgctgcagtacagtaacttatctatctcttgttataggggaatgaaggattttgttaagagtaaaccaactttttatcataggcactcattcttcaaaatccacctcaagcatcatcacttacgacatcccaagcagggttaatgaaacaaattgctaggtgttggaggtacacaaatgaaaaagacatagtccctatcctaaaggaactcataatcaattcggggaaacaaacaaatgaactgataatttcagttatgttatcgtaagctcaatgatagaaagaccatacaaaactttctggaagaaatgacagcaagcttacttcctttcagtaaccaacttgtttccccaagcacctggcatactgaattcctggcatatagtctatactgagtaaaatgtttactttaataaattcattggtactgactgaaattgttttaagtttattcctcccttctttttaaagagataaattaatgtacttattctatcatgtttaatcacatccctacattgttttttcagttctgaaagccatactaatgtattttacgttcaagaaatatttatcatattaattattttttggacagggtctcactctgttgcccagactggagttcagtggcacaatcatcgctcaccgcagccttgacctcccagactcaagcgatcctcctacctcagcctccaagtagctgggactgcaggtgcagaccaccacaaccagctaattttcatattttttgtagagaccgggtttcgccacattgcccaagttggtcttgaacttctggactcaagcaatccacccgcctcagcctcccaaagtgctaggattatagcgtaagccaccgtacccagcccaatcatattatcttttactaattataaaagtaatgttaagtgcagaaaggattttaaatacataaaaatataaagaagaaagcacccataatcccacacctggagacaattattattaacattttggactatccatttattcctaggtttcttgcataaatatatatatatatatatatatatatatattttttttttcctacaaaatgaataccacactgaacctaactttatacactggcttattacttaatattttacaaagggccttaaatgttgttgaacatacattttctagtttctcactattataaataatactacaataaacgtctttatttacaaatctttaacctcatctcacttctcctgaaaaaatactcttttccagattctacctctagtaaactgtggcagcactgtagcatctgtcagcaaatgtctgaggcattctgacaacatttcttccttttactgaagctagaattggtgtgtatcccttataagaaaagaacctaaatgggaccacactactctaagaggcactttgatagatagattgagttctttcaaactggtagaggatctggaaacaattacagtcatacttgggagatactgcaggtttggttccagcccacagcaataaagtgaatattgcaataatgtgagtcacacaaattttttggtttctcagtgcatgtaaaagttatgtttacactatactgtagtctattaagtgtgcaacagcgttacgcctaaaagatgtacatgctttaatttaaaaatgctttattgctaaaaaatgctatcaatcatctgaggctttagcaagttgtaatctttttgctggtagaatgtcttgcttcgatgctgatggctgctaactgatcagggtggtggctgcggcaattattgaaaacgagacaacagtgaagtttgccatatcgattgacactttctttcacaaaaaatttatccatagcatgcaatgctgtttgatgttattttacccacagcacaacttctctcaaaaattgaaatcattcctctcaaaccctgctgctgctttatcaactaaattgatgtaatatcctaaatcctttgtcatttcaatgaaattcacagcatcttctccagaagtagattccatttcaagaaaccattttctttgtttatccataagaagcaaagcttcatctgttaaaggttttatcgtgagattgtagcaattcagtcacatcttcaggctccacttctaacactagttattttgctatttccaccacatctacagttcctttccccactaaagtcttgaacccctcaaggtcatccataagggttggaatcaacttcttctaagctcccggttaataggttcatatttttacctcctcccatgaattatgaagttataatggcatctagaatggtgaatcatttccacaaggctttcaatttactttgcccagattcaatcagaggaatcactacctatggcagctacaggcttatggaatgtatttcttaaatagtaaaacttgaaagtcaaaatgactcttgatccatgggctgcagaatagatgttgtgttagcaggcatgaaaacaacattaatctccttatacatgtccatcagagctcttatgttaccaggtgcactgtcaatgagcagtaatattttgagaggaatatttttatgagcagtagttctcaacagtgggcttaaaatattcagtaaaccatgctataaatagatgtgctgtcatccaggcattgttgtcccatttacagagcacagacagagtagatttagcataattcttaaaggcactggaattttcagaatggtaaatgagaaacagctttaatttgaaatcaccagcaacattagctgctaaaaagacagtaagcctgttctttgaagccaagcatttacttctgctctccagctatgaaaatcctagatggcatcttcttccaatacagcctgtttcgtctacactgttactgtagtgtggctgccctcatcatcttagctagatcttctgcataacttgcagcagcttctacataagcacttgctgcttcaccttgcactttcatgttatagagacagcttcttttcttaaacctcatgaaccaacctccagcttcaaacttcttttgcaactttctcagcctacacagatttgaagagagttagggccttgtgctgaggattaggctttgtcttaagaaaatgttgtggctaatttcatctatccaaaccactcagactccatatcagtaataatgctgtctcattttcttattatctgcattcacaacttggctgtttggtacaagaggcccagcttttgacttatcttggcctttgacatgtcttccttactaaacataatcatttctagattttgatttgaagtgagagacatgcaattcttcctttcacttgaccacttaaaggccattgtaaagtcatcaactaacccaatttcaatactggcgtgcctcaaggaatagagaggcctgaggagagggagagagatgatggaatggctggtcagtggtgcagtcagaatacataaatcatttatggattaaatttgccacctttcatgggtgtagtctgtggcatgccaaaacaaaacagtaatatcaaagatcactgatcacatatcaccaaaatacatataatggaaaagcttgaaaacttgtgagattaccaaaatgcgacacagagacacaaaatgagcccaagctgttggcaaaatggagctgacagacttgttcaacattgggttgccacaaatcttcaatttgttaaaacaaacaaacaaacccacccataatatctgtaaggcacaataaacaaataataaataataagcaaagaacaataaaccaaagtatgtctgtctataaaaaggagatttagtcagaaaatttgaagcaaaaagtaaagccaggtgcactggctcacacctgtaatcccagggatttaggaggcccaggagtgaggaggccagaagtttgagaccagcctgggcaacatatggagaccccatctctacaaaaattagctgggaatggtggtacaaacctgtagtcccagctactcaagactcaactggaacccttgtgcatgttgatggcaatgtcaaatggtgtacctactatggaaaatatggaatatggaggtatggagtatgaaggcttctcaaaaaattaaaaatagaactatcatatgttccaacaatcccacttctgggtatatttccaaaggaattaaaagcaggatgttggtcaggcataggggcatgctattgtaatcccagcaatttgggaggctaaggcaggaagactgcttgagctgaaaaattaacatttatctgcgttttgattgtgacctatcatgggaggttttatatacatatgaaacagggttaagaatatggactcaggatccaggttacctatactctagtccagttccaccattccatcctgggaaaattacattacttctctgtgcttcattttcccccatataaaaaatgaagatactattacctaactcttagagctcttgtgaggaagaatttaagttaatgtgcatgtaaaatatataccagtatgagtaggtgcatgtttctcagaacagcactccaacctgaacataatagttgagattactgagccggtctgaataacatagtgtagagaagaaaactattattgttctagacaattatgttattaacaatgaagaatggtgttatttaaggtctcttggtggccacaagactcttgatttactggagttacttttgaatgaaacatgtaaatccctttttaaaacatgtttaatgctgttctgtacctgtacaaaagatttttcagactcaagttttatccctgttaaatttctttagtcagctcagtacatgcattttttggatcctatgtcagttacccagtgtatttatatccattttttatttaattaacttactttttttagttacagatatatactacaaaatgcaaccattttaaattaacagtctgatatatattgacaaactctcaataaaaacaattgcagtagaataaaaacaaaaatggagaacatggaaattaattatgttatattaaaatattgcttaaggagttcctccagaaaatatttcccgaaaaaaaattcatcaatattggcataagtccaattataatttcccgataataatcaaaatttcctgaggataaaagtcttggtcaaaacatgctatatacacattactgacactggcaccagtgcttctattccattctctcccaaaacaatctgcttggaacttcagcattgtacctagcacctgttcttctctcttcttcattaagaatatcatctcagaagaaatggctaaagcaaacgcacagcactagaaaatcagacttttgggtacatgtattgatttactcattttaatagaatagaagctgatctaaagatatctgtccaaagacagaactaagatgaaggccatattcaacttgcaagttccaagtatcccatttgtgatttggaaaatctgcttttgagcaaatgatttttttaaaatgttattttcatgttctctagaagacctgtgttataatgccaagacagccagaaaatcaaagttcaccagaataagtagatctaattgtgccagtatagaccaactttcaaaagataaggaaaataaaagctgctcattcactgaaaagaaagcatgcaggaaatcattctacaaaaggctttcatatttgatccatttagcatttaatgagagaagtctgtttgtttcaactgacataagccttttttgtggttatttaaaaatttaggtaggaatgtaatgtgattttctgattttccagtacaatctcctattattcaaaaggtttatttggaacatacaagctatttttcccagagttaaacttaggaaagagtccataggcttttacagaagtgaaaaagaatgcatttttactgactcacgcctgtaatcccagcactttgggaggccaaggcgggcagatcacttgaggtcaggagttcgagaccagcctggccaacatggtgaaaccccatctctactaaaaatacaatcactgggtgacagaacgagacttcatctcaaataaaaaaatgcatttttaagttgaagagaatacataacgaacaaggtatgtcattaaaaataataaataaacagcagctacacagctttaatccttataaactcacagttcactgagaatgtataaatccagcaatttagagaatgtcaagattaagaaaaactgagaaatgaatacaaactgaaattaaaactaaacatatgatctagcactttcatgaaattcttcagaatgcatcattttactgaattaaaatgtcttctttaacagcaatgaagaaagaatgattggcagtctggaatgctgtgaaaactatatggttgtacatcaacatttaagaaaagaaagtcttatcaagtcccttctccaaatatgcattgaatgtgttcccacccccagcatcattcacaatcactctagtagttcaaactctcatcatcttcatctgggtaacagcagcagcctcatcatctccctgcttcctgtttcacttcactccgagtcatgttcaagtttccggcagtctagaaataagctctgcaaaatcaaagttcttcacactaatttctctgatcaaaataattcagtaattctcccactagctatataataaaatagtccaaaactggccgagcgagggggctcaggcctgtaatcccagcactttgggaggccgaggcgggtggatcacgaggtcaggagatcgagaccatcctagctaacacggtgaaatcccgtctctactaaaaataacaaaaaaaattagctgggcgtggtggcgggtgcctgcagtcccagctactccggagtctgaggcaggagaatggcgtgaacccgggaggcggagcttgcagtgagctgagattgcgccactgcactccagcctgggtgacagagcgagactccgtctcaaaaaaacaaaaggtccaaaaatcattaccttagggacttctacctcatccaaggtgaagtaacaaggtctgaatttaccctccaacctacaacaactaaaaaaacaaaatctacaaaacaatggttttcagacacctgacatcaggcaatagaggacagtgaacccagagagaaagaaaacaaattatgtgagccctataattgccccagcttacttcttggtaagagtttccatgcaggatctagatgtttagctggggtgggggggtgagaggggggtgcagtttctagactgcagttcaatcaaggaaaatccagaagtcctggtaaaactgaagcaattgaggtgggaatctagggaacccaaagaggttagggttcacagagtatcaaagagaagagagattaacagggagaaagaagttcagagacctgcagaaggctgaatgaagcacacgaaaggaacagaaaggacaatccctagaaatcacacaaggccagggactgtttttgttcccaacagccaagaggaaaaaacgaaaaaacttgcataattcactaggcatcaggcagagaacccagagggtattattgcctcagtgtgaaaaattaaccctagataaaatgttgctgtagatctacctaacaaagctgggaaacgagcctcaaaaagatcaaactatttccaagtgacttaattacatctcagaacgaagttcaagaatatttacaggaacacagaaatatccagcaatcaagagagtaaaattcacaactctaacatgcaaacaaaaatcactaggcatgaaaagaagcagaaaagtatgggccacaaggaggacaaaaatcaatcaactgaaatagactccaaaatgatgtaggtattaattagtagataaagatattctaaattatcattatgttgcatattttcagtaatataaatgtaaaaaatatattggatatagctaatgaattagacactacaaggaaaaaaaggttaatggttgttatatgatagaaacttccaaaatgaaacagagaaacagactgggaaaaagacaaaaaaacaaaaacagagctgtgcaacaacttctagtggcctaatatgcatgtaacaggagtcaggagtcccagcatggaatggagggaatggagatatatctgaagtaataatggccaaatttaatgaaatttgacttttccaaatttgatgaaaactataaacacactgatcatagaagctcatcaaatcccaaacacgaagaacacacagaactcacaaaggcatatcataataaattacttagatataaagataaatatctaaaaacagctggagaaaaaagatacattgtgcagagtaacaaatataagaatgacagcagacttctcattataaacagtacaagctagaagacagtggagctacatctttaaaatactgaaagcaaaaaaaaaaaaaaaaatcaaccaaacgttttatacccagagaaaatatccttcaaaaaaaaagctgagtatatctatataatcgaatattatttgaacttaaaaaggaatgaaagctgggtgtggtgactcacgcctgtaatattacccagcactttgggaggccaaggcaggcagatcacgaggtcaagagatcgagaccatcctggccaacatggtgaaacctcgtctctactaaaaacacaaaaactagctgggtgtggtggcaggctcctgtagtcccagctactcaggaggctgaggcaggagaatggcgtggaggcaggagaatggcgtgaacccaggaggcggaggttgcagtgagccaagatcatgccactacactccagcctgggtgacagagcaacactccatctcaaaaaaaaaaaaaggaatggagtactgatacatgctacgtatcatggataatccttgaaaaccatatgctaattgaaagaaaccaaacgcaaaaggctacatattgtatgagtccatttatatgaaatgcccagaaaagtcaaattcaaagagacaggaagtaaattcatggttgacaagggcttaagggggtaaagggagtgattgctaacggatatagggtttctttggggtgatgaaacattttaagtaaatagtggtgatgtcgcatgttcccacttgtatgtggaagctgaacaatgacaacacatggacatagggaggggaacaatacacaccgcggcctgttggggggaggtgggaggggggaggcagagtatcagggtaaaatagctaatgcttgtggggtttaatatgtaggtgacgggatgataggtgcagcaaaccaccacggcacatgtttacctatttaacaaacctacacgtcctgcacatgtatcccagaacttaaaataaaattgagtttaaaataaataaacaaataaataaatagtggtaatggtcgcacaactctttgaatatactaaaaccactgcattttacattttaaaaggatgaactttacggtatgtaaattatatgtcaataaaggattttctttaatgaatctctgatcagacacaatggtatagactcattttttcttgctcttccccactaagtataagcctataaataacacaggaggcaaccaaaggagaactctgaaaggtggtaagaggaaagtaaactgttttgtaaccctcggaatggaggaacaacacaatggcaggacatcttacctatctctaccaaacagaagaaggcaacccaggcctagcatgtcccaatccccaggttaacaacagaaggcagccaaggtaggctcactcatctcccagatcaaacagaagttccactaacaacacagggaaagcccagaaccatgagcaggggatagacagccacagtgataataagcagccagggaaagcactttccttcactcctggccctgactccctttccccaaaggcagataccatgtgagtaggcatcaccagcaagagagaccccatcacaataagcaggatggcctgggaagcctttgtcatcacaggcctaaggctctcctacacaaccaagagaaactgaggtgtccagctagcaccagcaagaggtatctcgctgtatcaagtaacctcggcagacattttgtttctatgggcttaagaattccctccccaatccagaaacactggggtagtcagaggacaccagtaagagagactccactgtaacaagcagtctggcccaggtagtctctttgtcctcatgagtcagaatctctcatgtactccccagtgacatcagggcagtgaaatagcaccaataatgaacatcgtgccacacaaagtagcctggtccagcaaaacctctttgtccctgtagcctgagagtcccctcccccaccaagagacatcaaacagctcagcctggggaatgatttctgccacctcaggcagcaccagtgggagctctagtgctgcctgaggtgacagaagggctatatttaatggccccagcattaaataaacaaagaaaaccaaataaccaagaaaatcaaaataacactgaaaaggctctgaaaattaaactgccactggaacaacagcctacaaaattagactatggtctacatgctaactctaaacacaaaaactaacataacagccaaaatgtccaggatatagtaaaaaagcacccattacaccaagaaccagaaaagatcacaacttgaatgacaaaaagacaattaactgatgccaacacagacatgaatcagatggaagaattatctgcaaagattttaaagcagctaccttaaaaatacatcaaatcataaactctcttgaaacaaatgaaaaatagaaatatcagcacagaaatacgttataaatcaaacagaaattataaaactaaaaaataaaatatccaaaattaaaatctcactggatggtttcaatagtagagtgaaaatggcatagcatagaatcagtgaacttgaggtgaaatcagtagaatttacccagtctgaacaacggagagaaaacaaattaaaatataaagaacattgggaacccatgggaggtccacagaccataacaaaagatccactattcatatcactggagtcccagaaaagaggagaggaagaggggaactaaaagaatattcaaagaaataatggctaaaacactcccaaatttggtgaagcaccaaacatattcaagaagttgcgtgactctcatactggataaactcaaaagaaatctacactaagatacatcataattaaacatctgaaaattaaaaacaaagaagtcttgaaagaagccagagagaaacattttacctacaggataacaccaattcaaatgacagcaaatttctcatcagaaaccatgaaggacagaagaaagcagcacaacatttttcaagtgctgaaagaaagaactatcaactatgaattctatttcccacgaaactacccttaaggaatgagaggaaaatccagacattcttggaccaaaaaaaacaaagcaaaaaaaactacactaacattgaagattggctgaaggaaggtgtttaaacagaaaggaaattacaaaagaagcaataccggagcatcagtggcaaaacaaaaatacaaatccaagtcatcctcaatctagtacttaaatacttctccagtccaatagctggtgttctgatatcagctggctctaaacctcttcccagggcaatattcttcatgcttattccaacaacctttaagattgcttaaaacttctctgtccttgaagcttactgcttgcctgatttgcaacctttagttgccagggtagggtgaggagggaccagaaggcactgtcagaattgattcttttttcaacacaaaacttaatctgagtatgaccctaacagataagtttagtcctagggccctctctcctaatacttccttttctatgggaaaaaaaaactagatcatacaagggcaagcccaaaggcacaataattaatattttttctcactgtaacaaatggaaaacaagctcaaccctctctcacaagcacttatttaactacttaaagaaaactactatgtcttatcaaaggtaaatatgatatccatttcccttaacttctgagtacaagggcctattaaaacaccagtacattaaagctatcaacagtaattatgaatacacagaaatcatctaaaatataaataccttcccatggttgataaactaatctaagaaagtcctcaagaaaaacactgccatgttttgaaaagaatactacattggtaatcaggagatctgaggcttatcttagctctgtcactaactggtgaccttaagcaaatcctctaacttctctaagccttggtctcccacctgtaaagtgatcttaggtccctcctggctctaaacttcaggcacggtaaaccaacaaaaaatgtgaaatacatacatctaccactagatggcataacactatgattgctgatctgaaaagcagaccaaaatctcctccagatagattatgttgttaggaaaactataccagtttaaattataccaatttaaactaagcctcaataacttgtctgctggcaaagaactcccggctacttcataaacaccttcattttgtatgatgtagaatgagaaacctctttctgaacttgttacagttatcatgaaccaaactgaaaatttacaaagacatgattacagaattctgagaaactaagtttacagcaaaggagggggtgaaggaggcggtgaagacgtgtggcaggaaagaacacaggtggagggacagaatggagaaaaaaaaagaagctgttttttggcaatttctgcagtattatctatgcctatcaaggtattacgaaaattattaccactataccacagaatatttagcctcccttgataattcagcagagaaaacactgccacattaaaatttcagacaaatttcttggaaccagctttaaaaacattaatatattggtagtatctataaaacattgatcctttcagaaaaaaaatacaactgaaaatttaaaacacaattctctatgacttaactgtaccactttcactatgtttaagttatatttacgttttcttccaattgcagataagactagtacatagcaagtgcttagtttcagcatagattttttaaatacaacatttttaaactagggaggaaagttattgattaaaaaacagcaaaggctattatgttaatcttccttaaacaagaaattcgtatctgttgcataatgcaactggacatgatacacataaatttctcattaaaactcattcaatgtgtccctatcaatgtattccctaaccctaagtcaataaaggagaagttacaaaaatccttagttctccagcaacctgtgccttcaaaatcaagtaggcctttctcattacacaaatacaggtgacaaatttcttcttcccaaatacagtttaaacatgtcccctgcctacaatgctctcctctccacaaatttgtttttttttttttcccatctctaacttcctatctgcaactcaaagttcaccctggagcatcgcatctacagcacagataatccaagccgtgtgttttctgctcaactcttctctcaaacgcaaacttcctatcctgcaaaaagcattacagattgtttatctgtccaaacaagttatgaggctggttataatatactttactaccagctgttttccttaacgtttcactctcctgaagacaatcatttccttcttgtaacagatagagtatttctcaagctcccaatgctgtttgtaccccctattaagcatttccataaacacagcaaattaatcatgaccaaattgggattttctattatttctataaaatctgtatcttctctccctccattctctatctcagagaatggcacgttatccatctaagcattcagtgtctccactaggattatgttccactgcatatgacagaaaacctaaaacattaatagcttaaacaagataaaagtatatttcctttcatataaaagatgtctcgaagacaacactcaggatcaatgtcagatctatgggctcaaagatccagcttcttcaggttcatcactccactatctacaggtttagacccttgttctcatggtttaatatgtctgctagagctgcaaacatcacatccatgtttcaagtagaaatcaagaaggaaggaaggaagctgggcacagtggctcatgcctgtaatcccaagcactttgggaggctgaggcaggaggatcacttgagcccaggagttccagttcagcccgggcaacatggcaaaactccatctctacaaaaagaacacaaaaattagctgagtgtggtgttgcacacctgtggtcccagctacacaggaggctgaggtggcagaattgcttgagcctacaaggtcaaggctgcagtgagccaagattgctccactgcactccagcctgggaaacagagcaagaccccatgctcccttgcacaaagaaaaaaagaaaagaaagaagaagagaagaggaagaaaggaggaggagggagaggaggaggaggaagagaaggaggaaggtatagaatattttaaggagaatttctggaagaacaatttcacttacatatcacttgccaaagccttgtcacatgattacacccaatagcaagggagtctcttagtctcttagacaattgccctgctaaaacacaagagttttatttctaaaggagaaaaaaatagtattaggagacaactggccgtttctaccagagtcagctcttagtctgacaggtgccaacacatcatgtagaaccatctgttaaccaagaacacagcagactccccaggaataaaaccatgggtgtggggttgtgaaaggaatcacagtatggaaagggcctcttgtggccaggcgcggtggctcacacctgtaatcccagcactttgggaggccgagggaggtggatcacctgagatcaggagttagagaccagcctggccaacgtggtgaaaccccgtctctgctgaaagtacaaaaattagctggatgtggtggcaagtgcctgtaaacccagctacttgggaggctaaggcaggagaatcgtttgaacccaggaggcggaggtttcagtgagctgaaattgcgccactgcactccagcctgggcgacaagagcaagactcttgactcaaaaaaaaaaaaaaaaaaaaagagcctcttgcttgctcaatgtacatgtgttttcagtacttccattttgcccaatcccaggtatactgcttttatttgacaatgtaacactgctatgcatgctcatgtcactggtatccagtatttagaaatttgttctctatcacatctaacaacaaagccagtagccttctcagagaagatacagttagctctaaaatgaaggaggcttcactgtgattctcctgtcagagcctgccacaaattccacatagcaaccaaatggcagtttttatagattgttgagtcaagaggttggaacagtacacttaaaatttagtatatcctgacttcaaacccagagagacccaccagttactgtacttctttttggtagcagtgaatacaagatgcagtagcttatcttctacttcagaaaggacatcccaatatatcccaaaatactgttacctcagaaatttcactaaggtgtcaggtcctccaattttttatggacttcatgtcccatcatcagctgtgtctttagtgtctttacaaaggatctaaggtgtctgctagttctctatcacaatgtcctatcaattagcatgatgtcatcactgtaggggaccaggataacgtactgtgggatagtgagatgaacaaaatccctacagactaaatgatggcacagagccaaaatactgacctaaccatggaggcaatatgatgacggtgtactatactgctgggtatttctgatgttctcggttaattagattcagtaaggcatttgatagatcaaatagttaactaccaagtgcctgtttctagcaaagttctgtttctagcaagtgcctgtttctaccaagttctgtttctagcaaagagaccacatgtggaaccaaatatacaactggagtggtagaagcagcttatgataatacaccatcattctccaaaatgtatctatcttctgcataggtaaaaccagagttagcaggctgaacctttcaagtctttaatatggcactaatctctgagattcaggatgtgagactgctttggtaaaaagaactttgggaggttacacttggctcttcctaccataaagtccattaacccatggatatgggaactaatttggggattcttccacttgttgaacatatttattccagacatgcagtaagaaacaagatacaaccacggtacgaattcatggactgtgaaataatttcaagtcaaagctccattccatgcctgatttccacaagctcccatctgcctcatggaacacaacggtgtcctgagtcgctgggaattatcattagctcagcttccaataactcctgaaaggtttcagtatttgtcttctgatgaacagttaggcttgtaaataataaaagacccctttctttagggaaggctatgaagaaaattaattgtgcctacttgtgatattatcacaaggtccttccttaaaggaagatatgctgcctcttttttcttcaaggagttctagatttgtaaagtgataaatctataggtattagacattatggagacctaaaatcaatcctacattcattggaccttaagtgttctcttttcatttgtttgtttagttccagtatcaagatcaagaccttagtgagctacccttccatgacagttctaggaaccccttaatcaatttgcatactatattaagcatgcctatcttgagtctgatggttaagttctgttactcgcggcagggcgcgctggctcacgcctgtaaccccagcactttgggatgccgaggcaggcagatcacgaggtcaagagatcaagaccatcctggctaacatggggaaccccgtctctactaaaaatacaaaaattagctgggcatggtggtgcacgcctgtagtcccagctattcaggaggctgaagcaggagaatcgcttgaacccgggaggcggaggttgcagtgagctaagatctcaccactgcacttcagtttggcgacagagcaagactctgtctcaaaaaaaaaaaaaagttctgttacttgcctctgccattccaggattccactaaattcagaaagctcattttgtagcagcatctcttacattcataccaaggccagagaagacagccagtacagtactttttaaggatgccagcatttctctcactgttgtattttcttaaaggtagtagagaacacccatcttggaggatgtttttagagagtaaggaagccagctgcacaaaataaatccaccccaactttcctaactccccaagtttggcatctcaactttactcaatggaggtcactactgaatccacatttcagtcaaacaagcagacaatcagaaccactcctagctgcttcagcaagaaccaaatctaaaatctctcatagatgaatctacattaatagattcagcccaaactaaaattagattcctcctttcctggtccagcacctctctgaatttgatttcatatcaattgcataggtttttgctaacataaactagtaaaattcttgcaattcttttgatgcacaaaacttgtctttcatcatgaagttagccccttgaacttcctgggatctgactctcgctattggtctagaggccaaaaggtggtgggaatgggaataaaaacagctatcactcaacaagctgaagtcattacagcatctttaagcatcactcaaaggaagaagggttacttctgctggcaagggaggctcagtacaaaccacaggttaagaatacctggagtcattcaaatggttccatgtcatgattccaattcctgaaatcttactctttcccaatcaataactcaacttacacctatgaaatctgatgaagctctgagttcactctgcactgaacacagtttaataacttgttggatcagactctgaacccgatttagactatgacagtcctagagttataagacaaaagactcttttaagccaatcaccaaattcctaagtgttctaaccataacttcagccaagatttaaaaatttagccctgcagtttaaattttctttaaaccagaatttctcaaactaaacactattgacattttgggccaggtaactctttgttgtggtggtggggaggggacaatcctgtgcagcagcattcttggtctctactcactagataccagtagcaccctgctcccccagttctgataactaaaaaatgtcaccagacatttctaaatacgccttggagagcaaaatcaccccaggttgagaaccactgctttaaactctacagtggagttaaaaacagccaattggccgggcgcggtggctcacgcctataatcccaacacttttggagtccgaggcgggcggatcacaaggtcaggagatccagaccatcctggctaacacggtgaaaccccatctctactaaaaatacaaaaaattagccaagcgtggtggcacgcgcctgtagtcccagctactcgggaggctaaggcaggataatcgcttgaacctaggaggcggaggttgcagtgagccaagatggcaccactgcactccagcctgggcgacagagaaagactctgtctaaaaaatacaaaaaacaaacaaacaaaaacagccagtcctctcatatctttactttcctaaatggatcatcaatcagtttagcaaagctttgccttcaacaggtacttcatcccaggtaaccacagatgaaaaacactagatgccacaaactggttaccagtgacccttctagattccctgaggatctgttgcccaaaacagttttacatctatttaatggtccaggatcagaatccactccaggtagtttaagcaaaaagggggcttaagataagaatcagatgctcacaaaatctttggaaaaagtagagaggcagggtccagagtgactgagctcctagaaacaactcctagcccacagaaccactctgcctcagccacaatcacaaaagctggtaccatcagtgtaggaagctggcaagcaaggaagctcctgtagaagctacagaattagaaacccactgctaaatgacaaggctgccccacaaactactagctcagagccattctacttttctcataatctaaacccatatccttcctctctccccaggtggttcacttccaaatcaaagtgcatctgaagggtggaacctaaatcatgtccagaaaacaaagcagcctatagggaaaaaaaaattttactagccaagaagactattaggcactctcattctgaaagctatgtttttcactgtcatcttaaaaattggtattctccaagagatgtaacctatcaattattgcattgttgcatttttaacctatcaataatgcagttccctgagcatgaattactagaatatagattccaaaccaaggttaatgtcatcttgtaggaacctctttgtgtaaccatctggacttccataaaggaaaatcctctgcatcaataacaaccaaggtgggaggatcgcttgagcccaggaggtcaaggctgctgtgagccgtgaccgtaccactgcactccagcctgggtgatagagcaagaccttggctcaaaaaaacaaacaaaaaaccatgtacctcttatgattctgaactgcaacattctcccacacttactacaatgaatccatatcatttcttgcatagactactgcaataccttcataactgctctccctgactttacttgttgtgcacttcaaatcattttccccaaagtaccagaatttatataacatgttactccacttaactgacttctcatcacattcaggataatgactgaatttccatctgacttaccaaatgctcatctatgtctttaagagtgctctagtttcaacaacctgtttacagctccccaagtaagtcaggtccattcaaactcatttatctgcttttaagtatactgtcccttctgtggacattctcctctttaatcttacctccatttctcccattaccaggttaacatttacacattttaaagtgtcatctctttttaggaatgtttcctgacaccttgttcccctaggctaagagtggtccttcccgatgcttccataatatcttactcaaaatccttaagggaggaaatgcaaacagttatgtaatcttctccagtaggacttaagtctaagacataaaagaaaaaaataaaaatgattataagagaaggctgagagattatttcattctgttgttgaaagatctaaatcatttagaaactttctttttccttacactgagtcaaaatctttttgaagtactctcaccaactgatgttacctagaataagaaaaaatgcgtctattccttctttaagatgatagcgatagcttctcagctgtttgaaagccataatcatgattctccattcctctctaatgtaactagttttcccatcttagactgctctaatccttaatagtgttcaactaaagtgaaacactttaaggaacgtagaagaattagttcagagtaagaacttctaaaaggattaaaaagtaaaaagagggctgggtgtggtggctcacgcctgtaatcccagcactgtgggaggccaaggcgggtggatcacttgaggtcaagagttcgagaccagcctggccaacatgatgaaaccctgtctctaataaaaatacaaaaactagccgggtgtggtggcgggcccctgtaatcccagctactcgtgaggctgaggcaggagaatcgcttgaaaccgggaggcggaggttgcagtgagccaagattgcaccactgtactctagcctaggtggcaaaaggagaatctgtctcaaaatagtaatttttaaaaaaaagtagaaagggataaaaagtggaactcatcttaagaaaatgcaaatatttaaatgatataaataaatgcctaaatgaatcttttaaaaaatcataaataatacaggagctaaaaatagaaagtataagtataccactttccttgcctttcatagtaggtaatcaatggacactatacatttgataattcaagaaatagaggtttaatgtaataaagtatcctctagactgacaatattaaatattaacatagcaaacagatatcaggaggtagaaggagaagataattattaaaaatacaaaattccccatccttcatattggagaactaatagatgctgtctaaagttgtccaatatattcattgctcataaagcatccaccaacagaacaaaaactgacagaaaagaggtcttattttgaggaagtaggactgagtgtgcaagattatttcttttttcttggaaaggagactttttactttatattcttctgtttaatgactattttgtttacaaaaaacaaaaacaaaacacacacactcaagtagcttaataaaacagttactaatgctatataacatggtagaaaataagtggcaaatctgtgattacatacttaagacaataaaaggcaaataacccctgacaactttacgtagtttcttctatttattagttctaaagtatcattgctataaaatcacaaaatgttcactgctacaagtcagagatgatgagatgcctctatcagaggccaaactgtgctgctacttcctcataatttttatgagagaaaaaactctaagccttagagaggtattactctattttataataatctgtgaaggaaaggataacctctgtactagtctgttctcaccctgctaataaaaacatgaccgagactggttaatttatttaaaaaaaagaagtttaatagactaacaattccacatggctggggaggcctcacaatcatggtggaaggcaaatgaggagcaaagtcacatctttttttcttctttgagatggagtctcgctctgtcgcccaggctggagtgcagtggcgcgatctcagctcactgcaacccccgcctcccaggttcaagcaattctcctgcctcaagcaaatctctagctgggattacagctgtgtaccactgcacccagttgatttttgtatttttagtagagacagggattcaccatattggccaggctagtctcgaactactgacctcaaatgatccacctgcctcggcctcccaaagtgctgagattacaggtgtgagccacagtgcccagccgcaaagtcacatcttacatgacagcaggcaagtgagtgtgtgcaggggaactcccctttataaaagcatcagatctcgacagacttatccactatcacatgaatagcacaggaaagacccacccccccccccacccaatgattcaattacctcccaccagatccctcccatgacacgtgggaattatgggagctaaaattcaagctaagatttgggtggggacacagccaaacaatacaattccaccccggcccctcccaaatctcatgtcctcacatttctcaaccaatcatgccttcccagcagtccaccaaagtcttaactcatttcagcattaactcaaaagtccacagtctgaagtctcatccaagacaagacaagtctgttccacctacgagcctgtaaaatcaaaagcaagttagttacttcccagatacaacggagggtctacagccataccaccctgaatgcacctgatctcatctagatacaacggaggtacaggcatttggttaatacaccattctaaatgtgagaaactggccaaaacgaaagggttacaggccccatgcaagtctgacatccaatagggcagtcattaaaccttaaatttccaaaatgatcccctttgactccatgtctcacatccaggccatgctgatgccagaggtgggctcccacagccctgtgcagcttgattcctgtggctttgcagggtatagccctgctcctggctgttttcatgggctgctattgagtgtctgtggcttttccaggtgcatagtgcaagctgtcagtggatctaccattctggggtctggaggatggtggccctcttctcgtagctccactaggcagtgttccagtggggactctgtgtggcggctctgactccacatttcccttgtgcactgccctaacagaggttctccatgaagactccacccctgtagcaaacttctgcctggacattcaggagtttccatacatcctctgaaatctaggtagaggttcaacaaacctcaattcttgacttttgtgtacccacaggctcaacaccatgtggaagctgccaaggcttgaggcttgcaccctctgaagccatggcctgagctgtaacttggccccttttagccatggctggagtggctggacgcagggcaccaagtccctagactgcacacagcaggggggccctgggcctggcccaggaaaccatttttcttctcctaggcctctggatctgtgatgggagggactgccttaaaggtctctgacatgccctggagacattttccccattgtcttggtgattaacatttggctcctcgttacttacgcaaatttctgcagccagcttgaatttctctccagaaaatagggttttcttttctattgcattgtcaggctgcaaaatttccaaacttctatgctctgctttttcttgaatgctctgccgcttagaaatgtcttccaccggataccctaaatcatctctttctggttcaaagttccacagacctctagggcacgggcaaaatgctgccagtctctttgcatagcaagagtgacctttactccagttcccaacaagtttctcatctccatctgagaccacctcagcctggacttcattgtccatatcactatcagcattttggtcaaagccattcaacaagtctctaggaagttccagattttctcacatcttcttgtcttcttctgagccctctaaactattccaacctctgcctattacccagttccaaagatgctcccacatttttaagtatctttacagagtgcccccctacctcagtatcaatttactgttttaatctgttctgatgctgctaataaagacacaccagagactgcgtaatttaaaaaggaaagaagtttaatggactcacagttccacatggctcaggaggcctcacaatcatggcgcaaggcaaaggagatgcaaaggaacatttacatggtggcaggcaagagagcttgtgtaggggtactgccctttctaaaaccatcagatctcataagacttattcactatcacgagaacagcatgggaaagacccaccctcgccccaccagcccatgattcaattatctcccaccgggaccctctgatgacacacgagaattatgagagctacaattcaagatgagatttaggtggggacacagccaaatgatacctccaatcgttctagattcttgttcattaacatttacagcacatacaacaaatctgttaccaagacctatagcttctattgctaaattctcatgtgagttcatccctcctttctaccaccactcccttaggccttcataatttcttgcctgacttggtatccctacctcctgtttcttaccctatacattgctaccaaaataatcattctaacatgcaaatttgaaatcatactcacatttaaaatgcaccaatggcttcccactatctatgatttaaagttcaaagttcttgacatgagattcaaggccttgaatcatctggctccagtttaacttctctggcctcatattttgacacttccccctttccccatatataccctatactgtggccccaccaaaactacttgcaattcttccaacctgtcattcattgttaggcccccacatacatatttgtgttcttctctcttcttcctagaaagccctttatttaattcctcacttggcacatcctatttctcatagataaaacacaggaatcacctcttctagaaagccttctttcatctcctctctttcctgtcagactgggctaagcttctattcctctgtgttcttcatagtatcctgtttatacctcttatcatggctcctttcacttatattactattttctatttacctatttgtcttccctactagactgttacttccttttttttttttttttaattgagactcgctctgttgcccaggctggagtacaatgccgcaatatcagctcattgcagcctctgtctcccgggttcaagtgattctcctgtctcagcctcccaagtagctgggattacaggcatgagccgtcacgcccagctaatttttgtatttttagtagagatagtgtttcaccatgttggccaggctagtctcaaactcctgaccttaagtgatctgcccgcctcagcctcctaaagtgctgggattacaggcatgagccactgtgcccagccaagactgttacttcctaagagctgtggcttttctcacaagtcaagcactttacaatagtgatattcaaaatgacaatttctcaactaatttatgcatcatacagctacaaagctagtatctacattagggggcacaatcatggagggaatttccccacacaaaaagtaacaagagagaattctgcttatgctatggctgagtaagcacctactagattaacgttcccacaggtaacaactataaattctgaacaaaatataaaaatcagctacctatatataaataggtatataccaaaatataaaaatcaggcactgaagagtgaccaaaagcagacaaatattagagggcagtcagtacttggaagagtatggtattaggtgaatttcccatctacaacttttggcctgagggcagatccagtcagcaccatagcaagtacctaaaactctaagataaaccccactgttttactatcttgaagaatcaaaggacagagttcaggaagaccacagttgctgaaaagtgagaaacacatcctaggaagaagagacccagaaaggtagagacacaaaatctagttacaaactctgtacaaatttctggctgacccctgaaccaaacacgcaaaggacagactgcaagcagtccaggtagagataaaagaactgaactaagaactactgctcaagagacagagcttgcagtttttgtcccatcatgttaactgcctgctaacaagcatcaacactctttggaggaatataatggaattcagaggctccacaacttcatattcacaatatccaaaacacaatctaaaattccttgactaacaaaaaaatcaggaaaaagtggccaagttgcaagacaaaaggaaaccaatagaaactaactccaggatgatccagatgttggaatcagcatagattttcaagcaactattatgattctgcttaatgatgcagagaaaaatacaacacaacaagtttgaaaaattaacaaagcaatagaaacctaaaaaataacaaagtagaaattctagatctgaaaaatacagtatctaaaataaaaacattcactgatggcttaacagcagaatgaagacgacagagaaaaaggtacacttgaaaacagatcaataaattaccgaatttgaagaactgagaaaaagcaaattggggggaaaaaggaacagagcctcatgactggtctgcacatacaatgctaaaagatttctgaaggttgctagatggaaactcaagtcttcagaaggaaagagagcatcggatatgtcttaaaatacactcattaattcaacaaatatttattaacccatttatattggaggttgcaaatttcttttgtgaaaaaatcagaccttggcgatgaccctgagcagcaggatataaataacttccacaagcttagcattccaataatggaacactaggcataaatggattaattacccaggacagataatgtcctttaggcaataaatgagtttcaataaccttatatatatatatcatttttattaatttatgctacatcttcagagacgttttatcggtagatctctatatttaggccatcagtctgtttacctctcaaactgtatttacaagttgtattcattttataaaaccaagaatacaaataaaaagtaactcagtagaaacaaattatttgttaagtaaatactttaacgcactcactgattacataaaatctaacaagctagaagtaccaacatcaattatgtttccctcctgtccgatattcaattccttaatgagtcctgtcatttttatcttctaaatatacagatgacccttgaacaacttgggagttaggaaccccaacccctagagccgtcaaaaatctgcacataacttttaactcttcaacaacttagctactgagagcctactgctgaccagaagccttaccaataaacaacacatattttgcacattatatatatatatatatatatatatatatatatatatatatatagtattcttacaataaagtaagctacagaaaagaaaacgttttaaaatcataagggagagaaaatgcatttatagtattgtactgtatttatcaatactgaaagtttatgtcatctgtttataaatgaatctctgtctgaaatggttggcaactaaagctgcagacttcaatctacactacatatcaagcaattaaactttttcttgtaatggcatgacttttgtctgtttctcaggaacacttccagcatcgctagtggcactgtgtatgagtcccatagtgttattcaactaaacatgatgaaaaataatcaagagtgagaatttttaactatcgtatccaacttactggagagataaactgttcacttggagatgactggcatcatatggtattttaaggtattttaagcagatactcgcaagacttgagctcaccacaatagcaacaggaggcagctacaaaattattaacaatactacagtatatacttcagtatattttatgcagttttaatactgtatctttacatttgtttacatttctcaactgaatggtgtcatgtatagtctacagtgtttgtggcgtaagttttcataaattttaactttttataatagatttgtgtatattttatggtaagatagactagtatctacttatattttatgtattcatgcaacacctttttcttaattttcccaatatttctaggctatgcagtttgtctgcaagttttttcaaattgtcacacatcaccaaataattttccaatatagttattgaaaaaagatccatgtataagtagacccatgttgtctaagctcatgttgttaaatggtcaactatattttgaatgcatacatttccctcaatctctattgcttttacactagatccagccaccatcacttcttattagtctccccactccccatccataattctcacaacagccaaaataaattagatcatgtcactttacttcatttgcttcccattgcacttttaataaaatctaagctccttactaagcttacaagatctgtatgatctggcccctacctccacaacgtcattcatccaattctagcctcaatgtcacccactatattccagccacagaagcatcctttcaattccttgaacataccaagttctttcatacctaaagtttttttaataggctgtcccctcaaactggtttactcccctttctgcatacatggctggttccttcgaattcttcacatgttagtttgtatgtcacctcttcagagtacctaccctgaccaccttgttgaaaatagattttccattatctaacactatattttccctttatagtacttgtcacaaattgcttaattatggtgttgttgttttgttttgcttttattgcctaagacccctacaggcctacagctccatgagaacagggaccacacctgcatgatttaccaggatgcccaatggctaatacaataagagtaagtgatggtgcttataaattttattaactgaaagctcaagataaactcaaattttcacacatttcaaatagtgtttcattttaaataggtttgccatcttggagatagaggggtatgaggagactaatttaacaaataaaagctcatagtgtatttttattaaaaataaagtgaacataaaaacattcccttcgttgtccctgataatctatgttacctcagaattaggatgaaaaacaactgaacttatataaattaagaaactcaacaaatcactggcaatcttccaaatgaactcatatcttaaaatataccaatttgagaatattattggtatttaactgtttcaacaaacaaaaataaaaacacttcttctttaaaaaaaaagacacaagtggaacatgaaattatgccagataaatgaaaaagatctttttaatagaggcagcattttgaaaacccaatttcctattaaaaaaaaaaacccgtcgtctaagtggtataacaatgttcttaagaaaatagtaaacatctaaatcctagacaagggctgtccctaaagactagtcatagaggttgtatttgtgctattataaatagaaatttatttcctaataagtgatccatttttgtgtcttgtattatctttacagaaattctagatgacacaccattttcaaaaagaaaaaagtgctgggttttttgccttcatttatttaattctatcaaaagcattcatccattctgtcatgaaagttcttaaaataacattttgtgcagtttacttctaactatctcacgggaaattattctgacttcttcccaagaacatttcatcattttagactcaaccatttgtaataaggttggcaaaagttaaattgactgacaatgcccacagctgatgagatcttttttaaaaagaaaaaagcactcatataccccacagtttgaaataaaatgtaaaggagtcgattagcagtatgtttttcaaagtcttaaaaaatattcatgccttttaaaccaggattttcattaccaaattttatccaacagaaataagcagccagaagacacatataagcctgtttactataaaactgaaaacactgaaaaaatttaaatgacctatgtgtcatttggatatttaacactggcaatttttaaaataaattatggcatattcatggtcacgacccggtcacaataaaggctattcatttttttaaaagacagtgtacagctactaaaagtagcatttatctttattagcatagaaagatgtcccaaaaaaccaagaaaataaacgagtcacaaaacagcattatactatgaagtaacatttaagaaacaaaacatgttttttgcatgtggtacacatgtatttttttcttaattttattattattatagtttaagttttagggtacatgtgcacaacgtgcaggtttgtaacatatgtatacatgtgccatgctggtgtgctgcacccatcaactcgtcatttagcattaggtgtatctcctaatactatccctcccccctccccaaccccacaacaggcccgggtgtgtgatgtacccctttctgtgtccatgtgttctcattgttcaattcccacctatgagtgagaacatgaggtgtttggttttttgtccttgtgatagtttgctgagaatgatggtttctagcttcatccatgtccctacaaaggacattaactcatcattttttatggctgcatagtattccatggtgtatatgtgtcacattttcttaatccagtctatcattgttggacatttggcttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgctgacttccacaatggttgaactagtttacagtcccaccaacagtataaaagtgttcctatttctccacatcctctccagcacctgttgtttcctgattttttaatgattgccattctaactggtgtgagatggtatttcatggtggttttgatttgcatttctctgatggccagtgatgatgagcattttttcatgtgttttttggctgcataaatgtcttcttttgagaagtgtctgttcatatcctttgcccgctttttgatggggttgtttttttcttgtaaatttgtttgagttcattgtagattctggatattagacctttgtcagatgagtaggttgcaaaaattttctcccattctgtaggttgcctgttcactctgatggtagtttcttttgctgtgcagaagctctttagtttaattagattccatttgtctattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatgactagccagttttcccagcaccatttattaaatagggaatctgttccccattgcttgtttttgtcaggtttgacaaagatcagatagttgtagatatgcggcattatttctgagggctctgttctgttccattggtctatatatctgttttggtaccagtaccatgctgttttggttactgtagccttgtatatagtctgaactcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaacttggattcctaggtactttattctctttgaagcaattgtgaatgggagttcactcatgatttggctctctgtttgtctgttattggtgtataagaatgtttgtgatttttgcacattgattttgtatcctgagactttgctgaagttgcttatcaacttagggagattttgggctgagacgatggggttttctagatatacaatcatgtcatctgcaaacagggacagtttgacttcctcttttcctaattgaatgccctttatttccttctcctgcctgattgccctggccagaacttccaacactatgttcaataggagtggtgagagagggcatccctgtcttgtgccagttttcaaaaggaatgcttccagtttttgcccattcagtatgatattggctgtaggtttgtcatagatagctcttattattttgagatacgtcccatcaatacctaatttattgagagtttttagcatgaagcattgttgaattttcaaaggccttttctgcatctattgagataatcatgtggtttttgtctttggttctgtttatatgctggattacatttattgattttggcatgttgaaccagccttgtatcccagggatgtagcccacttgatcgtggtggataagctttttgatgtgctgctggattcggtttgccagtattttattgaggatttttgcatcaatgttcatcaaggatattggtctaaaattcttttttgttgtgtctctgccaggctttggtatcaggatgatgctggcctcataaaatgagttagggaggattccctctttttccattgattggaatagtttcagaaggaatggtaccagctcctccttgtacctctggtagaattcggctgtgaatccatctggtcctggacttttttttttggttggtaagctattaattattgccacagtttcagctcctgttattggtctattcagagattcaacttcttcctggtttagtcttgggagggtgtgtcgaggaatttatccatttcttctagattttctagtttatttgtgtagaggtgtttatagtattctctgatggtagtttgtatttctgtgggataggtggtgatatcccctttgtcattttttattgcatctatttgattcttctctcttttcttctttattactcttgctagcagtctatcaattttgttgatcttttcaaaaaaccagctcctggattcattgattttttgaagggttttttgtgtctctatttccttcagttctgctctcttagttatttcttgccttctgctagcttttgaatgtgtttgctcttgcttttctagttcttttaattgtgatgttagggtgtcaattttagatctttcctcctttctcttatgggcatttagtgctataactttccctctacacactgctttgaatgtgttccagagattctggtacgttgtgtcttcgttcttgttggtttcaaagaactctttatttctgccttcatttcgttacgtacccagtagtcattcaggagcaggttgttcagtttccatgtagttgagtggttttgagtgagtttcttaatcctgagttctagtttgattgcactgtggtctgagagatagtttctgataatttctgttcttttacatttgctgagcagtgctttacttccaactatgtggtcaattttggaacaggtgtggtgtggtgctgaaaaaaatgtatattctgttgatttggggtggagagttctgtagatgtctattaggtccgcttggtgcagagctgagttcaagtcctggatatccttgttaactttctgtctggttgatctgtctaatgttgacagtgggatgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccgtttgcttggtagatcttccatccctttattttgagcctatgtgtgtcgctgcatgtgagatgggtttcctgaatacagaacactgatgggtcttgactctttatccaatttgccagtctgtgtcttttaattggagcatttagaccatttacatttaaggttaatattgttatgtgtgaatttgatcctgtcattatgatgctggctggttattttgcttgttagttgatgcagtttcttcctagccttgatggtctttacaatttggcatgtttttgcagtggctggtaccggttgttcctttccatgtttagtgcttccctcaggagctcttttagggcaggcctggtggcgacaaaatctctcagcatttgcttgtctgtaaaggattttatttctccttcacttatgaagcttagtttggctggatatgaaattctgggttgaaaattcttttctttaagaatgttgaatgttggccctcagtttcttttggcttgtagagtttctgctgagagatccgctgttagtctgatgggcttccctttgtgggtaacccgacctttctctctggctgccttaacattttttccttcatttcaactttggtgaatctgacagttatgtatcttggagttgctcttctcaaggagtatctttgtggcgttctctgtatttcctgaatttgaatgttggcctgccttgctagattggggaagttctcctggataatatcctgcagagtgttttccaacttggttccattctccccgtcactttcaggtacaccaatcagacatagatttggtcttttcacatagtcccttatttcttggaggctttgttcatttcttttcattcttttttctctaaacttctcttcttgcttcatttcattcatttcatcttccatcgctgataccctttcttccagttgatcgaatcggctactgaggcttgtgcattcgtcacttaattctcatgccgtggatttcagctccatcaggtcctttaaggacttctcagtattggttattctagttagccattcatctaatgtttttctcaaggtttttaacttctttgccattggttcgaactttctcctctacctcggagcagtttgatcttctgaagccttctctcaactcgtcaaagtcattctccgtccagctgtgttccgttgctggtgaggagctgcgttcctttggaggaggagaagcgctctgatttttagagtctctggtttttctgctctgttttttccccatctttgtggctttatctacctttggtctttgacaatggtgatgtacagatgggtttttggtgtggatgtcctttctgtttgttacttttccttctaacagtcaggaccctcagcttcaggtctgttggagtttgctggaggtccactccagaccctgtttgcctcggtatcagcagcggtggctgcagaacagcggatattggtgaactgcaaatgctgctgcctgatcgtttctctggaagttttgtctcagaggagtatccagctgtgtgaggtgtcagtccacccctactggggggtgcctcccagttaggctactcaggggtcagggacccacttgaggaggcagtctgccagttctcagatctcaagctgcgtgctgggagaaccactactctcttcaaagctgtcagacagggacatttaggtctgcagaggttactgctgccttttgtttgtctgtgccttgcccccagaggtggagcctacagaggcaggcaggcgtccttgagctgtggtgggctccacccagttcgagcttcccggccgctttgtttacctactcaagccttggcaatggcggacgcccctcccccagcctcactgccgccttgcagtttgatctcagactgctgtgctagcaatgagcagggctccatgggcataggaccctccgagccaggtgcgggatataatctcctggtgtgccgtttgttaagcccattggaaaagcacagtattagggtgggagtgacccgattttccaggtgccgtctgtcacccctttctttgactaggaaagggaattcccgaccccttgtacttcccaggtgaggggatgcctcgtgctgcttcagctcacgctcggtgcgctgcacccactatcctgcacccactgtccggcactccccagtgagatgaacgcggtacctcagttggaaatgcataaatcacccatcttctgcgtcgctcacgctgggagctgtagactggagctgttcctattcggccatcttggctccacccctcagtacacatgtatttttaagaagtcaggaaatacatagaccaaaatgttagcagaattacatgaaagtagtagggtttcttttttacatttttattttgtcttaattttttttttttttttgtaagggacaaggtcttgctctgtcaccgaggctggagtacattggtgagatcatagctcactgcagtcttgaactcctgggctcaaccaatccgcctgtctcagcctcctgagcagctgggactacaggtacacacaattgtgaccagtttagaacttttaaaatgagtatcttctacttctatgacaagagaaaagatgctttcatttgggaaaagtttatttcctaaatatgaagcctattttcaagcttccccaaactaaattctgttacttctataacagcaaggagtccttcagacaagtcatttactttgtacttagaattagaagttgttatctctgatagggagtgataaatttgtgctgtttcattcaggaaaaccaagagtacaaatttgccatctgcataaccccagttgccagaggtcatgaatccagtctataatagaaaatgctgaaaacataaatggtctacacctcccttttaaggaaatattttcagccaaagaagctaattagccacatacgaagacctatttttagatttttagtactaattttcatatcttttcatttactctatcatgtcttccctttgaaagtttcatatttatatacaaattgaactctttaatttttccttacaaagtagttatcttgtcatttctatcaattctttccatttttatcatattttgacaagatttcttcacatgtatcataagtattatgttctaatcatcatcaaaactgaataggaagaattctattcctgtcttaaagtacaagaactgtgtagtcaatcctctcccctaccctccccaccaaaatctttgtactgccgggtgctcctattatgaataatccatatttcataatcttaatcttataccactgatttttaagatctctaagcttaaaagtattcattttttttcttaacctcttggtgtatatcctaaccaaatatatatatatatctctctctctcaaagattctgtatcattttaaacaacctgtgataattctccaaaaaaaaaaaaaaggtattgattagtaagtcagccaaagatatgagccactcagatctcctttcaagaaagaatttatgactcagctgcagggagggtaattagctattagagccttcaggttctgcatcagcattccggttaaaactattatcttcccaagttatctcccaaccaatgactaagcacagctgtaatactaaggcctggtcatttctgcctaacatgggactccttcgatatacaatcttactcttggtctccctactgggctggctgagactgtcagctctgcatcatggtgaggagactcccctggccctatgttgttttcattaatccttcacagtcattgttcctcaatcaacctcttgcactcctaactccacctcagcatcttcttcccaaaggacctaacagatataatgatttaatactgacacatcagtattattcatcaaagatccagatttaaaattataattctaatacaaatatctatttctctcatttatatgtccccttacattctgccatacctatcagataaaattttaaaaatatggataagctattaaaaacaggtatgcagaggatttgagatgttggttgaggtagttgtttttacccctcattttgatcttgtaaatgcttttaccctggcatcaaggatgtatctttttttcctgagccagtttcactgagccaatatcctatcttgattttctatagcatagttagaccatttattttattaaaaagtgttcatttcactgaattgctggagcaattcatgtacattttgtgataacaattttaatttgttttataaccatatcaatttttttaatgttagcttgtatcacagtaaaatttgggtgagtggcccaatttgtaccttttcctaaccaagtctatttttccaaagtcaaattttacagatctaaattttgtcaagatgatagtgttcctatcagattttaattgacaacaaaattttccatgtgcagctataacagcttttatttgtgttacatctaccctatcaaatggtgggatcaaagattattcggatttaaattctctacttcaaaattatcttcaaattcaggtcacaacttaaatgtcgtcttctcaaaggaataatcctccatctctatgatgaaaagaatgcatgcatccaaaacagaaagaacaaagggaacaagcttagtgtgctggctggacaaaaagaaaatcagtgtggttatagcttggtagaaaaagggatacgggtggccaggtggtacagtatctcttatatgcctcagcccagacatggcacatcaatttgttaaaatttcattgcctaaaattagttacatggcacttcctacgtacaaagagaactacacagggtttctttctgccaaggaaggagaaacaggtgtgagtaagcactggtagcctcaaatacaaataccttccttacggtacttataaagattgaaatgagataatatcaagttcatagctcattgccaacatttttgagtattgaataaataactaatttacactttattgtttttcaagtatacatctaattatacttccttttttaagtgaattgaagcattttttaaaagtcaattaattgaggccaggcacggtggctcacgattgtaatcccaacactttgggaggccaaggcaggtggatcacctgaggtgaagagtttgggaccagcctcaccaacgtggagaaaccccgtctctactaaaaatacaaaattagccgtgatgcacgcctgcaatcctagctactgaagaggctgaggcaggagaatcgcttgaacccgggagggagaggttgcggtgagccgagattgtgccactgcactccagcctgggcaacaagagcaagactccatctcaaaaaaaaaaaaaaaaccaaaaaactcaattgagaaccttgaccaacactaacagcaaaactatttacataaacttccctttttggaaaaattagaagatactttcaaatcaacaatccttcaaacgtttctatagttcatattgtaatttctcaatgactatcactgaccagatcctaggactatcattgacaatgtcctagaacttcattaatccataacaggaaaattgaatcattgctgcatctagatatccatcattcaagataggtagcaaatttgctttttaaaaatgtagtccaggatgaggcaggaggatcacctgagcccaagagttcaataccagcctaagcaacatagtgagaccccccatctccacaaataatagaaacaattagccaggtgtggtgatttgtgcctgtggtcccagctactcaggaggctgagataggacaatcatttgagtccagaaagtcaaggctgcagtgagccgcaattctaccaccacactccagcctgggcaacagagcgagatcttgtctcaaaacaaaacaaaacaaaaataggagtcctcatataaccagaaagtacaaatgaacaaataaaaacgaacaaagaatatctgaaataacgttcgatttaggtccagcttggtggctcatgcctgtaatcccatcaaattgggaggcccaagcaggaggattgcttgaggccaagattttgagactagcctgggcaacatagtaagatcccatctctattaacaattttttataataaaaaaattatttgggtatagtagtatgcatatgcagtcccagctactcaagagattgacggtgggagaaccacttggctgcaggagttcaagcctactgtgagctatgattacaccactgtactccagcctagacaacagagcgagtccgtctctttttttttgtttttttgagacggagtctcactctgttacccaggctggagtgcagtggcgcgatctcagctcgctgcaacctccgcctcctgggttcaagcaattctcctgcctcagcctcccgagtagctgggactacaggtgtgcaccactatacccagctaatttttgtatttttactagagatgggatttcaccctgttggttggccaggatggtctcgagctcttgacctcttaatccacccgcctcggcctcccaaagtgctgggattacaggcgtgagtcaccacgcccagactcgagtctgtctcttaaaaaagtttaaagagtgttcaatgtaaacaaattactttcatttctagtaatgtatattcagtaatttggactaacttctctgatggaaacaaatagaaaagctggataaatctgattaaaggcattaatgagtcaagaaaacagaaaataaattacaggacacagatctggaaagaaaaaaagaaaaccaaaagataaagtcagcatttgggagtacttttcccccagggtatttgccaatctgaaatccagatgaaggtttagaagataagcagggctactgacaggcacaaaggaatgtggaacaaaaactggagccacattttgggaggctgaggcgggcagatcacctgaggccaggagtttgagaccagcctggccaacatgacaaaaccccatctctactaaaaacacaaaaattagctgggtgtggtggtatatacctgttatcccagctatttgggagcctgtggcatgagaatcacttgagcctgggaggcagaggttgcagtgagctgagagcgtgccactgcactccagcctgagcaacacagcgagactctgtctcaaaaaacacaaaaacaacaacaacaacaaaactggagccaaataagggagtgttgttaaatacctgatgcttggagaccatacactgaaggctaccctagggaacctaaaataaactgactatccctgggaatactgcccagcctcaaatcatctcagtacttaaaactggattaaggtgatacagaattactaatacccctatcttgtcttttacttctttgaaaatattgagcaggattattttcttcaggtttattgtgctataatgtcaaataaactgcacatatttaaagcgtacaattaaatgaggtttgacgtgtatatacactggtgaaaccatcatcacagtcaacataattaacacagccataaccccccaaagattctttaggcacctttgtaatccttgccttctacctgttcctaccctagtactccacattcctaaaccaccactgatcggccttctgtcactatagattggtttgtataattagtttagaattgcatgtaaataaatggtatgtactttgggagggggtcacttctattgtataagtagacctgaagttgttgatccattaatccactgaaagacatttgggctgtttctgggttttggctattacaaataaagctactacgaacatccttatataagtctatgtatgggcataaggtatgaatattttgaagcctgtttctgataacactcctatcagattctaaagtacaagaatatagaaagaataaaaggattcaaaaatataacatggaggctggtgcacggtggctcatacctgttatctcagcactttgggggatggaagcaggaagactgcttgagtccaggagctcgagatcagcctgggcaacatggtgaaaccctatctctacaaagaacaggaaaaccagctgggtgtggtggcgcacaccggcaatcccagctactcgggaggctgaggtgggaggactgcctgagcctggggtggttgaggctgtggtgagccatgattgtaccactgcactccggcctgggcaacagagtaaggccctgtctcaaaaatgaaaacaaataaaaataacatgaaaacactaaccaaaagaaggctggtgtagctctattaacttcaaagtggactttcaggaatacttcatattgaaaaaagcttgaattccacaagaagattaacattttcttatgtacctaatggtataaccttgaaagatatgaagcaaaattgagagacacaaagagaaaaagacaaatccaaaataacatggctgggcgcagtggttcacacctgtaatcccagcactttgggaggctgaggtgggtggatcacctgaggtcaggagtttgagaccagcctagccaacatggtgaaactctgtctctacaaaaaatacaaaaattagccaggtgtgctggcacacacctgtaatcacagctacacaggaggctgaggcaaaagaatcacttgaacctgggaggcagaggttgcggtgagccgagattgccccactgcactctagcttgggcaaaagagtgtgacttcatctcaaaaaacaaacaaaaaataaataagtaaaataatagtggacgatgttaacgtaactcttgcagcaactgatgagaacatgtgaacaaacaaaacaggaatacagaagtaacaaaactgacctgaattatacatatatacacacatatatgtttatgtgtatatacatgtataatatatgtatattaacataaacgtgtgtatatgtgtgtatatgtatatctgcatgtatgtgaatatatataaaccactgcacaaactacagaataaaatccttttcaagctcatacaaaatttttaccaaaattcaatttgtttgcaacataaagcaagtttcagcagatttaaaaggactgaaatcatacacagcttcttccctaaccaactgcaattaacctaaaaccaataagactaagataaatagaaaattgccatatacttggaaattttaaaatatgctcctaaataatccatgggttaaaaactaaatttcaataaaaactggaaaatatgttaaacaaaatgattaaaaatacaatatcaaaacttgtgagatgcttccttagcattcatattttggtgcctaatactctactagtaagtgaaccacaatataatggagtaggagaaaaaattggatgtgtctgtaacatcctgctgtaaattttactttcaagatcatagacatcactaaaaaaggaggaaaaggtaaataggggaattatactaattacattttgaaaaactgcacataaaataaaaataccaactaatgatcattaatgttttttattttacaaaagaccgtgacgtcacaacaatggtcaagagaaaacgcaaaatgcactatataaacctaatggtaaatatagtagcttgtttttataatgtatagaaaagtattgatatacatgtatattttgggttttaaaattttgattatgttttatgtgttcatttatagagcacataaatgtgtctgtttttatctttgtaagaagaacagcatgaataaaattagtagtgagccaaacagcactagccaaaagaaggaattatgctacaaacaagaagacccaatcagcactggaggtgccctttagtaactaagtataaggtgagtcccacagctgattagtattggtagttatatccaaaaaccaattagaagaaagattctgcaatgtgtcccaataatacatgagacaaaagtccccaaaagtaagctaactatacagacttaaaaccttatctcaggagatgaaaccctagatgaacatgataattttaatgaagtgcaggcataagttgctgatcattttaggagatatgcatacaattaaaagaacaaaaaaaaaaaaaaaacaggataacctgttaaggctgtctggccaaacaaaatttaaagacttccttatttctgagaaaggtaaccaattttcaaaataaatttataggaaagatgggaacttaaaagtaccatgatataacacataaaactcagattaaatggagacttggtctagagaacaatagctgaaatacgaatcatcatggactaagaaatcagttttcatgtccaacacaaaaatcaaatggtgagtgacacagaatcagtatctttgctgatctgagaacgcatgctctttacctttgagtttggtggtatgactaaaacccagagaagtaaaaagcaaaatataattgcaactggttgaattacctatacctacaaaaacagaaaaattggagcagtagaattatattatcatcaggatatgaaacagtaaaattcatggtatttaatgatgtaactggtttggggtaataatttagatatatggtgcatttttttctgcttcttaatgtgtttagatcatttgaaaaacacttattattaaattttatgactccaatcaataaaagtattaaagttcgcaatacgtgtttaaatatctgggaatttttattgcattatcagtaagtttgattatttgcataaggaatataagaatacttagaggaatattagtgtttaatatctaaagatataccaattgtttgacaaattaatattaatagattaaacaaatttgtgtcacagattagagtgcttaaaaaaatttatagcttgaaatgcatatacaagagagaaagtggccaggagcggtagctcatgcctgtaatcccagcattttgggatgcagaggaagggggatcacttgaggtcagaagtttgaaaccaccctggccaacacggtgaaactccatctctactaaaaatacaaaaaaattagccaggtgtggtggcacacgcctgtactcccagctacttggggggctgaggcaggagaatcacttgaacctgggaggcaagaggttgcagtgagctgagatcataccactgcactctggcctgggtaacagagcgagactgtctcaaaaaaaagagaaagtaagtaatgctaaaaatcaatgatgtaaaaattcatccaaggaactttgaaaatggacagcagattaaatccaatgaaggaagtaaataaagatgagaacagaatttttaatacaaaaaaatatacaatagagaagaatgacaaagctaaaagttggttgttaatttgataagctcccagcaacacaaaacaaaaaaaggcggcaataataatcaaaatcaggaaacattacagatcctactgacttcaaaaagataaaaaagtatattatgaacaatgttatggtaataaatatgaaaatctagatgaaacggacaaattcctagaaaacaacttttcgaaactggctcaagaaactgaaaatccgagaagcagatatctataaaatgccacaataggaggttccaaaattcatttctccatggaaacacaaaattaacaaccatctaaataaaaaattaccttcaagagaactccagaaatcagccttcagcagattcccttggcccacaagttctccaatgggagaaagaaagagtaaggtgagtgtctacctttgccacaaatcctagcaccaggcctgtccacctacagaccacaccaccagactgaccctactccctgcagacccacttgcccacagaccctaggacctaacatgcctgcccacagacacaaaggcaggtgtgttaggtcctagggtctatgggcaagttaggtccactggtgtctatgggcagtggtatgtccaaggactggtcctagcaccaaagtatttaaaaaataaaaactacccacaaaaatgtgctgataagatacacaacataaagagtcgttctgacataaataacatagagtgtgtggcaaaggcattataagtgtatagtttttatatgcaattgaagttaagactgtatcagcttcaaacagactgtcataactattaagaaattttatgcaagcctcaggataaccatgaggaaaacacccatagtaggtacaaaaaaagataaaaagaaaaaaaagtatattattacaaaaaaaatcatcatatcaaagtgaaaacagcaatacaaaacaaaaataactataaaacggacagaaaaaaattaacaatggcaatagttcttatctatcaatcacgttaaatgtaaaattcaccaatcaaaggaggtaaagtaatgaaaggagttaaaaaacaagatccaactgtatgctgtctgcaacaaatacaccttaaatttaagaacacacacaagctgaaacagaagagatgaaaaagggtatttcatacaaatggtagccaaaagagagcaagggtgactgtagttacatcagacaaaatagactttatgtcaaaaactgttaataagagacaaagaaggtcattacataataataaaagggaaaactgaatacaggaaaataaaacaattatatatgcatgcaacataaaagctgctaaatacataaagattgacagatctgcaggagaaatagatagcaatagaaaaatactaggatacttcaatcaccacttaaaataatgaacaaatcatccagacagaagatcaaaagaaaatatcaaacttgaacaacactatagatcaaataaacctaacagacagatataaaacattccacccaaaagtagcagaacacacagtgtcctcaagtgcaaacagaacattctacagggttgatcacatgctaggtcagaaaacaagtcctaacaaatataagaagtttgaaataattccaagtatcttttccagccacaatggaatgaaactaaatcaaaaacaaaaagaaaaaaattcaaaaatatgtggaaattaaacaatatattctggaacaactaatgggtcaaagaagaaaccaaaaagggaaattagaaaatatcttgagacaaattaaaacaaaaatctatctcaaaacttatgggatgcagcaaaagccgtactaagattgaagtttataatgataaatgcctacattaaaaaaagaagatctcaaatcaaaacctaacattataccttaagggtctagaaaaaaaagaacacaccaaacctaaagttaaaaaaatgaatcaaataataaaaattagagtcaaaataaatgagaaagagacgagaaaaaaaattttttaatgacaaaataaagagttttttgaaaaaattaaattggaaaacccttagctagactaagagaaaaaaaacaaaagaagactcaaaatcagaaatggaagaagagacattacaattgatgccacaaaaataaaaaacatcataaaagacgattgtgtacaattatatgccaacaaattggacaacctaaacagataaattcctagaaatgtataatctaccaaggctgaattaagaagaaatgaaaaggccaaaaagaccaataacaaatacggagattgaatctataatcaaaaaccaaacaacaaagaaaaggtcaagaccagatgacttcagggataaattctaccaaacatttaaagaattatcaccaattcttcttaaattatttcaaaaaaatgaaaacaaggaaatttgtaatcttcttttataaggacagcatcaacctgatatcaaagacagacaaagacacaagaaaactacaggccaaaatccctgaaaatagatgcaaaaatcttcaacaaaatattagcaaaccaaattcaacagcatgttaagatcataaaccatgaccaagtggtacttccctcctgggacgtaaacataggccaatatacataactcaagacaagtgattttttgtctttcttgcctgtgattttagtgtcatatccaagaaatcattgccaaggctaatatcaaacagcttcttccttatattttcttctatgagtttcatcgtttcaggtcttacatttaagtctttgagttgatttttgtttatggtgtaaggtaagggtccaatttcattgttttgcatatggatatccagttttcacaacaccatctgtgaacagactgttctttcctcattgtgtattcttggcacccttgtaaaagatcagttgagtatatgcatggatttgtttctaggtactctattctgctccaacagtctacaagtctgtttgataccagtcctgcactgttttgattgctgcagctttgtaatatattttaaaatcaggaagtgtgatgcctctagctttgttgttcttgctcaaaactgctttgggtatttgaatcttttttggtaccatacgaattttaggcatgtgttatcctgtttctgtaaaaaatgccaatgggattttgacaggaactacaccaaaactaaaaagcttctgaacatccaaggaaacaataaacaaaacacaaaggcaacctatggaagagagaaaatacctgcaaactatacaactgataaaagattaatatctaaaatatacaaggaatccctacaactcaatagcaaacaataacataatttaaaatgggcaggccaggggcggtggtgcatgcctgtaatcccagcactttgggaggccaaggggggtggatcacttgagctcagaagttcacgacagcctggacaacacagtgaaactctgtctctacaaacacaaaaaaattagctgggtgtggtggcacacgcaggtagtcctggccactcaggagactgaggtgggaggattgcttacaaccaggaggtcaaggccacagtgagccgagatcacaccactgtactccagcatgggcaacggagtgagaccctgtctcaaaaaaaaaaaaaaaaaaaattaaaatgggcaaactaattagatatttatccaaaaaagaaatacaaataaccaacaggtatatgaaaaagtggaaaacattactcataaaaatcaaaaccacatggaggcctggtgtgggagtgcatgcctgcaatcccatctactcaagaacccgagtcaggagaatgctgcttgattccaggagttccagactatagtgcacaatgaccttgccattgaatagccactgcactccagcctgggcaacacagcgggaccctatctataacaattttaaaacaaacaaaatgagatatcaccttatgtaagaatggctattattaaacaaaaaaaaagataagtaatgttggcaaggatgtggagaaaagtgaccctttgtatactgttggtgggactataaattggtgcagccactataagaaattatggaggcacctcaaaaaattaaaaatagaacaaccatatgagctagcaatctcacttccagatatatacccaaaagaactgaaatcaagatatcaaaaagatatctgcactcccatgctcactgcagcattaatcacaatactcaagacatggaaacaagctaaatgtccattgacagataaatggataagaaaaatgtgggatataaatacaatgaagtgttatttggccttcagaaaggtatcttgccatttgtgacaacatgggtaaatctgaaggacactacgctaagtgaaataagtcagacccagaaggacaaataccatttatagggggaatctataatagccaaactcacaaaagaacagtagaatggtggttaccatgagttgagggtggagaactggggaggtattagtcaaagggtataaagttacagttatacacgtgaataaatcctagagatctattgtccgacatactgcctatagttaacattatggtatacttaaaattatacaaagacactagatcttacgttgtgttcttatcacacacaaaaaaagaaagagtggggggaagcttttgaaggtcctggatatgtttatggcatacactgtagtgacgctttaaaaggtgtatacttattgccaaactcctcaatttgtatacattaaatatgcacaggtttcttttctttctttcttttttgtgtttttgagactgagtttcactcttgtcaccgaggtggagtgcaatggcgcaatttcggctcactgcaacctccgcctcccgggttcaagcaattctcctgcctcagcctcccgagtagctggggttacaagcgtttgccaccatgcccagctaattttggtatttttagtagacacggggtttcaccatgttggccaggctggtcttgaactccaacctcaggtgatctgcctgcctcagcctcccaaagtgttgggattacaggcaagagccaccacacccagttgatatgcacaggtttctgtcaataaaagacaatcatatgtcaattgatatatgataaaaagacaagcatatgtcaataaagaaattaaaactctgaaaaatactataaccattaaaaacaatgaatctaaaatctttccacaaacaaaactccaaatccagatggcttcaccacttaattataacaaacatttaagaaagaaataacactggccttgcatggtgggtcatgcctgtaatctcaccactttgggaggtcgaagcaggagaattgcttgagtccaggagttcaggaccagcctgggcaccatagtgagaccttgtctctacaaaaaatttacaaaagtagcccagcatggtgctgggcatggggcatacacctatagtctcagttacttgggaggctgaggcaggaagatcacttgagcccagatgttcgaagtaaaagtgtgctatgattataccactgtgctaggtgacataaataagaccctgtctttaaaaaagggaagacagaaatcacaccaatcttacataaactttcagtgaaagaaacattgggtggaatgtaacactttcccagccagcacattattaccaaaaaatgacatggaaaacacaagaaaagttacaagccaatgtgactcataaacacacatgcaaaactcctaaaaacattagcaaacgaaatcaagcaaactacacaaaggataatatagcaaagcaagttgcatttactaaaaatgtaaaataggcttaacatttgaaaatcagtctctgtcattcaccacaatttaggaatttaaaacaacaatcaggctgggcatagtggctcatacctgtaatgccagcattttgggaggccgaggtgggaagatcacttgaggtcaggagttcgagaccagcctggccaacatggtgaaaccccatctctactaaaaatacaaaaaaaaaaaaaaaaaattagccaggcgtggtggcagtcacctgaaatcccagctactcaaggaggctgaggcaggagaattgcttgaacccaggaggcagagattgcagtgagccaagatcgtgccactgtactccaggcctgggtgaaagagcaagactccattgcaaaaaaacaaatgaataaaataaaataacaatcaaaataggaggcaaagcaagatggctacatagaagcctacaacaatcatcctcctcacaggaacaccaaattgaacaactatccacagaagaaaacaccatcataaaaaacaaaaatcaggtgagcccttacagtacctgattttaacttcatattgttcaaagaggcactgaagagggtagaatgaacagtcttgaattgctgacaccaccccttcccagttttaaagattattggtaaaataaaaatgtcttcaaaagtgtaaacatttggtctaaattatgcaggtcagatattaagtttgttaaatggtctaaggtcataagctgcttctttgacttttaaaaattgttcaatttattttggagcattacattctagataaggcctggcgacctgtgaaattacccatgccccctagctaggcaaagaaggtattaaagaaaagagattttatatatgaaaggatcttgtataataaatgtttgtcctaaagctaaagtaaaatgactggtcatttaaaaagagggatgtttaggacaagtcaaaaagtctaagcatgttgtaggtggtctgtgttaagtcatgaaagaattggtgaaagggaatttatgcaagaaatgcagtacaatttaaaggtgattaggcctcttaaatgcttcataaaatgccactatgactcttaactgtactacttgcctgctttacagttaggtaaggcttgggacttgtggagtgagatgctggaaagagtcagaccttatcttcatttctgtctgggtcctaggctccatgcctagtacataattaaaatgctgaacttaccaaggtttttcaccaaaagtaaaaatgctaagggttaacagtgtaatgtatatttgaaactactgaaaaaacagttttacatgcaaggtgtgtaaagaaagttaaatgtgtttttggtaaaagattattaaaagtcatgggaatgtgaattttttgcctaactttagttaaaggattgttttaagtgaaataggaaaaatctaaaggtttaaacaacttgtggaaattctgtaaaaattaaccctgtaaaacaaattctaggccgggcgcggaggcttacgcctgtaatcctagggctttgggaggccgaggtgggcggatcacaaggtcaggagattgagaccatccaggctaacacagtgaaaccccgtcactactaaaaatacaaaaaaattagctgggggtggtggcgggagcctgtagtcccagctactcaggaggctgaggcaggagaatggcatgaacctggcaggcagagcttgtagtgagccgagatcgtgtcactgcactccagcctgggtgacagagcaagactccgtctcaacaaaaaaaaaaaagaaagaaattctatgtgtgaaaatattgactaaatttaaaggggtattatcttgtttttctgtaaattgaacatcaaaataaaagcacaacagggttttcttaaagcacgaatctgctctttaacaaaaaaaattgtaaagggttataaaaggtttataaaaatctctccttatggtcaaactgattaagattggacagatttgtctaatgaggctttattaaaaattggggttgacattaataatctactaatgtaagagtgaaatatggctttctcgaacaagattttcatgtaatattaaaagataatgaaaaatgtatttgccttttaaatacactatcaaagaaaaaaaagaagggaaagacaaaagattgtttgaaaagctaagtcttccctctatcaatgagtaaacattgttgcctttttaaaaatttttgtctcattattttggctaaatgaatgacttacagtaatgtggaattccagttcataatatcaagtgttttatacctttaacatatttaataagcttccccaaatcaaatttcagcttccaaatagtctcttctgacttctaactttggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgcatatggaatccctgaagcatctaaaagagacgtaaagagaattatttaacatgttaagttacatgggaagcattgtcaaaataatgtttaatcttcaggttatattttagtgaatattaatatatgctccaaaattgtatgggatttctaaaattctaatacgtctgagtatatgctaccaatcataattatggttaagttttatacaccatagaaacaaccaaatatccttgggtaaaactgctaacccaagcagaaccaaaaagttaattaaataccaagaaaatactttgccagattttcatgttaaactagctgatactaaaattgtttagatatacaatttgaactccatggtctaagttaaactacctatgataacccattagttatctgcgctatgcacctaaattgtagaaacaagtggtattcaagaggatgtaagtccaacgctaagcatggactcagaaccaggacagctgccttgtccttcttgagtccttaaggctcttgttattaaagggtctgcattccatgactcatcatgggaaggataaaatgatccaaattgaatatacagatgtggtgacttataaattgtgaaaattagtttaaaaccaatgtttggttccatatttctgggaagacaatcaaaccttcagatacatttggctacctgatgggtcatttaaacatttataaagggatttcattcaattgtcattttcaatgcatgttttatgttataatagttaattattacgccacagtatattttcaccaggtaaagaaagtttttatggttcactaaggacaatcaactccttcacaatatagaacttgaagactggatgttctgagaacatcagagaaagactgcccttgccattcacactgcaacaaaacttgggaagcttgaaccttgggttaataatctcacaactgagaagggtccctccacactcttggaaactgtacacccactggaacccttaaggtaaaactaaccaggcaagtttctccccagaagaaaatggcatccttaatgtgaacagcttttcctaggatcatggatcaagacttctactatcattagactcttatcttcgaatattttttccttatttatgcctccatgaacaatagaaatgtaaagggggtctattacgtgcacttatagggtatacttttatttgtagaggattttgcagccagccttatacatgaataaccttatactttggtagataaaagatgaaggcccgatgtagatgcgaaaccttaatggtacatatgttgcctcataatcagtcaaaactctcttaacccacatcatgggccagaaagaatattgtcaggaagccttcactcttctagaaggacatcatttgttagatcctttttccatgatttagaataaaagaggcaataataaaaaatgtatccctcataatagactctatagcagattctactgtaaaggctatggttacacaacagactttacattttcttgtgaaagacatgctaaataatagaattggctaaacagaaaagtacctgtgcagctactgacacttgtggcctatggacaaatccatcaaatgtagattataaaatttcagttgtaggggattaatgaaaagactacttattcaagcgagtagactcctcatctagctccttctttaatctatttaatcttaggtggtttggtttatggggactctggataaggagcacactccaaactcctggcattatcctcccaatagtcatgataatagtctccctggtgcgctgtattctctcaaaggttttaaatgtttgcatgcagccatacctagaatgtcaaatggtctctcttcaactggaatgacaaaagttgaaagaaatatgcgactgtgaggacacagtaacctatgaatgatgtgcagagaccagaaacccaaaatgatagaaacagagagtggcactaaggtcctaggttttggtcactctctcacctaagggagaagctgaccaaaatggggaaatttttttaaacaaaattatgggaggctaaagtttggactaagctcatgcacgaggccccaacaggccaaaccaaactaaaatggagtcatcatgctaaatgtgacataatcaaacttaagacttcaaggaaacacctagatcctagaacagaccaggttctgtttgcctcctgtaaacaggatgttccagcataaggaggtaccctctactcagtccttgttcttgcttttgcaaaactcactgttctactatttcccagtgggtttcaagaccaaataagtacatttacaatggtgatagtgacatcaataactaaagttttggtcaatctctcaaaattgagaaaatgaccaaaagtgggaaattgttaaagcaaaccaaatatggcctgagaaggactctgtacttctatatttgagtccttgtggacgaactgcaacctagcttaatatgcagacaagactgaaaacctaacttaggagtatgtgtctgtaataatagctaaatcttggccaatcccatcggccatacttcaaccattcatagactgctgagtgttaaaactgtgttcaaataaggcaaacgctggccgggcgcggtggctcacgcctgtaatcccagcactttgggaggccaaggcgggcagatcacggatcacgaggtcaagagatcgagaccatcctgactaacacggtgaaaccccgtttctactaaaaatacaaaaaattagccgggcatggtggcaggcgcctgtagtcccagctacttgggaggctgaggcaggagaatggcgtgcacctgggaggcggagcttgcagcgagcttgcagcgagctgagatcgcgccactgcactccagcctgggcaaaaatgcgagactctgtctcaaaaaaaaaaaaatcaaaaaaaagaaaataaggcaaacactgagctgtaaccaatccagcagttctgtacctcacttccgatttctctatgtcatttcccattttttgtctataaatcttcttccaccacgtggctgcactggagtctctgtgaatctgctgtgattctgggatctgcccagttagcaaactgttcattgctcaattaaactcctttagatttaattcagcttaagttttaacatgggaaaaacatattgacagacaactagcaacctccacacaagaggtaaataccaaaaaaaaaaaaaaaaaaaaaaaatcagctttagaagtttcagaatttgcctctagagaaaagaaaaatgatagcaggaattagagcgtagtgttaaggaatactagtttctataatatgcttctacagatctgactttttaaactatgtgcatatataatataatgaaaataaaaagagttatgagagaaaggaaagcagaaatgagccacaacttgtttctgaaagcctgtctttttctttttgggaggagatgcaagagatagacgtaagaactatataaaatcaaaagtaaaccctgtctgcacattagtactctttaagacagtgattttaactgcttggaaacgcttttcttaatttctttttgttcctggatatatccctgattctgtggagaaacagaatattatggcaaagaatctctaaatcacagactctaccaatacaaaactacaatgattacttttgggaagtctgcattactttttgctaaaaggggcactttttctcataaaggaaaaatcaccgccctgatttttcaatttaatatctcaattgccctgagatattactataatgaatcacagtataatttagtttgtcagttattaataccataattcacacattaggaatctccaaatctccaaaaaaaaacaaaaaggccttctttgttcttctgcccccttatcacgctgatcccagataaaaagcctaggtaagcactgagtgaaaaataaatctggccacaagatacatgaaaaaatattcaacatcgataatagtatgggaaatgcaaattaaaaccacagtgaaatattacctcacatctgttaaatagttattatcaaaaagataaaaaatagcaagtgttggtgaggatatagagaaaagggaacccttacacactgttggaaggagtgtaaattagtacagttattatggaaaacagtacggaggttgctcaaacaattaaaaatactcaggtatggtggctcatgcctgtaatccccacactttgggaggcccaggagggaggatcacttgagcccaggagtttgagaccagcctgagcaacatagtaagactcctagctctacaaaaaataacaatattttaaaaattagctgggcatggtgctgtgtgactgtggtcccagctactcaagaggctgaggtagtaggactgcttgagctcaggaggtcgagactgcagtgacagtgcactccagcctgggcaacagagcgagaccctgtctcaaaagaaaaaaaaaaaaaagaactacctatatgatccaactatcccactactaggtatatatccaaagaaaagggaatcaatatctcaaagcgatatatgtgctcacatgttcattgcagcattattcacagtagtcaaagatatggaatcaacttaagtgtctatcaacagatgaatgaataaagaaaatgtggtatacatacacaattgaatactattcagcctttaaaaaaaaaaaaagaggatgggcaccgaggctcacgcctgtaatcccagcattataggaggctgaggcgggtgggtcacttgaggtcaggagttcaagaccagcctaaccagcatgatgaaatccctattaaatatattaaaaaagttagctgggcatggtggtgcatgcctgtagtcccagctactcaggaggctgaggcagaacagcttgaacccaagaggtggaggttgcagtgagctgagattgtgccattgcactccagcctgggtgacagagtgagactctgtctcaaaaaaaaaaaaaaaaaaaaaaaaaaaaaaaaaaaaaaatcctattattttcaaaaacatcaatgaacctggaagacatgatattaaattaaataagccaagaagagaatgatctcacttatacatggaatcttaaaaaactgaaactcacagaagcagagggtgaatggtggttatcagggactagcaggtgagaaggattgaggagatggtcaaaggacataaaacttcagttagccaaaagaaaaagttcaagagaactattgtatgtcatggggactatagttaaaaataatatactgtattcttgaaaagcactaaaagagtagattttaagtgttctcagtatacaaaatcagtaagttaatgtatatgttattcagctagattagctatttctcaatgtatacatatttcaaaacattatgttgtacatgataaacacacataaattttatttgtcaattaaaaataaaaatctttaaacaaaagaaaaacaaatctactggtttgtcaagttctttgggggaaatggttataaatatttgaaatataaataaaggagaaaaaacagaaacacatggtagcaaaagtaaataagttactgtcagttctgtgaagatacattatcctccagatattcgttttacataaacaaaagtggtagagcaacactgaacactattaggctttcctagtgcagctgcatcaatattttaatgtttacttagattgaccataatagttcctctttttctaactttttcacatttattatctctgaccatttctaaatactatgaacaatgacctaaaaaagcatttttgctgaatcaaaaagtcagtgtgactaattcaaattatagaaagaaaatggtcatccataaaattaagagttacctaagatcatacatagctaatgaatggcaaagatataaaaccaggtctctttaccccattactgaggaaactatgtcaaaacaggaaagaagcacaactttagtcatgtttccctggtcaacagcgccacaagcaaagtccctgttgctcccacctgtcaaatcagtcaacaccattcacatcaactaagtaaattattgtgctttacttacagggtgtattacacgagatgggctctttccaattgccaaactatatgcagactcatttgagctacttcataaagaaaatttagtataagaaaatgtgggggaatatgaaaatataagaaaaatctccacaatcaggcttcactgacaactgcagcactggccaggataaaataaaattggttcccaataggaaggaattctggttgattattgtcaaaatttagcttcccaactctgcccctattatgactgtagttttattttactctccacaataactactctctttctactacatgatttctactgtcctgcagcttctgcttactacattctctgatatctcacattgaaattccctaagaaagataagattgatttaattcatcatttacagagctattggacagagttcctgggccaggccaagctataagccactggcctacctatatatcactgatgccagttcctggtccaggtaattgtggcaaagaagaatggcttcataacaaagcataacaactgatacaagcccttgaagccgcattagtcagaaatgagctatggttgtagcttccactaagagcactgtttgcccatatacatttggattataaaccaaaatcctcattagataaattcagacttaaaaatctggcctaccctctccagggtatagtctcatactgtcacccctatacacaatactcctttcacagcagatccaaaacagcaatctcatctcacaccagcccccataatttctactcctgacctggaaaacgtaatagcatctctctcatcaaaatcttttctctaaattgaaattttcctttgacccagtatttatcccatatttatcctataacgaagtctgacacaagaattatgctagacgaaactattcagatgaaagataattatttattatagaagaatgattgtactaactggtacatccaaacacttcctagtaaaaatacaggtaaattttactgatcaccatttattaattattcaccacgtcaggcactgagctaagcacttgacaggaaacatcacgcattagcaaactcaggcccagaaaggttaagttcttatccaagatcacatctaataaatagcacaactgaaattcaaactctatctctgtgatgccaaagttcatgtttttaacaattatcccatactgtcaatgactgcaaagtacaatcatcaacaggattttatagcattgactaatcctacctctttccccacaaaaaaatcttccaatgtgctctaatgcaatgattcccaaaacactatgcagtgagatatcatacagtaagaaagttctatgaccaaataggcataagaaatgttacaggccaggctcagtggctcacgcctgcaatcccaacactttgagaggcctaagtgggaggaccacttgagctcagaagttcaggatcacctattatcagtagaaaccttgtatctactaaaaattaaaattaaaaaaataggcatggttgtgtgtgcctccactctcagctactcagaaggctaaggtgagaagatcacctgagcccaggaagtagaggctgcagtgaaatacgatagcatcactgcactccagcctgggtgacagagtgaggccttgcctcaaaaaaaaaaaaaaaaaaaaaaaaaagaaatgctgtactaaaaagagcttggtcaggcacagtggctcacgcctataatcccagcactttgggaggccgaggtgggtggatcacttgagcccaggaatacgagaccaacctgggcaacatggtgaaactctgtctctataaaaactagaaaaattagccaggagaggcaggaggactgcttgagcccaggaggcagaggttgcagtgaaacgagatcgcgccagtgcactccagcctgggtgatagagcaagactgtctcaaaaaaataaaaataagtaaaaataaatttaaaacagagctcaaacttctatattgtaggacatatcagaatttttaacatgccaatccaaactatgaatctctaagaggtataaatacacacacatacacacacacacacacacacacacacacttttttttttttttgagacaggatctccctctgtcacctgggctagaatgagtggtgcgatcaaacctcattgcatcctcaaactcctgggcttaagcaatcctcatgccccagcccccagagtagctaggactataggtatgcactaccacatctagctaattttttatttttattttttaaaggtagggtctctctatgttgcccagacaggtctgaagctcccagcctcaaacaaacctcccactgtggcttcccaaagtgctgggatttacaggcataagccattgtgcccagccaagaggtaaataagtaaagatattaagcagagtttctcataattatttagctgaagttaccactcttcacaggccattgcctggaactcatgttttgtggaatgcaccttagaaaatgcttatctagtaaaaaaaaaatttcacatgaccatctttttctttgataatttcaactaaactaggacagttactaatcagtaaatcttatgattactgctcatccatacaccacttctaggtgaaaatgtcatggccacgctgagggccagtgaccatgttttggatcatgtaactttactcccattctgagataactggacagaataggcaccaaaggaatatagcccattcactacatagtctgcctcaaaaagattagttgggcaaataagatatatctttaaaaatgggaaacaaacaataaagcagagggtccagaagagccatatagtgacaatagggcagcagatggaaatcacaaaggagtaagaaactactaataagcaaaggaacagagcaaaggccaacagaaaaaatgaggggcagggaacagagaaggcatagagaaaagtaagagatggactctgttcacatttggagctagttgtagctcctgggaacctagtccttggacttctatgagatctttattgtacccttataatattgtacccctttggatttaactagcttgagaagttgtcttttccttgcaaccaacactatttaaattcacacaaggagagtttaatttccttgtgtgaaatgaagtagtacaagtcaggtgttaagagcacaggttgtagagttagaatacttgtaattaagcccacatcttttattgttaagatgcaaaatttggggaaagttaactaaagcctccaattcccatgtataaaatggaaatgaaagtatctccacctcagtaaggctgcaaggattaaatgagctgtctgtaaagtgctctgtacatagaaagcactgaataaatgttagctattattactactaatttgcatgcatttcttttctctcactcaacaggaaaaccttgtccttagaacctaactaagaaaaaagaaaaatcctatttctagatgtaaacatctgataaatattgcttttcaaaaaatgtattagtacactgtagccacaaggccttagccacagggaatccctcaccctttgtactttttatagaactaataatattaaatactctgaaaatatgtttgatcttaacaaaataattcttccaaaacaggataaaaatgttacatcaacaccagatataccttatctaaagcatcaacatttttagagattccgaaacataacatattttaaagggcaacaaaataagcctactttataaaataaaaaataattttttattttgagattattatatttggaataaacatgcagacctactataataacaaaaaatttaaaagaaaaaatagtagcttctcttgaggacttttaataacacacaatttcaaatccaaaaacaagtgatctcactaccatttattagctgattttaacccaactaatgcctgaatcatattaatttcactccatatattcgaatagttatttgcttactaggaacaatttatacttaagaaatttatctacatcattctctgatttggatagtttgggttctcctgcctgacagcaaaatagttattcagatcagctttagaaataatataaaaaattttaaaaggccacaatagtttttaatttgcccccaacccataatgtgttaataaaattagaagtctgcattatttgtatttcaataagactattactcatctttcataagtaattatgtccactaagggcacattttggcatatgcaaagaagagccaatatctgcagagcacaatgccacacacctgtaatcccagcactttgggaggccaaggcaggaggatcacttgaggccaggagttcaagaccagcctgggcaacatagtaagaccccatctctacaaaaaaaatttacaggtcgggcacggtggctcacgcctgtaatcctagcactttgggaggccaaggcgggcagatcacgaggtcaggagatggagaccatcctggctaacaggatgaaaccccctctctactaaaaatacaaaaaattagctgggcgtggtggcgggcacctgtagtcccagctactcaggagaatggtgtgaacccaggaggcagagcttgcagtgagccgagattgcgccactgcactccagcctgggcaacagagcgagattccatctcaaaaaaaaaaaaaaaaaagattttaaaaattagatgggcgaggtggtgtgcacccgtagtcccatctactcaggaggttaagacaggaggattgcttgagcccaggagtctgacattgcagtagctgtgattgtgccactgcactccagcttaggcaacagagagaccctgcctcaaaaaagaaaagaaagaaggggagggagggagggagagagggagaaaagaaaaaaaaatagccaatatttaagcaccactacgtaagtagtaacaactctgtaataaaatggcaatccaattataaaataggcaaatgatctgaacagacccttcaccaaagagcagaagaaaaaaactgatcaacatcattaatcagcagagaaaactagaaattaaaatcacaatgagatactagtacatatacctcaaaatggctaaaatcaaaaagactgacgatgccaaatactgatgagattatagagtaactgaaattctctttttgttgtagttgttttgattttgaaacagtatctcactctgtcacccaggctggagtgcagtggtaccatctttgctcactgcaacctccacctcctgggctcaagcaatcctcccgtctcaacttaccgggtagtggggactacaagcacatgccaccatacccaacttatttttatattttttgtggagagcgggttttgccatgttgcccaagctggtctgaaactcctaggctcaggtgatctgcccaccttggccccccaaagtgctgggattacaggcgtgagccactgtgcccagccaactgcaattctcatacattgtcggtggagacataagatggtataccactttgggaaaagatgtggtcgtttcttataaaactaagcatacacccacctataacccaaaaattcaactgctaggtatttacccaaaagaaattaaaaactacactcacaaaaacacttataagaatattcatagcagtttattcattattgccaaacactggaaacagtccgggtattcatcaatagaatggatatgcaaacttgttgattcacataatggaatatcattcagcaaaaaagggaacaaacttctaacaaacataataatgtggatatacttcaaaaacatgctgagtgaaagaagccttacataaagaaatatgtgctatatgattccatttctatgatgttctagaataggaaaaattaatctatggcagacaaaaaaatcagaacagtgactgcctctgggaggacagggcaggaagtgactcagaaggggcataatatactgtatcttaatacatgtttaaattacaaagatgtgtaaaattccaggaatgtaaatttaagatttatttcattatatgtgaacattgcatcaaaagaaaaaaaaagtccccaaaattgcattatggttaattatatgcatgccaaactagtttgggggaagatactggtatcaataatttactgtgaaatacatccaaaaaaagatagattagtggatgatataggaatcaacagatggagtaatatatgataaaacaggtataataaaatgttaattgtacaaagtgtaggtagtactatacaggcgtttggtataaattctttcaacttcgttgtatttgaaatttttcataatcaaatgttgtagaggaaaaaaagcctcatccaatccttcaaagtgcaactcaaaataaactacttccatgagccctttcctgtcaccctcagccttctgaacctagtcttactgtctagagcactcacctggcaatatgataattatctttccacagacatctcatccttataaaatagactataagcctcttaggggctgctctctgatgcgagggtagaaaagagtttagtgatctgtttattatgctttctatgtatgtataaattattttattttataaaccgtaacttccaaaagacaactgtcagtcaactaaaatgtaaatacatagatgtatatgcatacactacacacacacattgaaagctaaaaacttttaaccaagtatccttgatttttttgagtccttgattaatgaaatatcctatacctgctgaattcaacttaatagttcatctatgcaaaaataattggttgatgctttctctaaatgttctgcaaagagctatgacaccagaggtctcagattctttacctgaggataaaaggatcctcagggagtctataattttactaccatataagacgaaaaaaaaacttgcattaacaagtaatgacattctttaaaattaataaatattttatcagtgttcaatacaacatttaatcctaaagaaattgtactacttccctgttttaaaaaattatatacaatatacatttagaatcttaaaatctcctccttatagataccttctttctatacctattgaaggccaattgataaatcattcaagaatcttctgttatccttttaaataaaaaaaatcagcacaataaatcaacatttcagacaaaagaaaataagcacattattcatattttatatggttttaataataattacacatttttatcccccaaagaaaaattatgaagctggaagtatcagatatagtaaaaattcaagtttttttttaatttgtgtgaattataatgacataatgctggaagaaaccacactttactttctgtttagaggggttgccctgacttccatgtatgaatgatcaagagaatgaattacagtcttcttaaaaccttaatgataactatggttaattcaagctacaataggttaattactagtatcaagagacatgcagtaacttctactagaataaactctgacctttaaataagtcagagactcttactactaataagtacctaattaaacattaggttccttatttataaagtgaagggtttgtataaaatctctgctgtacttaagaatagaagcctttggctacattagagaatactcaactccattcacccggaaaaatgacatagaagaatataccatatcaaatgaaaactttatcctggctgaaattaaactctctggaatatattaaacacatttgaacatccttacggaaaaggtgaggaaacacttgaacagtccaaattatccacttaaaaacgaaaaaacaacaatatccaaaaatcccatcattcaagcattatctgaggaaaattatccaaacaggtcttaacaataacctgataactacaaaaatattcatgatttataaagttaatattaaaaaataagaactacaagataatccaaggtgcttatgtgaatgtgcttctgccttaggtaaagcttactaaggaatatttgtcaacagcaggcagcttggagatcttcaagctttacatcatcaaattccaagatggttttactgccaaactgccctctttatagctcttgagtattccttataatggggaaggaatgctcagcaaccataatcttcctcccactcctatcagtaactggtacagtgatacttggtcaccttcttctctaatccaaatactcacaatacttcagggaaataaagctcagcttctcattagaaaaaatgttgagaataactgacagagttataataaagatctcacctatgtatactaaaaattcttttagggaagattatatagggagatgcatgcttgaaaagaaaatgggagcagaaggatagcatctaggctgccatcccatcttagtataattgctcattcaatattaattcaatatgtatttaccaagggtcttccatgtgccaggtattttgccaggtactacaaaaaaaatgagcagaaaacagttcctactttatttatttttttatttttgttaatttttaaaatttttattatactttaagttctgaggtacatgtgcagaacgtgcagttttgttacatagttatatacatgctacgatggtttgctgcacctatcaactcgtcacctacattaggtatttctcctaatactatccctcccctagccccccaccccccgacaggccctggtgtgtgatgctcccctccctatgtccatgtgttctcattgttcaacttccacttatgagtgagaacatgtggtgtttggttttctgttcttaggatagtttgctgagaatggtttccagcttcatccatgtccctgcaaaggacatgaacccaaccttttttaaggctgcatagtattccatggtgtctatgtgccacattttctttatccagtctattattgatggacatctgggtgggttccaattctttgctattgtgagtagtgtcgcagtaaacatacgtgtgcatgtgtctttacagcagaatgatttataatcctttgggtacatactcagtaacaggattgctaggtcaaatggtatttctagttctagatccttgaggaattgccactctgtcttccacaatggttgaactaattcaccctcccaccaacaatgtaaaagcattcctatttctccgcatcctctccagcattctgttgtttcttgactttttaatgactgccattctaactggtgtgagatggttatttcactgtggttttgatttgcatttctctaatgaccagtgatgatgagcatttttttcatatgcatgttggctgcataaatgtcttcttttgagaagtgtctgttcatatcctttgcccactttttgatggggttgtttttttcttgtaaatttaacagtttctatctttaaaagctcacagtcaagtgcagaaatcggggggggggagaggtgggggggtatcaacacagggtatctttttaaaatatgtcaatgaatatacaaacatacagtcaatataaaaaatctagagaactcaatgaaaaccacatgcagcttaaattctgtgaaacacgcctaaatattatggacttatgtgaagaacatatatgcacctatgtaaataataatagctgccttctttttgagacagggtctcgctctgttacccaggttggagtacaagtggtgcaatcatggctcaccacagcctcaacctcccaggctcaagcactcctccctcctgcctcagcctctcaagtagatgggatcacaggtgcacaccaccaggccaggctaattgtgtgtgtgtgtgtgtgcgcgcgcgcatgtgtgtgtgtgttttagagatgggggtctcattttgttgcccaggctggttttgaacttctagcctcaagtgatcctctcaccttggtctcccaaagtgctgggattacaggcatgagccatcatgcctggcagcccaacctgccattttttttagtactttttcggctaggcagaagaccttgcttatcagttcatttaatcctcataacaatcacatgaggcagctactactcatacttttatcccagatttacagaggataaactcagctctgtagttaaatgatttgtccacagccacattccaataggtggctaagcacaaactcaggttgtttgacgctagaacttaatgctacttgtgaccagtcaatcgccatgctacctcatacagaccctcactgcagaattacagaggagaggacactatttgtgcaattaaagacctctcggccaaggacagagcactgagactgtaaaggactaggagacactgatcactatggggaggggatatccctgcatgcaggacaacaggacccaggctagatacgggtaaatgcagatttcctctgctactgacactgtttagataccgtgagacattctgagtatgaagttgaagctagtagcaaactactcaaagattaaatacaaagtgacataaacattccttttaaaaaaaaattactctggtggcaatatggaactagctagagaagaatttaactgaaagcaaggaaataaagagatgtctacacttgattagttatttcctaacagctatgatgatgatgacagtgatgatgatggtgataacagaagctccaattttaacatgagggatatggaccacatttcccaggataagttttggccaaaggaaacgtagttgattttggcctttaaacggaagagggtccgggcgtggttgctcacgcctgtaatcccaacactttgggaagccgaggctggcagatggtttgaggtcaggagttcgagaccagcctggccaccacagtaaaaccccgtctctaccgaaaatataatacaaaaattagccaagtgtagtggcacatgcctttaatcccagctacttagaaggctgaggcaggagaatcgcttgaacctgggaggatgaagttgcaatgggccgagatcgtgccactgcactccagcctgggtgacagtgagactccatctcaaaaataaattaaattaaattaaattacattaaattaaattaaaaagggaagggggctatctcttcttccctacttcctccatcctcctacttggaatatagatgggatggagctgagatgctaagtacaaagctagaagcagcctggtccagatggctatacaaacccgaaactgtctacacccagactttaacttttaaagaaataagtttctatattgtttgagacacttaagtccctattactggaagccaaacctctatcctaacagagtgcactttatagtaatccgagtaagaactgataagggcctaaactatggcagtgactgtgaaaacagaggaaaaaaaagatgtgagaaaattttgagggaaaaaaaaacaacactttgaagtgaaggtgagagagaaaggagtgtggcaagtttctgacttgagcgaatggccaaggggaagaggtttgaatgagccagatatgcttgaacatgctgcattttcttttctttctttttttttgagacagggtcttactcctacttggaatatagatgggatggagctgagtggctaagtacaaagctagaagcagcctggtccagatggctatacaaacccgaaactgtctacacccagactttattcttctacaaccaaattcctcaaacacacaatctgaacagtagcagtgaaagggagtttaaggtgggggtgagggagaagggagtaatatggttttttagtaatatagtaatttacattttcaaaaatcttcagtgtttcactatcttaaatgaatatttattctgttgttcctctcatttctttcctcctgttaaaaaaatgacttttattaactccaatctcatgtggatttgggtttactcacgctaagatttggtaaaacatctgtctccaaagaaaaacaagtaacattcttttcaaattccctagaagaccgcgtaggacaagtatatgaagcatttataaaattcactccagtcccaactgctactttccactgtgaattaattttcatactattattgtccaagtttgttctgacacttgatttctctctgtaaatgttactagaattaacttaagctaggaaaaacaaaggacatagttttacctacaagcagatgtcattaactatacagatttttttttccacttaaaaacttgccacaaaaccacttattttctttaaacaagaatcttccattttaagttcttaaacctatattttaaattactataaggacagaatgtttgcttgaagaaaaaaaatagagagatgtcaagttcccaaacaatttgttttcttcaaatcatggtattagtgaaccttgtaaattattaatacagtacacaaaaagctacaatggatcaacgaaaaagatgacatttatagaatggtgtcatcagtggaaaatagccctttccagaaacaacacaaattctttctcctaactcagtctgttaggaaaatcaccaaaagcccttcaactgtctactcaataaacaatcagtaaataattgtttacttcccagtgtgtaaagcattctgctaaaaaagtagtagtctctctgttgaaaggacattttttccagtttcaaaagtttctctacggatagcatactgtgatatatttgggccatgctctcaaggaactctttttcagtctaaaaaaattagacaaatgtaaacggaaagaccttgaaattttcagaactccaattccttgtttcaaacatttctaggacacagtaaagaccaaagacaagcagcaaaatgtttcagagatgtaatctgaaggtctgatctctctgaaccagccccttagcatcttcgtcttcatgaagctatgcagtttcctctgttgtttcttaagcaatacctcattaagtgatttttttttcctaattaaaatctccctgaaggaagtaggtatactcccatactactactgagagtataaactgacacatctttctgcaaggcattttagcaatatacctcaaaactattcaaaatgttcttttggctttcagaaacagctggaaccagaagtttagataatgtttccagagctatgtctgtcttttcattttttgactatccttgcctcagcttgtgttcaatactcagagactctctaaacacagtaaggaaaacacacactggcagcctcaacttaatcacagtatcttaccttagtcatcctagtgggaaaagataggcgtgccagtttgttccaaaagaaaacacccaagctctaaccggtccagcttaaagtagagggtagggtaactaggactgaaactttccctggaaccgtagagaaaagaaggcatggttcccaaaggaagggatgccaggaagaaaattcacatatgtccatataaacatacatatccttgacccggcagttccatttctatgatgaaaatgtggcactattattgtgtaccagacactgttttactttacatgaaataactcatttaatcttcacaacatctctatgaggtagatactactatttactattatccaattttatgaatgcagaaactgagacagaaaaattaagtaacttgtctaaagccagaactactaggaggcaaaaccaagaatcaagctcagactatgtggctccatcccacactttatctatttttgtagaaatggggtcccactctgtcacctaggctagagtacagtagtgcaatcatagctcactggaacctcaaattcctggtttgaaatgatcctcccacctcagcctcccaacttgctgggattacaggagtgagccaccacatctagctcatcccacacttctaacttttctactactaaaatttactgcctctctatttgatcctgagaaattaaaaatcaatgcaaaaatctggctagaacaattcatcacagcactatttataacagcaaaaatttggaaataacaaaattatctaaccatgagattaactgataaatttatttactttaaattatatattaaaatgataaaaacattttgtagttaataaaaattgatgttatgttttatatatacaaagttgtccctggaataactcaagggttagatgcaccaacccctgtgcagtcaaaaatctacatataacttatgactccccaaaaaactttactactaatagcctactcttgaccagaagccttacagataacataaatggtagattaatacatattgttaatgtttatatgtattatataatgtattctacaataaagcagactagagaaaagaaaatgttattaataaaatcataagaaaacacagttactattaagtggaagcagatcatcacaaaggtcttcatccttattgtcctcatgttgagtaggctgaggaggaggaagaggaagggttattcttgctgtctcaagggtagcagaggcagaaaaaaatgtgtataagtggaccaacgcagttcaaatccatgttgttgaagagtcaactgtatatagaacatggaaagcttccaataacatgcagataagttttaaaaacacagcttatataaatggatagatgctataaacatgtttttaagaagtaaaatgaggacgggcgcggtggctcacgcctgtaatcccagcactttgggaggccgaggtaggcggatcacaagatcaggagattgagaccattgtggctaacacgctgaaaccccgtctctactaaaaaacggaaaaaagttagccaagcctggtggcgggggcctgtagtcccagctactggggaggctgaggcaggagaatggcgtgaacccgggaggcggaccttgcagtgagccaagattgtgccactgcactccagcctgggcgacagagcaagactctgtctcaaaaaaaaaaaaaaaaaaaaaaaaaaagtagtaaaattaattatacatatatacgtatatggatgcacacaaaaatctctggaaatacatatgttaaaatgtcagcagtatgccacttcttacccactggagtggttatgatcaaaaagacagaataacaagggagtagcaattgcaaaaccaaggacagcaatcttgattcttttttttttttttttttgaagttaagaattcttttaggttgtaatattttcatgttagtttttaatcatttacaatgttctgtgggtcacattttaaacatttttaaatatatgaaattctgtatttctttaagtacagccacaactacaaagcagagaaacgtaagaatacaaaaatcaaatctgcttcatttatatacacgatggggcagcctaatgcacatcataacattaacttttccaaagaagtttgctaagaatctgctcccataattagtgttaaaaataaagcaatcttcccatttagaaaaatcaagacatcagttgattaataaagcctattcttcctcccagcaatttgtactttctggtcttcatttaggaattataaattcatgagaaaagaacaaattttttatggaataaataacttccaggaacaacagtttataagtattcagttgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagcagttattactatttaaaattctattccttcacccagttttctcactcaagtagaaactcatgaatatctgtgattttggctataggaccaggccacaggaaagggctgaaatatctctaaaagttaggtaaaagtgttttcttgagacttgaaggcagtcattcatcactttgtgcttgaaggcattcctcagcaaacttctctcgagtcttcagagtaaagcacaggatctaggctcccggaaggggttacttccagctggaacacccaccagcagggcatccttgcaggcattctgcatacagtactgttgaagctctgcagctgcctgagagaccttgatcctctccacgccagcctccaacttgagctgctctaccaagagctgcagggcgctcgcgctagccccggaggacatggcggcggcgctgggctcctaggggctgcagcaatcttgattctttaggagaatgacaagtcgttcactgtaactaaggcttacttacttgctagttaccagttactcacacaatttccttaagtcttgcaacaatttcttcaataacttcaaacctcatgagccacaagtacaaacaaccctgggcaaacacggtgatttcaccataccatttctttaaaattattcattaaaaataaaaaataccaggccaggcacactggcttacgcctgtaatcccagcactaccaaagtgcgaactcaccagttcaagaccagccagggcaacacggcaaaaccccgtctctactaaaaatacaaaaattagccaggcatggtggcatgtgcctgtagtcccagctacttggaaggctgagattggcttgagcctgggaagcagaggctgcagtgggctgtgatgataccactgcactccagcctgggcaacagagccagaccttgtcttaaaataataataataataataacatgccgggcgcggtggctcccgcctgtaatcccagcactttgggaggcccaggtggacagatcacctgaggtcaagagttcgagagagcctggccaacatggtaaaacctcatctctactaataatacaaaaattagccaggcatggtggcacatgcctgtaatcctagctactgtggaggctgaggcaggacaattacttgaacctgggagacagaggttgcagtgagccaagatcgcgccactgcactccagcctgggtgacagagtgagactccgtctccgaaaaaaaaaataaataaataaataaataaatgaataaataaatccctggagtgagcctttttgtaacatgtaaatagaagaccgtttttagtttttgaattatttgataactaattattctgtttaattattagtagaaagaacagacccattgtacaaaagggagtcaaatgaaagggataggacaagctttcagaaatcattacttcaacttaattgcacaagttaaatcagcccaggatctagatgtttttgaactcgaattactgttttttaaaaaattgcttcaacattcatgcttactaagtaataaaaattgtatcattatttgttcagattaaaatcaaacagaaaagactacaatgaatcaattaaaaataaatatgagcacatgcttctaaagaacttatttttcttttagaagaaacagaaaatataaagcttatttagctgtgctttgatttgtgtatgaatgttatgaccatgtttctaggtaacatcaaagttttgtcaatgctaggaccatgggtggcaaacaggtacaaaaacaaagatgtcccttcccacactgctgtatgtgtgtatctcttcttcttgtgctaaattataatgtagcagaccagttagtgctgtagtttaaggccttggataagaaatggaatatctcctgaagcatagccctgatatcaatcatacagaaaagaaacagacatttggatggaaaactggaaccaggaaaatggacctcattagatagacctgacaggaataggttgtctgtcttgccaccatctagggcctagacttaaggaaacatgctgaaaggcaagatgaccttcatcatatgatggcagaccacaaactaggcagggtggaatccctttaggagactacagactgaaaaggaggaaactataccttgcaaaccagactactgacttaaaagttattctctggtttcattatctttttatttttaacctttagaaaagttttatttcactgctgcagctttgcctcagcaaataaaagtatgaatgatttggcagtgggagttaggccagaatgttaagaaaaagtggcactccatgagatcactggagaaatagaagaactggagctttgagttcaagccaatccttcccatacagaggcaggcgctccttccgctgtcaaccttggaggactagggtttcattttattaagagaattttaaagtttctgttcaggtacctagaactaaattcatcgtgacaaaatctgaagagatatgtactacattcaagagtcagcaggtttctgtagtgtttaaaattacagggttttgttttattaagggtttcattttattaagagaattagaaagtttcattttattaagagaattataaagtttcagccagagtagtcgctcacgcctataatcccatcactttgggaggccgaggcagacggatcacctgaggtcaggagttcaagaccagcctggccaacatagtgaaacactgtctctactaataatacaaaaatgagctgggagtggtggtgggcacctgtaatcccagctactcaggaggctgaggcaggagaatcgcttgaacctaggaggtggagattgcagtgagccgagattgtgccactgcactccagcctgggtgacagagcaagactccatctcaaaaaaaaaaaaaaaaaagaaagaattagaaagtttctgttcaagtacctagaaacaaattcattgtgataagatctgtagagctatgtactacattcaagagtctgcaagtttctgtaatgcttaaaatttttaacaagtatgtattactactgtaagtaaaacagtttagcacaggcacgtcagtggaagcaatatgcaaatgaatatgcagaagcatgcaccagaaatatgcagcagaaccaccaccatcctggttatgaattaaaagtaaaaactgggtagaaaaatagatgagcagagtttccaaatcacatggacacctgaactcaatagccagggagaaaggatcagtccagaaactaagtccataaggaggtaaagtcaaatgtgagtaaaacaaaacacagtttatagagaaaggagaccgagaaaagagagagaagagaaaaaaaagaaagagagaacaccagacaatcaatctgaaagcaaaggcaattaacctggttcctttgagagccagaacttttcccaaggtgttacccccatttgtgcttgtaactataaaagcacaatatggctttaaaagtctttagtggcaaaactctaaattctaagaccaaagtatatttgattctctgttggagcatcttgacgggtatgacacccatctccgcatgacttcctacttacacaagataaaactaaaatattttaagttatttgtaggatgtactgaatactgttttactattcgtgttcttagtttctacagtaaaatacatgtataccttacaaaactaaaattgctttttacttacatgacttttcattaacttgtattctacggtttaacattctttcattaatttaaaaaaaaaaaaaaaagtatcccaatcctcctcatttccaaggctgcaacagaatcttaaaacaaaacaaaaaaaccaatacactagaaggagtaaaacaaaaactgcttcttggggaacaattcattgtttcaaaataaatattttaacaaaaaattctataggctctatccatttttaatcatacctaccagtgagagtctactaggtgacttcttaagtcaacatttaagagtggggaaaaaaatgtgatgtttcattgctgtctctaaatttatgtggtattcataacactacagattacaacatgctatacaggtttcaacatttgaaaattctctggagttgtaatcatagttaaaagcaaagcattaaattcaagaagcttgaaaaaaagcaatgttttctgagaatgatcttttaacagtggtcaatttgcatagttttttactttctacaaaatactttactgatgaggggaaaaattattttctaccataattaggaatctggacttaacctgttatgccaaaaacagcaaccatactttgcaacaaaaaaaattttcaaaagcattttcaatcttcctgactaccaaagtttccactaccaaaagtgaaaacacttttaaaccttcctgtgtaacaagttttaaattttcttttatttatttgtatcaattttctcacctgtggctgccaaaatatcaagaatttcaactccagagaaggaggacagaagaaacacaatgtaaagtggttggcctagtaaaatagttggaaaaaaaactgttttggctgctctaatataatcttcatttattactcattagttctcttcttatggtcccaatattccagccaaattgagaatctactcactgtttatcaattcagtgcctttgccactactcatctccacctcccagtccccacaatgtatttatagacaaaagttttgatttaaagccagaaaactgggttcaagtttcatttaatcccttttaattccattcatgatcagtatgaacatggacaaattattttacctttatgcaccttcaaggataactcagtgtaaccatgaagagtcaatgcaataatgtgaacacactcaatttttttaaatgaatgaagattcaatctgatagtctctgcttgtaaaacaagtgtatagagaaatgtaggctgtgacactagatcccaagaaagtatctactggttgttatcaatataataatatggagaaaacaggtggcactagtaatttaaagttagaacaaggaacacaacacaaatttaagcctttcttaaaactgtgtaaaacaggctcggtacaatggctcatgcctgtaatatcagcactttgggaggccaaggcaggaggattccttgaggccaggggttccaggccagcctggtgaacatagggagaccccatctctacaaaaaactttaaaaagatagtgccactgcactcctgcctgggcaacagagcgagaccccatctcaaaaaaaaaaaaaaaaaaaaaaaaggcctgtaatctcagcactttgggaggccaaggcgggcagatcgcttgagcccgggagtttgagaccagcctaggcatcacaaagactctgtctctaaacaaacaaacaaaaaatcatgcaaagctatgtatctgtcttccaaggaattctgaattttctacagcttatttttcaatgaagtatttagagtggatgctgatttaacttgtaatgttgtgggagtgattcctatttcatatgtttggctttttgaataattttgtttgttgcaaaattgtttttaaaaaattaagcctatttagcactgttctatccagatagatttcctaatatttacaaactactattattataataactgcatgaaccattgtgtttgtggtgagttgaatagcgttgtccaaaaattcacgtccatcagaatctcataatgtgactttatttggaaacagggtctttgcagatatagttaaggatcttctgatgaaaattatcatggatttagggtgagccctaaatccaatgattagcatctttataaaagaaaagaaagggagatttggacacagtaacagagaatgcggccatgtgatgacagagaaagagatcagagttatgctaccaccaatcaaggagcccctggggccaccagatgctggaagagggaaaggaaggatccttccctaaatccttcagagagactgaggccctcctgtcaccttaacttcagacttctagtctccagaattgtgagagaatggtgtttgttttaaatcacgagtttgtagtaatttgttatggcaaccccaagaaactagcagagtgttggagcttaactaagcactattgtttaaacattttaaagtgagaattctctgtacttccctgcaatagtattaattttcccaaaagacccaaacttttttatcttcttagttaacaatctttttgttcctatactctagatcaatctatactgtttgaaattcatttaaacttaagcagttatgtgaaatatttccctaggcaaaattagtttttaattttctttcaagtaaacaatgaaacctacagctataactaaaaacttatgaaaaattttatgatgaagacattgataagtatatgggaaaataaaattatcaacttataaaagttatatttgccttcgcaatgtaaattatggtaataacaattttaaataaataacttttactcaataaacaactgcataaccaaccccaaaaatttcgagagctcagcaataataggatattaaatcttataatatttaatgatctcagttctgaccataataatgttttaaaattaagaaatactggcagggcgcagaggctcatgtctgtaatcccagcactttgggaggccaaggcgggtggattacctgaggtcaggagtttgagatcagtccggccaacatggtgaaaccctgtctctactaaaaatacaaaaatattagccgggcatggtggcaggcgcctgtaatcccagctacttgggaggttgaggcaggagaatagcttgaatcggggaggcagaggttgcagtgagctgagaccgagccccattgcactccagcctgggcaacaagaacgaaactccatctcaataaaaaaaaaaaaaaaagaaatacaattccagcaacacaatgatttaatcaatgccttcactttcctaacagtttttaataaaaatgatctttatcatattgggcataacaacctataatatacaaattaacctacaattaggaaataaaactattcaaaaagttatttcaaggctgggcgcaatggcttaatctcagcgctttgggtggccgaggtgaaagaatggctgaggccatgagtttgaggctgcagtgagctatgatcgcacttctgcaggcattccagcctgggcaacagaacaagacccggtcttgtattaaaaaaaaaaaaaaaaaaaaaaaagccaggcgtggtggctcatgcctgtaatctcagcactttgggaggctgaagtgggtggatcacctgatgtcaggagtttaagaccaacctggccaacatggtgaaaccccatctctactaaaaatacaaaaacttagccgggcatggtggcaggtgcctgtaatcccagctactagggagactgaggcaggagaattgcttgaacccgggagacggaggttgtagtgagctgaggtcgcaccattgcactccagcctgggcaacaagagcgagactccatctcaaaaaaaaaaaaaaaagttatttcaagaggttaggtctcttggaattcattatttagatactagtacctaaaatttaaaagcttaccctgaaacttcttggcacatatcaccactatcttttcctaatacctccctgtctgttagtgctaagtttacctgtagatttccagttctattatatgcctacgtgacctgtcacctcccacagtgtccttacacctgatcagtgatatgtttttttgtgtttgtttttgagacagagtctccctctgtcacccaggctggggtgcaatggcacaatctcagctcactgcaagctccacctcccgggttcaagtgattctactgcctcagcctcctgagtagctggaattacaggcacgcaccaccacgcctggctaattttggtattgttagtagagacaggggtttcaccatgtttgtcaggctggtctcgaacttctgacctcatgatccgcccacctcggcctcccaaagtgctgggattacaggcgtgagccaccacgcctggccgatcagtgatgttttaatgtgcatcattatagaacacagttttcagtatcgtttatctgaaatgtttggcatcagaattgtttcaggattcttttggatttttaagtatttgcattatacttactggttgagcatccctaattcaaaaatccgaaatccaaaatgctctaatgagcatttcctttgaatgtcatatcagtgctcaaaaagtttcagatttcagagtatttcagattttcagattagggatactcaacctgtatctccaagattaacgaaatgacaattttagtttccaaagtacatactctttagaagggatgactaagagctggactgatatatttgtatcccaaatacatgtgcttgagacccccacaacataaggaactttattcctatacatactatccccactttctccagcatcaactgttctcattccattgatttccactcttctacctttaaaatggtcacatctattccatacatttttaaaaactctcactggatcttactaagtctgcaatttaattcaacaaacatgttactgagagcaataataagccaggcaactctgggatacaaaaaatagtctttttaccctgaagaataggcattcaaagttttccaaccagatactcttacctctcaaaatcagattactgaaacaaatcatcttaatatgctgcctctacttcttattctttatcctactaaaattctgcaatatggtttacaatacaacattccagctgaaacaatctgggctaaaactacccttgatacagcatggtgtactgcagtatgggcatgagaaaacttctattacaagatttgccactcaatagctgtgtaactactcacaggtaacaactggggattgggggtgggggaggcgggcagccttcactggtttctccttacccaaaaattggacagatatagattatgtgtacagttaactttcggccctaaagttttatgaaatgcaaagcttttcattaactccttatctcactgatcgctatctgccacacctgacactaagaaatattccttcactttctatgacttttctgatctcgccttcttctgtgtatctggattcagattacccacatgaagcaataaactcagatttataatggtttaaacatgtaagattatagcctttcatgtcaaaataaataaataatttaaaaattcatattaaaataataaaataaatccagagggtagctatccaggtctgctatgacaatcccactataagtcattagggactcaggttctttctagctttttgctctgatatacctagggtttgggccttacctacttggcccaagatggctgctggggctgcagccttcatatcagaatgccagtcttaggaaaaagaaaagctaggaaggcataccctcatcctttaagaacacttataggatactgcattcatcatttccacttacatccaactgaccagaacttattcacatgtttatagctgtcagaaacttgaaacagtctctcttatgcatgtccacatgattattcaaaaccatcaaggagaagaatcgccatggaggagaaccaaatgtctcttccaaactctccaaacccttctgtggttccttttcttttacatcctcttaccaatagtgttccccaaagcttggttctcggtactttattcttctgtctctatgccaacttcttgggaacacctacacaatttcacaactctatatactctaatgactctcaagtctttgtacccagtccctacctgtcccatcttttgaagtctccacttggatagctgcaaaataaacaccattctatgtcaatcccacaaacacaaatgagtaactttaaaagaaaaacattctcaatcttccaatttaagtcataacatcacaagtacccccagacctccaggtctgcaattttgaagttgcctctgactcctctttccattttcaacaagccatgagttgcaggtcatattgaacttctaaaaagaaatgaaacaaactagactacatgaggtttatacagcatatgacttggggcatgtattcatcaaaatgactatggcccccacaactctactataatgttcgaaagttatcctaattattaaatccataagcctatttttagtccttattatacatgacattttcagcacatttgacatttgttatttcctcctccttgaaattctatatacccagggttttccatgataccatatcatgctatcttggttcttttgcaatacctctgactactcctatttagtttccaggctgccactgctttatctaccttttgaatattgatttttctctgagtacaattctgaggccactctttttttcactcttgcacatttcctaggcaatctcacatttttcttcatatttgacaatcagctggctactgacaattgccaagttaaatctcacttttctccttacctcctgactcacatgtctaaacacctaaatgacatctctaccttgattatagaccatcacctttcactcagcatttccttccctcatccaaattcatttcttctcctgaattccctatttgtatccatagcatcatgacacatattacctctcatccactctttctactttacccctcacattcattcattactaaattttactaatctgaactttcaaatttctctagcatccataccttccttgccatttccaccataaaaacgtttgagctttctcatactggtctttctcccttcagttcattgccatttgagtcacatttctatgttgtttcttgctttttaagagctaccatttttcaacagaccccaccatctatagagtcaaggctcaccatctatagagtcaaggctaaattctatagcctgatatacagagcttttcacaattgtcaacccactcaagcatcaaagcctacctcagtttccatctactttcacttctctccattcctgtaacaagacattcacatacacacatttttcctctatgcctataatctcctctatcctctttttcacatagcaaatgtttatgcataccatacaaattggtttaaatatcacctctcataagaagtcttctctttttccctcagtaaaatggatccatcctcttgaaataagcaatttatcattacttatttcaagaccttatccactaatgactaggttagggatagagttttaatctttactcatttgtatctagcctagcacttagcacaatgcctggaaagcaataaataactgtcaaatcagtgaatcccaaatggttcttgacaggtggcaacaaacagcaactagaaaataccaactacttcaggggagaaaactcaggctatgtattacaatggtttaacaataatcaattatcaatttttacaatgtctcaaaatgtggtatttcaggtgttatacataaatttacattctagcttgtctctctcatagtgcttaaataaaactgattaaatgcctaagaaacatgtcgaatgttctctaacatacttaaacagactgatatgaaaaaaaacaagaacttcaaataattaacataattgactccagatgaaataccaccaagatacatgaattataaatgtattaatggacagaagaaataaaaaaaagtaaaggcatataaaattaacacaggtagtcattatcaatttttctggacaaatctcagtaaaagaaagtaaaaacaataagaaaaatatagttggctaaataacttcacatattagaagctaatgatatttcttaattattctgccatagttcacaggcaaagtcagaaaaataaagtcttaatttcaaattatcaaaatcaaactatcataaaaatcagtggttttcaagctatgttctcctcagcataacagcactataagaacacaaaactggaaacaaggtccaatagtaaagtgactaagttaaaatgaaacactcaaatgatataataatacagccactggacattatgtttttctaaaattttataaaataacttatgtcattaatagcttttaaaaagatagtaagggtatctttctatcttccttatagctttttaaattaaacttttaattttgagatagttgcagatttacacacaattgtaagaattaatacagaaaccatataccctttacccagttccctccactggtgacgtcttgcaaaattaaattacaaaatcaccaccaggatatcatacaatccaccaatctcattcacatttcctcagttttacctatactcatttgtggttgtatgtgtgtatttagttctatgcaattttatcacacatgaagatatatgtatccaccacccagtcaaaatataaaacaattttatcaccacaaaaattcctcccaattacccttttataaccacatccacctcccaccctccttttttatagctttttcccccatattttcaacaactgtgtgttcattccatgtatcttccttaactacctatgatgtaccaggcacccttctttctatataattcaaatagcatgcattaactcttttttccagtttgtaaaagaaatttttcaaaagacaaggggtttttgcttttgtttttgagacgggatcttgttccattacccaggctggagtttgttccgttacccaggctggagtacaatggcaaaaacacagctcactgcagcctcgacctcctgggctcaagtaatgctcccacctcaacctcccaagcagctgggactacaggcatgcatcatcacacctggctaattcatttttatgtttttttaatttttagtagagacaaggtctcactatgttgcctagactggtctcaaattcctgggcacaagtgataacccacctcagcctcccaattacaggtgtgagccaactgcacccagctgacaagagttttttttttttaatccaattataaaatataaatatttaaaaattcaactgcaagtattgttaattgaaaagacactttaggaacaaaaataaagagtgtatcatttggccagtgaggtgactcacggctgtaatcccagtgctttgggaagttcaggcaaaaggactgcttgaggccaggagttcaacaccagcctgggtaacatggtgaaaccccatctctacaaaaaataagaaaattagccaggcatggtggcgtgcacctgtagtcccagctactcggcaggctgaggtgggaagatgaactgagcctgggagatcaaggcttcagtaaactgtgattgtgcgactgccttcctgcctggtcaacagagtgagacgaaaggaaaggaaaaagagaagggaaggcaagagaaggaagagaggggagaggggaggaaaaagggagggagggacagactttctagaattagaaaaaaaaaaaatctcaataatactgaggcaggagaataggacctggtggcagggaacctaaggacttcctagaactaaatcaaacagaaaaaccccaactttctacatccaagtaaataattgtgtaatttcccttcagctatgtcaggaaacatcctctttatttgcatagggtgtacaccaagtaaataactttgtaacttcacttcatcctcttcatttacataaggcatacactgcataaccaatgggaatcctctagagggtatttaaaccccagaaaattctgtaaccagcactctcaagctgcttgctcaagcccattcccaccctgtggagtgtactttcatttcaataaatctgtaattttctgtcattgctttgtttgtgcattttgtccaattctttcttcaaaacaccaagaacctggacaccctccaccaataacagtaagaagtcaaacaacccaataaaaaagagcacaaatttgatcagacactttacaaaaaaatacacaaatggcaacaagcacccgaaaaggtgttcagcattattagtcaccaggaaaacgcaaattaaaaccacaaatgaggtatgttaagagagtagatcttttttttggagaaaaaagcctgttgcccaggctggtctcaaactcctggactcaagcaatccacccacctcagcctcccatagtgatgggattacaggcgtgagctaccacgcccagccaaaagagattttaaatttcttcacataaacacgcacacgcacacacacacacacacacacacacacacggtaactatgtgaagtgatggatatgttaattaccttgactgtggtaatcatttcacaatgtatacataaaacatcacgctgtccaccataaatatatatgatttttatttgtaaattatatctcaataaagctagaggaagtttttgttctttggtttttttttttttgagacagtcttgctctgtcgccaggctgtagtgcagttgtgcgatctcggctcactgcgatctcggctcactgcaatctctgcctcctgagttcaagccattctcctgcctcagcctcccacgtagctgggattacaggtgcacgccaccacactcagctaatttttgtatttttaggagagacggggtttcaccatgttggccaggatggtctcgttctcctgacctcgtgatccacccaccttggcctcccaaagtggtgagattataagtgtgagccacggcacccagcctgtttttgttttttgtttttttgtctttttagtgaaggcaagtttattagagaagttaacaaaaaatggctactccacaggcagagcaaccaaaaatatttttaagtaataaattaaatttaaaaagaataactgaaactctcatacattgctagtgaaaatgtaaaatggcacagccaattagaaaagtttgtcagtctcacacaaataagacacttatgacctagcaattcttctcctacgtatttacccaagagaaataaaaacatgaacatgaaaacattcaaagatctgtatgcaaatgttcagaacaattatgttcaccatagcccaaaactagaaattcaagtgtccttcaactggtgaatggataaatcgtatcatactaagcaataaaaaggaacaactgccaataaattcaacatagataaatctcaactgtatgatcctaagtgaaaaaagttagacacaaaaaactgtatactatttatatgacattctagaaaagacaaaaacatacagacagaaaacagatcagtgactgccagatgctagaaagggaactgactacaaagaggcatgagagaactttttggaagcatgaaaatgttccctatctatctatctatctacctatttttagaaacagagtctcaatctgtcactcaggctggaatacagtagagtgatcatgactcactgcagcttcgaactcctaggttcaagcagtcctcccatcttagcatccgaagtagctggaactacagacatgtgtcaccacgccaggctatttttttttttcaaagatggggctcaccatgtggcacaggctggtctcaaactcctggtctaaagcaatcctccagcctcagcctcccaaagcattgccattatagatatgagccacagcggccagccctatatctatatcttgattgcagtagtggctacactaatgtatgtatttgtcaaaactcactgaaatgttcacttaaaagagtaaattttattgcatgtaatttatactttattagatattgttatgggatctttagggtgtcacttttctggccagaaacctgtggctggtggcacctctgcctgagttttgctcagacctgctagcctcattcccacccactcggccttgtaggctacactcagctcacgctaccagcctggatcccatgcctccaagaaagactggagtcaggcgtggagtggtgaggggtgtgtaagcgagcgtacagtctggccattgcccagtcagacatgtcagctgctgccacagggtgggcagctccaggtgctggcataagtgccagctctctgcgaggctgtggctggaccagttgcaccacaaacagcttccccggccggcaccggggaatgtagtggcactcagaagcttgaagatgccaggaaccacagggccccaaagaaggagtcacagccctagcttggggagctcccaggtctgggctcccagaagggccacagctcttatctcccttccttcacctgcaacatggtgagcaaggggcatgtttcagctctgcttgtgttagagctcttttaccctcaccattcaagggtcccaagttcttgttctgtgaccaggaagaatgaggtcctcagacaacaaatggagggtgagcaagacaaagaggaactttactgagcaatagaacagctcaaagacccacagtggacagctcttctctgtagcaagggtatcctgatgagtgttcagctcctagcagagagggtagctcctttatgcaggcaggtcaccccagcaagtattttctcagcagtgagagtggctcctctctgcagctggtcatcccaacaggtgttcagctatcagcagagagggcagctcctctctgcagctggttgtcctgctgtctgcagctctcagcagagaggtcctagactagaatgggtggctcctctctgcaggcagattgtcccatcatctcttcagctctcagcagagaggaggccctacagtgggaagctcctctctttaggcaggttgtcccatcatctctgcatctatcagcagagagggtaactcctctctgtaactggttgtcccatcatctctccatcctctgctctgctctgggctgagcctgcaacttttatgggcctcagaggggacaaagtgcacaccaattgtccataggtgggcccagaaaaggtaccacaagtcctcgctctagtccataggactggcagctgggcccccagtcttcaagccctccccggcctgaaggtggggcctcaccagagacctgcccccttccgccatccacgacgcccaggcttctcgcttcaaggggtacctgcaggccagcaccaaacctccctcaaacccctcccacggtgcttgtcagggcccaaagtccagagggggctgaggaggcaggggcccagtgtgtcagcgctgacctaagtgtgtacacacccgggggcgctgtgacagcaccctggcttggccccaaccccgctccgagattggagcaggcgcctccaagcctacaagggcaggagggatgccttccctggcccctgagagtgcaaagaggccttggtccacagccccagcttgggcagctgcagctgtgtggggtgggggggcctcctgctcgtggccccttagaacacagggagaactgggtccacagctctgacttgggtggctgcagcacacccaggagggcggggctgctgcctgctccagccaggtccgtggagtgtgcagccctagccatgccccctcgtagcctggagcaggggctccaggtcctcgctgggcccaggccagtatctagggcagaggtaacatctctacgagctccccctcacccagcttgtggccctgcctaggggggtgcctccaggagcagactgtgggccctgggcccagcccttgggagtgtcaggcctggcaatcaccctgatgcagggtggaccccagggatgcggccctaggcggccctgctcagagcctacccctgaggcacaggaacccggtgccctcggcagggtgggtgtggtgaccacgctgctggctgggtccctgaagcaggcactgctcccacttccggccccagacccccatatcacacctccagctccgcctcctcctcacaccctccccgcagcattggtgggcaagagtggtgacacagggccagggtcaggagctggggaggctccgggcctgagggcaggtcctgcccagaggcacaagggcgggggcagtacagtcggctgcctcagggatgcagggcacaggggacccaccagcatcattgctgctcccatagccgctcctgacaccaccgcccgcacctcttcgctgccatcaacatgacaaaagaagaattatcccaagttaaaaagttatacatttcactgttgacattctacaatttatacaagcttctggattgtattacttaaaaaattaatcttccttctccttcccttttcctgctgtgagaagagcagttgtcatggtacccctggggtggaggtggatccctggggtggagcttgtcatattgtcatagaccaagagagctagggaaggagtctgtgtggtaggggaagaggcaaacattttgcttcagagcccaagcattaaggcaggagggggaaactggcaaagggcactggggtacaacagagtgagaaggatatcttccaatggaagcaactcactggggtgtgtcagagtctgagtggggtacgaagtgtgtccaccgacagtggggagaccaacatgaggagtcataaccagagtgctggggagggtgtccctgtatggaagcatgctggtatggactcttagatccagactggggtagggggatggaggagatggaatgaagaatccaagtcccagcagggagaggagtagatggtagtgaagatgggagactgaacaataagtaaatacattcaggataacagaagccagatttctcactgtcagagaagaacgttacaatatgaaaaaggagaacactagaatagatcctggactatttgactgaaattggaggtatcagtatgaattcatagttttcaatatacagagataataaataaatatagatataaatgcatatgtatgtttatgcatacatacctatacttaccagccctgaccattaacaggacctggaaggagtaacagcccaacagcaataaacacactagccttgagatcttagcttctaaatgtcattctccactaaaaggaaccagggatccctaaatggctgattacagaaccaaggcatggaaagtacaagatgagccaggaacaggttcttgtgccaaaaagtacaaagttgttctcaaagagtgatggggatgtaccataagaacacagaagccagcttgtacaactctcattggccatataaagaacaatttgaacatcaaaataaataatgctatagtctgaatgtgtatgtcccctcccaaaattcgtatgttaaaatcctaacacccaaagtgatggtattatgaggtgaggcctttaggaagtgatcaggtcatggtggtggagtccttgtgaatgggattagttccctttttaaagagaccccagagagctcatttgacccttaagccatatgaggttaaagtgagaacatggctatgaggaagcatgtcctcaccagacactgaatctgtcagagtcttcatcttggatttctctgcctccagactgtgaaaaataaatttctattgtttataagccacccagtttgaggtatttttgttataacagcccgaatggactaaggcaaatagtaacagaatataatccgcgagctcccctttctggtctcacttcggctggatgtgcttagactctcctatttcccactcaagccagtgcttcgggcaggtgggctagtgactttttccgaatagactaaggcaaatagtaacagaatataatccactaaacacacacacacacacacacacacacacacacacacacacagactccatgtagatgtcaataaatgattaagagtttagtgaggaacaagatatttacatagtttcaaagtacatggcaaaaacaattaagtattaactttacagtggagaagcctcgcagatattacttatatcaagtaatcaaagtaaaaataaccaacaatgaaacaaagtgaaattgtgcaccacctgacaggatgcagtgagcatcacttctgtgatatccttcccacgtgcatattcgtatgtatctaatcatgaaggaacagacaatcccaaattgagggggcagcctacaaagtgactgacctgtaattgttaaatatgttaaggtcatgaaagtcaggagaagataaaggaaatgttccagattgagggagacaaaagagacataacatgaatgcaacacatattgctaaactggatccttttgccagtaaagagattactagcacaatcaacaaaacttgaaccagtctgagaactagatggagtactgtatcacaatccatttcctgttttggttattacactgtgatcatgtaggagaacattcttgtttgcagaaaatgcacattaaagtattctgggatgacagggcatcaggtcaacagcttcctctcaaattgttggggggcgggtagaattttttgtaccattcttgcaacttttttgcaagtctgttattgtttcaacattgttggccgggcgtggtggctcaagcctgtaatcccagcactttgggaggccgaggccggtggatcacgagatcaggagttcaagaccagcctggccaggatggtgaaatcccgtctctactacaaatacaaaaattagcgggcgtgttggcgggcgcctgtaaatcccagctactccggaggctgaggcagagaattgcttcaacccgggagacagaggttgcagtgagccaagatcgcaccactgcactccagcgtgggcaacagagcaaaactccgtctcaaaaaaaaaaaaaaaaaaaattgtttaaaagtggggagggggggaggcggaacaatgtcactaaaaactaaaggttaaaaaactgatttcccacacttaatcttgatagaaaagaaacatcagactatgccaaattactaggaaataaaattttggatccagaagtttaaacatttaaactttctctttaacaattgacctcaatcaggtcatgactggtgaaagagaaaagaacatgaaaggttcccactaaaggagaggaagttcttaggagaggaataatgaaagagagagtggaccaagagtgggtagaacaatggtattctgagctaccaatggctgtaaccatcaggaaaacacaatctcagcatctctgaaaaatgaaggggctgtagagctgatatctcaaattccttgcaaatgtgggactagaattgccctaaaatagaagtggtttcccagctcaatttgttattacattatgcttagctacatagtaatacaagagaatacaaatacagaaataaacgtgcatgaaccctgaattctcttaagttgtggaagtccgtcaattaaagtgtaaaatacaatgcatttgcccaattgttccttacgacgaaaattctgtgacaaataaaaagaacaatgaaaacacattaaagtgaaacaagatcaccttcagcggtcagctggctgtccttagttaaaagacaagtcatgtcactgtgaagtgaccgtcacatttgtcctgaaagaatagggagcatttcctagaaaggggtaaaagtgcaaagaatcctgtccccttccctggtaccacgcgttccttggggaggtcactaggcccccaacagcacaggggtgagttagcactggactctcagcacttcctttcggagaggacaaccccctgcgtcactggttactcactcaggatgcagggcagaagtttatccccgaggaacttagcacagttggctcccgccctcccagccttgcggtcctgggcccaatctcagggctctctctgccccgggtaccctgcagcctccagcgggagggtcgcgagaccccaactcgcctccggcccgcccagcgggtgcgcccaggggctgggcagacgcggcgtcttccctccccctaccgtcgtgccggcccccccacgcccaccgccaggctcagcccagccgagaaggccggacgccgaccgcccgctcctccgagactcggcctggccctccccgacgcccgtccccgacgcccggccccgcggagcccactggacagcggccggggggcggggaggcccgggggcggtgccgccccacacccttacctggcttctcgtggtcatagcctaccacgatgaagtagtcagccagccgggccatggccgccgccgccgcgctcgggaagcgggtccccgtcgccgccctcgccgccgccgcccacccggcccgggagggctcagcattttccctgcagcggcagtagcggcagcggcagcgcttcagccatgtttgacaacc
